United States Patent 7,365,185 (GENOMIC PLANT SEQUENCES AND USES THEREOF) - sequence listing, part 100

SEQ ID NO: 86998 - DNA, 706 bp, Oryza sativa
cgcgtgatgtgacatttgacgaaactaatggctctcaagtagagcaagttgactcacatgtgttaggtgaagaggaggatccgagcgaggcaatcaaaacattggctcttggggacgtacgtcctagggagccacaacaaggagcctcttcctcaacacaagtggagccacttacatcaacccaagccgacgatccctctatctcaagcttggatcaaggtgaagaaggcgagcaagtgccaccctcaccgatcatcttagctcgcccaagaatccatcaaagtatccaaagagatcatcccaccgacaacatcttaggagacatcaacaagggagtatccactcgttctcgtattgcaaatttttgtgagcattactcgtttgtgtcttctcttgaacctctaagggtggaagaagctctaaatgatccggattgggtgatggcgatgcaagaggagttgaacaatttcacccggcaaaatgtgattggcacaaagtggatcttccgcaacaagcaagacgaggccggggtcgtaataaggaacaaggcaaggttagtggcgcaagggttcacccaaatcgaaggattagatttcggtgaaacttttgcgccggtagctagacttgagtcgattcgcatattgcttgcttttgctactaacctcaattttaagctatatcaaatggatgtcaaaagcgcctttct

SEQ ID NO: 86999 - DNA, 962 bp, Oryza sativa
  unsure (1)..(962): unsure at all n locations
acgacgagaacgagcacaagaacgctcaagccgctaatgcaatacttagcgccttgagtggaagtgagttcaaccgtgtggatggcattgagagtgccaaagtgatttgggacacgcttcggaacttgcatgaaggcacggatagtgttcgtgagtccaaggtggagatcctcaaggggcaatttgagagatttgtgatgttggatggtgagagcccaagtgacatgtatgaccggttgagcaagatcgtcaatgagatcaagggacttggctccaagggcatgaccgatgaggttgtggtcaagaagatggttcgagcaatcactccaaggaactctaccttggtgactatcattcgtgagcgtccggacttcaagactctcacacctcatatttgctcggacgtattcttgcccatgacatgctcgtgcaagagtccaaggatgtcatccaatacatcaatcaaagttcaaccacaaacatcaagaaagaagacttggcgttgaaggcgaaggaagaagaagaagagaatcgcaagagcaagagcaaggcggagatcgatgatgaagagatggctctcttcgtcaagaagttcggcaagttcatgaggcgaagcggcttcttcaagggaggttcttccaagcactactccatcaagtcaagtggaagacactccgcaagagtgtgctacgtgtgcaaagagcccgggcacttcattgcggattgccctcacctcaaggatggttcccacatcaaggaagataagaagaagggtgagaagaagatgagaagaaggagaagcacaagcatagcaagcgggaacattatggccaagctcaccttgngatgatcttcggctccgactccgagtcaagctcaagtgatgaagaaggagtcgccacatttgccgtcaagccttcatcaccaccgagactcttcgactactcaagtgatgaggatgc

SEQ ID NO: 87000 - DNA, 670 bp, Oryza sativa
aaccatctgatatgcctggtattcctagagaggtgattgagcactctttacatgttaaggaagacgctaaacccatcaagcaacgactccgccgttttgcataggacaggaaggatgcgatcaaggaggaattgaccaagctgttagcagcgggcttcattaaagaagtccttcatcccgactggctggctaacccagtcctggttcggaagaagacggggcaatggcgcatgtgtgtcgattacaccgacctcaacaagtcctgtcccaaagatccttttgggttacctcgcattgaccaggtagttgactcaacggccggctgcgagctactcagttttttggattgctactcgggatatcatcagatccgactaaaagaatccgactgcttgaagacctcatttattacgccttttggggcctactgctacatcaccatgccctttggattgaagaatgtaggagcgacctatcaacgcatgattcagagatgtttttcaacttagatcgaccgcaatgttgaagcttatgttgatgatgtagtcgtcaagaccaagcagaaggatggtctgattgcggatttagaagaaacctttgcaagcatccgcgctttcaggatgaaactaaaccctgaaaagtgcatcttcggagtaccgttagggaagct

SEQ ID NO: 87001 - DNA, 4340 bp, Oryza sativa
atcaaataaaatcctataaatagtatgatattcatagagcctattgggatataaattttccaaaaaaggtgtattccgtgtattttgtattcaaattttggtttatgaaatttgttcagaatctaccggctttccatcagattttgcgaaaatcgtcattccgctagcgcccggaacggaaggtaatcttggaatcataaaccctgatgagtctactttggctcttgtttggcagcagagtcaacaccgccatctagctgctctaatgcattggataagctggcttttgagcgcatcttccaaatctttctatcacagcagtgaacatgtcgaggtcatcgttcgggttgagcatcgaccgtctacaagattccaatcagcagggttgtagtttgtgctcttcagattcaacgaagacttccatgtcaatctttgtttgagtccagtgaagataaaaaatctacgactaaacatcaaaacttgaaaaagccaaaaccgtagagacagtagggattgccggtaggtcaagcggtgagcacatcagaagagggcccttgatgtacttgtcgcggcattgccgtgggtccccgacgacctcatcctccactattgtgttgttcgatttggaagtttgctttgaaatttcagttttctccttttgaaaggatggctcgatgccttgtgcaaaatcttacaaggcaatgtaacaaggaactgagtttcctgattgtgaatctggtcttaacttttaatatatacttaaaaaaaaagaagaagagagaagacatgctttgtcacaacttcatcacaggtcattaggattagcaattaggtttgtctcaacaaagatatccttatactgtaaataattcatttttatacagaaatttaaaggtaatataactcttgtacagaaacttctttacatgcaaattgaagtactacatctgcttttaaaacgagtaatttaggtttttttaaagccaacagtatataactttgactacttagttctttagcataaaatattctaaataagttttaatactcaaatttaactcatgttgacttcacgtatttttaaatggtattttagactgaagggaaaacacatattttaaaatagattttttagaccaaagggtttggagtaacggagagaaagacaaacctatagcctttgtaaggcgggtcggtagctgtgtggcgccatcggcacatctataagaagctgatgaagagcaacgggtggatccacagcacaccggacggcatggtgacgccccccacctctgttgtctgcttgttggtgtagctgaggtaggatccagtccctcgtggcgaacggggttgcactggcgagcagcacagccaggttccacagccccacggcgcgcgtgacatgtgagagaagtggtcgaagccgaagttgtagtagagcttgacccacagcacgttgagccagtggtagaggatgcaacccacctaatagatctagagctggcacactggctttagagacctgccgtcctttggcttacacaacatgtacaacacatacaaattaacaaagggtaattggatccatatcattgtaaatttgtcgatttgaaaaaatatcactgtttttcgtgatatcgggtcataccactaaaattttgcaaaatttgaaccgtttcattgtcatcaagatttccattagtgcatgcatttgatggtacatttccgtcagcgccttcatttcttctccatctctagcgcgtgtagcaaatctctagtgtacttgggctcttggatggcagcacagagaggacttattgatggtggctcatggacttgaggactaggggcggtgacttgtgggcttctttgcctacctacgttgacacccgtccccgcgctccccgccatgctccccaactgcaacgagtaaggcagaggagacacgcagccgtggcaacgtcgcattggagagagagagagagagagagagagagagagagagagagagagagtagtgaggggcttgattcagcggcggcagcggcaagcttagcacccgacggagggagatggagctagaaaggagcggcgccggtagcggccttcaaatccgacgagcttaacaccctggtggagccggaggagatctttggttgtggcctctatatccgacgggcttgaccccacggtcccctgttgctatagcagacgacaccacagtggaggcgaggttgtgaacggagattcgcgtcgcctcttattcttcccctgccaccgtgccatgctctagagctcggccggtgctcgtttcctgttgaagctgacgagggtgttgatagaaatagtgatggagtatcatggtttgaattttgcaaaattttagtagcatatacccgatattgcgaatagtagtagcattttttcaaatcaacaaatttgcaatggcttggatccaattaatcctacaataattctgtcaataacatatttataattggactagtccttaaaaaaggggatattccctcccattccctatagtgtaaaattgctatggaaatcggataatatagagacgtgatattcttgatgacctgcgcaccggccgagtggtcgacaaagtgcactggtggttcgtaatgcataaaggaaatatcaaaagcgggtaacactacataagtgacactaaaactaaaacaaggtcccaaataagatatgagttactccgaagaattatcatcaactgcaacatcattatctgaaacttcagtctcatgatcatcatcggaagcaaggaactcatgttcagaggaagtcaattccttgtcactttcatcaaggattggcgctgctgtcctggaagtggaagcacgatttgacatcgctccatgtgaccttttcgcacgttttgctgattccctggtttgttttctaggtgatctctttgtgccaggactggtgtttcagctgtataaccccaagtttgagttcttgccacattttgtgagccttcagattcatcttgaagccaaccttcaacattacaagtgtcattgtcttcgcatgcttccattgtagcatcttctttctgcgctgaaccatccttcttcttcattcttgagttgagttgtacaaaaacaatgtcatttagcctttgaacaattagcttgtttcttttctttgtttgagtctaaagagagacatggaaggaggtcactagtctaattcatttaaaagggggaaggagctgaaatataatacatgaagattaagaaaatgagaggaaaatgttacccattcaaatgcactccaatttctttcacaacctgaagagctgcatgtcaagtttagaatttttgtagcaaacccttgcaaatatggtgcttttgatccccagacattccaccagtgagcttgaaacaaaacaatgtaccagatagtacatggttgctagataatgaatgtacttgcagacattaagcataaaagcatttaaagttaccaggattaaatgaatcattgtttttctctctctgcctcttagctcctggatttccaaaagttccagaagcttcagagtatgccaacatttcagctcctgtgatcttgtcttgattttgatcatctggataaaaacgctgaataaacttgtgaacactgccagatattttttctgaactaatgaagccatttctgttgctataaaagtagtaaggattgagataatatgccattaggtgaagttcactatccaacttgccatccatgtaaaaatcaatggcattaataacaggaatgcaaagctcaagctcatttcgaagcaactgagctagctcaatccttgcatccatcagaccaccatgaatgaatcctatagctggccttttatcaccatcaacaaagcgaagaagcttaaccagtgaacggaaaacattaatggctaactctacattatcccaaaatttttcatcagatacaacaactgaacttatccttttagcttgtgcagtttttgagatcttgagagcattgaacctgggcagcagtaaaatgtttataaaaatatataaaataaaattccagtatagctgtaagagtttgaattcatacctgttacctatgaacattcgtttttaactttgatttcaacttgtgaaagctgctcaatgtgagaaatattgtggcaaaacgtgtcgctccaggcctcacgatctacctcttctcagtatatgagcgcatcaaatcaagagttatgtgatggttatagatgaaagaggtaattttcttggccttatccactactctttgcatgcgttgatccttgcaaatcttttcta

SEQ ID NO: 87002 - DNA, 722 bp, Oryza sativa
taacaaccaactgagaattccacggacgatcagacgccgaatgcccaaagagatcgcgatccttaatccatgaagcagcgcctcatactctgccacattatgggacgcagaaaaatgtatccacaatacgtagctcaatctttctccagtcagggagatcaaaacaaccccagctccagtgcctgaaagcctcttcgacccatcaaaatgcatggtccaatactccatcttctcctcgggcatgtcttcttggcactcggtccacttggcgacaaagtcggctaaagcttgggacttaatcgaagttcgtggcttgaaggatatatccagggacatcaattctaaggcccactttgcgattcgtccatttgcttcgcgattacgaagtatatccccgagtgggaacgatgtgaccaccgtgaccgagtgaccttggaagtagtgagataatttcctaacggtaattaagataccatataataacttttgaacctgaggatatcttgtcttggagtcggccaaaacctcgctaacgaagtagattggtcgttggactttttgaacatggccttcttcttcatgctcaacaaccaggaccgtgctcacaacctgagaagtcgctgacacgtataacaatagtggctcttgcagatatggtgaggccaaaattggtggagtagtgagaagtttcttgaagtcttcaaaggctttttgtgcttcgg

SEQ ID NO: 87003 - DNA, 1868 bp, Oryza sativa
atacttgcccaccaaaatctttccttgagatcctggtacatcttagtactaccagggtgaatggagtataaagtatcatgagcttctttcataactgcatcttttagatctttgttgtcggggacacagattctctcacccaaccatacagttccttgctcatcctccaagaaaccaatagcttttcctcttctcatattcttcttgatctcttgaatatcaggatcattaatttgggcttctctaacttgatcaattagagtgggcttcgcttctaaggctgcaacgaaacctctaccgacaattcccaaatttaatctttcaaattccttgcataattccaatggcaactgtcgtccttctgtagcattgcaatagccttttctgctaagagcgtctgctaaaacattagcctttcccggatgataatgaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgcggacgtaactgtcgagaggcataggcaaccaccttcccatcttgcatcagaacacaacctaacccaagtttggatgcatcgcaatacacttgaaaacccttctttggatcaggcaaaatcaaaataggagctgatattaagcgacttttcaactcttgaaaactctgctcacattcttccgaccacttgtacttcacatctttctgaagcagtcgtgtcatgggcttagcaatcttggaaaaattctctataaacctccgataatatcctgcgaggcctaggaaactgcgaatctctgaaactgtctttggttgcttccaattggttacggattccacgttactaggatcgacggcaactcctccggctgagatgacgtgaccaaggaatttcacttcagacaaccaaaattcacacttgctaaacttagcatacagttgatgttctcgtagcttctctaatgcaagacgaagatgttcctcatgctcttctttggttcgaaggtagataagaatatcatcaataaagaccaccacgaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggcacctttaagctgatcaaacaaatcatcaatcctgggtagtggatacttattcttgatagtcacatcgtttagtgcacgatagtccacacacattctctgagtatggtctttcttttccacaaaaataaccggagctccccatggtgatgaactcggtctgatgtatcctttctgtagcaaatcatctacttgcctcttaacttctgccaactcattggctgccattcgataaggtctcttatgaatcggagttgttccaggtaccaaatctattctgaactctatatcccttttaggcggcataccaggtaaatcatctgggaacacatcaggatactcccggactataggaatctcttccaaagttatctggttcagtcttgaccttaaagactcagatgacaatgcatgaacagttacaactcgaccatcatagctggtgagagttacttttttgttggcacagtctatcacacctttatgtctggctaaccagtccat

SEQ ID NO: 87004 - DNA, 680 bp, Oryza sativa
atggagatcacaaggctaaggaatgagatcgaccagctcgaagccagtttaaggaggcaaactggagaagacctgtcatctgtgtccacagtggatgagctcagccagctgcagctgcagcttgaatcatctctcagcaaagttcatgcgaggaaggtactagcacttgcttaaatatggcagaagattagtgcagatcagcatcaaatccttatggaatatacaagtcctccacgatttttttttctttgctcacaaattcacaattagagtttatatgacagaatgtgttaactgcatgaggtgcttgtgtgcaggatgagctcatgagccagcagctggaggatatgcgtcgcatggtacactactcccttattgtagtcgcagttgtggtttttgctgatgagtggtgagctgaattaatatatggattttctgtatgaaatgcagcatcagaccgtgcatgagcagaacaatttcttgtgccgcatggtaactaaaatactcctactagtatgccactgcattggcttaatttctttttgagttcttcctaaaatgttttcatgattcgagtgaatatcctcttgtttcttacgtgtcatctatcctataattcaccaactcgttttactcatcttttactcttacactcttacattcatcattcaacggttcag

SEQ ID NO: 87005 - DNA, 693 bp, Oryza sativa
tcgccattattccccttgccttcgccgcttgcgctctaactcctcgtttcctgtgccctaccctcgccgcactcgctcgctctcaagctcctccgccggcgtcatggcacggggctccgcaccgctcgacggtagcgtgctgccgccttctcgcatcgtgagcgagaggcaggccgggctgccgcgccgattcatgccggaatctaccaccggccgggaggtggtcgcgctgggtgagggacgcccggcgccacactacccggggcggtccgtcttcttcctctctttcgcaatggtagggctggtcctgccattctcttctttcttcatggatgttttggagctttatgatctccagatggcgcacctcacccccaacgcggtaatgacgttggccatcttcgcgcacctgtgcgagatgttcatcggggtgcgcccatctctccggctgttccggtggttcttcaccgtacagccggtgtcgccaccgtcggtagtcggtggctgttactttcagccgcgggggccggtgctgaaccgctacattccctgcgttcttcacaagaagtgggacgactggaagagcgactggttctacacccccctcgccgacgaagtgcgccttcgactttcgagccaagccccggcgcaggccttcagctggcgggcgccggtagatctgggagacggcta

SEQ ID NO: 87006 - DNA, 597 bp, Oryza sativa
ttaccgcgtgtgcggggatgcatggtacggtgttgcggacttgacagaaccgctgaatgtaggagcgaagagactcatcgtcccttcgctgtaccgcatgcaagtccgcttcttcacctgggcgcggatatgtgccctggaagttcatggtgaactgctggcacaaatcctcccaagagtggaccgacgcgggtggcaagttcattagccaaccccgcgcctgacctctcagggccatggggaagaaattcgccatgaccctgtcgtcacccccggcggcctcgatcccggtcgtgtagatctggagaaactcggcggggttgacgcttccgtcgtatttttcggtgatggtgggccggaaccttgggggccaacggacgttccgaaggctcgccacaaaggctcgacagccggcaccgccaaccggggacacggggggctggcccccgtgcccggaccgaagtggcgctccggacgaggaagcgtcctccgttgcgtgggcagcacgacgaccattgcgccggcgctcgatattgaggcgggcatccggccccccacgcacatcttcttgggtcggaggcgttgacgagggaatgg

SEQ ID NO: 87007 - DNA, 585 bp, Oryza sativa
gtcgaaagtgagggcaacctccgaccaccgcgcccgccgcgtcgcctcatgggtaggggccgcggccagaagctctcgcttcatggccttgaggctccggcgagaaacgtgagcgcacgctcccccatcgacggtggcgacggtggccccgggctcctggaaccccaggtcatcgtcgccatcgtcgacgtcctcggcggtggccttctgcttggcctcacctcgccggttgccggcgggagccgccggggccttgccctcacggcgctcctgcttcctctcctcctcccacttcctcgtccgctcagccaaacttttgaccgcgcggcagtccgcgaggtcgtggagggaggtgttgtgcacagaacaccacttgccggtcgggcgctccctgctgggagcgccggcctccttctttttgtcgctcgcaggcctcccctttcgggtggcccgcgaagcgccctcgacggcgaggacgtgaccctcgtcgtcggaatgggccaacctcttcttcctcctcctgtcccgccgccctgaccgagcggcggacccgtgggcggccggagctgccacaccggaaccgga

SEQ ID NO: 87008 - DNA, 787 bp, Oryza sativa
atttcgaattcaactttttggatatgaaattcacgtggttcgtgataaccaccgtaccgaatgtgggatgaccgcagggccggacacatcctctaatgcaacgtgtaccatattttaggaaaccttctgctgcactacatgaaattagcattagcaaacagtgctacgatgttcatcgacacattgttcaatcacatgaaaattaaaattactcagcgagacagttaagtacagtcaacatacagatgcaacagtttgcttctatttggtctttatcccatcagtacctttagaaccaccatcatacgcagaaaggaagaacgaactctgattcttctgcagaaacctaccatgaattcccaattgatttagtgagcattttggcataaagtatgcctaactatcagggattgctacaatctggttagcacgtgattaaaattatggtattgaccggaaaattaattgtgtgggacagattttcaagcatgttttcaaaagtcggctaacttgagagatgctagtatatatagaagaaaaataacggctggaattgcatgaagaaatgaaggtgctaactgacttcacatatttgtgtatattgatgggaaatgaatatgctgctatagtgatgtacaacaataaaatcaagaaagatttgcttacttgagaatgtccagcaatttctgctgtagtttgttgagtgcatcttcttccatggtgacagacgcaagtagctccggcaatttcactgcaaagcatgcaagaagtgaaccctttcaaacat

SEQ ID NO: 87009 - DNA, 1800 bp, Oryza sativa
caaccaaaactagctcatttttcagctcatttaacccttgctttgaacaatgtgatagtctcttcactgctatctcttgaccatctaaaagagttccctgcaagtgtgtgatttagtttgcacgtatatatttagaacttggtgtgaagaacatgaaaagggatacaaattgtatgatcataaaatgtattaccgggaaaacatttttttcaagggaaaaggtgaattcattaaggaaagagtacgaattattctcctaaactatcgtggttgacataattattcccactgacatcgctcaccctaaacttccaataccgaacaaattacccccctcaacccaatccagagcggttttatcctacgtgacaatccaatcagcattttattttttaaaaatggtggaacccacttgccataccccctcttcctctcttcctctcttccacatgacccacatgtcatacgtggtcagtgggcgcggtgcagaaacgggcggtgggcaccggcacgggaacgagcggtgggcaacggcacgcgggggcgggccggctgtcggccacccgagagagagagagagacaaagagagagagagcacagggattgggaagggcagagggatgacaggtgggtccatgagttttttaacttttctttgctgactggattgccatgttggtgccacgtgtacaagctcgagtcgaaaacaattcaaaacagtgcttaaaggggttatttgtctggtttgtatagttggggatgaaggatgtttggttttcgggttcaggggtaattcgtactttttccattcattaattaggagacaattcctcacacacaaggtgtggtatgagggtacaagaattattatgcagaaggaaaagtctatttatgccttgaaggaacatcctctcttctgtttttacatgttgtctaaaaagtcataaaaatataaaaagaattgataaaatagaacaacgtgtgaagtgtatctcgtgccagaaacctaaatgaacttcacatcaactagcaatgccagatacctatgagcttcacacatataacgtacaatgctcgctatctcgtcaattatcctattctgtaaacagtgatctttttgttaaatgaattttcctataccatggtcatgagctactttatctccctgtcctagtgtggtgaacttgtccaaaatccaaacaaaacaatgaaaaggtaagatcaattttacggtacttaagaaagtaccttaatacctttaaaactttgctatgtggagttaccatcatttatattagaaaatatgagaccttcttaaattttaataccttctaaaaatgataaaattgcccaattaattaaatgtaggtcatttcgtccagattttattatattatgatgataccttataaaccataccaaaaccaccttccctgagcctatttcgctcgtcgaagttatttgttgctgtctgcaaagttcggagatcaagactgaagtcatcttgattaaatgaccctgttgaataaaaataagtacatgacagcagtcagcagcccaggatatatatgcctgatcagatcggctgattttacagcctccagtttatcagccctaaaataataataaatgtggtggggagtgcaatattacgtacttagcttgttgcgatccatgtgtgttaatagtctcttcatcacaaattataataactatattttttatatatttttatcggtattcaatgacatactatgatcattaatgtattccatattatgttcccaacaaatatgaaa

SEQ ID NO: 87010 - DNA, 956 bp, Oryza sativa
aagacccgatcccctcaggccagaaaatgcttacgctattatgagggctcgaggaagttgcgccattatttccaggcgcatcgggtcacggtggttacgtcttaccccctcggccaaatcttgcataaccgagagggtactggacgggtggtaaaatgggcaatcgaactctctgagttcgatttgcactttgaaccacgccacgcgatcaagagccaggccctcgccgactttgtggcagagtggaccccagctcccgagcccgtctccgtccccgaggccagctcgggcccctcgcagctgcctcacaccgcctactgggtgatgcagttcgacggctccctgtctcttcagggcgcctttgaagaaaggcatgcccagccgacggctcgacccgaccccctaggggagacggacgcacctgaacggcccccgaggcccgtcggagtccaggcctcgggacccgaggggagcgctcccagctcccctagattgattgcttggatcgctgagatctaggcgtacatcgcagataagactctacccgaggaccgcgaagggagtgaacgcgtccagcgcatctccaagcgctacgtgctggtggaagggaccctctatcggcgcgcggctaatggagtcctcctgaagtgcattcctcgggaacaaggcgtcgagcttcttgccgatatccatgaaggcgagtgcggagcccactccgcctcacgcaccttggttggcaaagcctttcgccagggtttctattggccgacggctctcaacgatgcggttgacctggtccggcggtgcagggcgtgccagttccacgccaagcaaacccatcagccggcccaggccctgcagaccatacctctttcatggccgtttgctgtctgggggctcgatatcctgggtccatttaggcgggccccgggagggttcgactatctgtatgtcgc

SEQ ID NO: 87011 - DNA, 508 bp, Oryza sativa
acattttgcagtaattatatactattaacatttttaatctgacaaaatataggccaatatgtcggacagtgtcggatgctgtccatgtgttggatgccattgttgggtatgatgcacttgacgctgaagccactggagcagcatccaagtacattcctaatggtggatatggacaattcttaaggatggatggattcaaaggcaagaggattggtattcccaacggcttcttcactcaagaaatatttgagaagaaacagctgagggcataccaaaaacatattcaattaatgaggtacacaaacacaaagcacttctaaaagataatacatatgctagcatatgtgcattcagtctataaaagattttggtgatattcgtattagaagcatcatttatgaagaaagaaattgttgcagtaaaataatattctttctatgatgtttgaaagtataataaaatgttatagtcaatattgtttgtttctggcaatctggcataaaaatga

SEQ ID NO: 87012 - DNA, 1272 bp, Oryza sativa
caccggcgatgtgggggaatcggggtccggcggcggcggacggaaaacgagcggcggccgaggtgcgggcgggctcggtgagcgcgacggcggcgatggtgcggcgcggcggcggctctagcggcggcggctcgcggccgaaggcggcggcaagcggcggagctcgggtgtgacggcgcgggcgcggtagggggcacgggaggagacggcaagtgggggaaacgagagagggagctcgggagagcgatgtataggtgcgggagggggcggacgtggccggggaggtggccgatttggccggcgacgtggggaggagagagagaaagtgggggattcaaatcccccaccacttggggcgcgcgcgcgcgggagatgtggagggagagggcggcgacgtgggcgcgaggtgcgggcgcggagtggaggcgcgacgtggagcggaaaaggcggcggcgattgccggcggaggcgggcggctggaggaaggggacggcctgacaggtgggccccacctgtcagcgtcccggagagaggggaaggggaacgggccggcccaaacgaaagaggccgaacgcgggagggagtgggccgacggcccaacaaagaaaaaaggagggaaaagaaaagaaaaagagaaaaaagatttttccagggattaaaattgcactttggtgatttttaattggtaaaaattatttccaaggctctgaaaattccactaaaaatcctgttaatatattgtgacatgtggaacccaagaaaaatcccacaatgccaattccaattattatttgcatttattaattagggaattagctctaggttaattaagataatttcttcggacgatttatttagccaaatttttttttaaagcaagcaaaaggggaaacttccgggcgtgacaaacctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtccttctctcgctggtttcgaggatacgagtcggcttctccacatatgtcagatcttcctgaatttcgatgtgatccggacttgcctgttcctcaggaactctcaaacatttcttcaactgagagacgtggaacacattatggatgccaagcatgttggaggaaagctcaagctggtaagcaacttcacctctacgttccaaga

SEQ ID NO: 87013 - DNA, 9287 bp, Oryza sativa
ccgcgctcgccatgggcgccgaccgcgccgtccacgtcctccacgaccccgacccctcccgccccctcctccccctcgccgtcgccaagatcctccgcgccctcgcgctccaggagaaccccggcctcgtcatcctcggcaagcaggtaggcgcgcccaatcttcgatttgaccgattttgtggtatagagattgaatttacttgatttcactgataaattcgtgggattgtaggtaggtgatgttcctgcatgattacctagttgtggtgattcttttttgcttcacagtgtgattatccaaggattttcttaatgggaagagttcatgggatttcaggattattatatatttcttgcctcattacatatcttttatgttttattgcattagggattagggattcttgttagcttgtgagactgggattggggtatctcaatttgatcgagagctttcattcttaatgcgaagagttcatgggatttcaggattattatatacttcttgcctcattacatatcttgttatgttttattgcattagggattagggattcttgttagcttgttgagactgggattggggtatctcaatttgatcgagagctttcattcttaatgttcttataatgttcttaatgcgaagagttcatgggatttcaggattattatatacttcttgcctcattacatatcttgttatgttttattgcattagggattcttgttagcttgttgagactgggattgggtatctcaatttgatcgagagctttcatttttgcagcataattaattgtgtgcttgtgattacattttgacggcttcatctaatcaagacatattcctgtgatttggggggcatgacttttgtgaatatggaatgattgactctgtatttggagcttagtacttcattcttacgataataaaggttgctatttccccgcaaaaaaaaaataataaaggttgctattagtgtgttttgggttgaatcttagtggtttacttcttggttcgttgaagcttgtgtaaattgacaatgttgatatccatgtgattgtatagtgcaaatttagttaccaatatgcactatggtaccaacagtgagatcccatctcaaaaaataaagtgagatctgagagaaccatggttgtgttaatgcaagccatttgctgattttgcttctaccttaatttaatttattgccctaaagtgaggtatagtattattctgagacactagggtgcatctctatacagtgtacttgtgttcaacatccatgaaattggcaaattgctcctacacatgtcctcgtagtgcttgactttgttgaccctgtttaatatgaaagttcaaagtgtagaattggtgcattttcccccctttagacctaatgctcctggattatttcatgacattgtctaattgctgcatataagacttgaatccttagtactattttattaaactttgacgtcttgattttttttcaaaatgttgacagtctttgctgtcatgagcaaatgagtacgtacaaaagacaaataagaaaatattagctaactagtgataggaaatttaacttgaaattatatatattgataatcatcaggtattatatcttctggtaattgcaggcaattgatgatgattgcaaccaaacaggacaaatgctagctgggttgcttaattggccacaaggaacctttgcctcaaaggtgtgttttttgttactccttccattgctttttactgctgtcatgattgccctcgcatgcaagtggggcgccaagagcatggcacagcaggctgggctgggcttgtcattttaagttcattacttgaagatttgttctccccttctcatcacttccccccgtgcctgttaatcctctcctcaaacacagctcctggctggggagatccagggccaaaacccccagttacccaagggttgtcccattgatatttaaacctagacaaccattacctttaatttgattaccaaatgagttcttaacaatgtatttgctccttcaatttttttctgcatttaaatgatctgctcctagaccctaaaccgtatgaagctcgtgttgaactttggtatagtttctcccacaattgtggaattggccacataggaccttacagtttttttggtttgctcatttttgtccttctgccatgtggcgtcccgtgtggacttgtccagtcagcgccttctttccaatttagactatgcaagtgactgaaatgcgtgctttgcatcacctgaaaaaacaaataatgaactacatagggtcatcctacatcgatggtaagaaaaattagggcaattcagttactttatatagtttgtagcatttgaaggccctgaatattgcctgcccgaaccctggatattgcctgcctgagaccatctgtgatgtcataagaggcattaccattaaaacaagccaactaacgaagctcagggcgctaacataccaattcacagttgaatgaccaatttgagcaagaagcaagggaccaaatgaactattaatctttcagattgtggaaggaatttctgagcactgatggaagtttgctgttccgtttttttaatcccattttaggaacattaattttttcttctttcaagatatctgatttccttttgttggccgaacatagtagagcaaccaaaaaaaatcactgtaatggcgttttctatgggttcacattgaccaagtgtttattggttttctcttatcatggtgtttccaattcaagtttgtgttacacaggcagttgtattcaaagatgctgtttgattctggcaggttatattgaacaaggaaaaggctactgtggagagagaggtcgatggcggaatcgagaccattagcttggatttgcctgcagttatcacgtatgttccatgaaacatttattttctttcttttagttttatttaacaaggctagtacttcgattcttcataagcattgcgatcatttagtgatctctgtcacatagctggatctttgtattgcattgtggttttgagccaatttcagaaattgcctaaactattgtttgatttttgtgacagcacggatttgagactgaaccaaccaaggtatgcaacattgccaaacataatgaaggcaaaatcaaaagtcatcaagaaagtcacccccgaagatctggatgtagatatcagatcagacatggaagtagttgaggtcactgaaccacctaagagaaaagccggtgtcattctttcatccgtcgatgagctcgttgacaggttgaaaaatgaagcccgtgttttataacattctttgtactaatgctcatgagctaaggaatgtggcatatgcaaataaagtgtagttataaatggtcatcgtatgcaataaaaatgtggcgttcccgtatagcaccagtatacctgctaatggtcatcgaaatgctagtgtgtgtgtgtgattttaagaagccatgtaagcagaagtgttcactaaaatcaatcaatctttactcattcagaaaaaaagataattctatttatagaaataaagatctaggcatctagcacacgtatgatgtggtaaaattagtttcgtctccactagatatgccttgagctctacaactatttacgtttcaacctcgttgctgttgtttcgtgggatgtagtgctggcttggtaaaggtaatttggttcaaagctgaaatattttcaagttaataaatcgagaggacaaaaacattgagctaggaaagtgttcataaatgggaagtgtctgatttttcttttaactgaaggagctcatgggttgtacttggaagcagcttctcactaaagtcagagatataggtccaaacaggagggactcgtcctcatggacccatacatcaaaaacacacatcccaacttatataggccgtgtttatgtcccccttcaaacttccgaaaatttcgtcacatcaaatatttgaacgtatgcatggagtattaaatgtggataaaaaaaacaattgcacagtttacatgtaaattgcgagacgaatctttagagcctaattactccatgatttgacaatgtgatgctatagtaaacatttgctaatgatgaattaattaggcttaataaattcgtcttgtagtttacaggcgaaaaatgtataatttgttttattattagtctacgttaaacactttaaatgtgtatccgtatacttaaaaaaatttttgccaagtaactaaacacaaccatagtatattacattacatgagtcttatcaggttgtattatcagatcgtactaagtacatgaataaatgggagtgacatacagtttgagccgatctatacatactctcttcgtcccaaaaaaagataaatcctgggtttccgtgtccaacgtttgactgtccgtcttatataaaattttttttataattagtatttttattgttgttagatgataaaacatgattaatactttatgcgtgacttatctttttttttcatatttttttcaaataagacggtcaaacgttggacacggaaactcagggtttgtcttttttttttgggacagagggagtacaaaatatcactgaccccctggtggaagcagatcgtctgacgttaggcgcacaacgtcagagggacgtccagcgtcgatccatcgtccgatcgacatctcacggtgctgctgcttccttcgttccgcatcgcacgagcacggcgaggacggcccattcagcccatttacgagcaaccgcggagggacaaaaacgaacgagactgctcgtcattcgtcaatctgccatcgcgcaaaaaaaaagaaaagaaaaggcaacccccggcatggctgcccaccgctccgctgtggctcgcgcctttctcgacgcgggcgtgagaggagcggactgccgaggaagactgcttcgacctcgccctcctctccatccctcggccccatgtcctcccccacgcgagagcttccaggcattgccgtcctcgacaacgacggcttccacagcggcggcggcggtcgcgcgagcgcaacgaataaggcggtcaaacgggctcgcggtcagcccatgccagtgaaaatggcccacaaacatcctcaatgtcgtgcgccgccgttcgttgctctgtttctggaggggaaaaagggcgccattatactcggatggagggaaaaaaaagaccattcggctgctgttcttacggcgatgaagatggtgagcgagcaacaagaagcttttctccacttgatcgtaagtctgcactagttacctatcttcttctatatccttcattaatagcttcttagaattcatcaaactccccttattaggttgccccccttgccatcaaagaaacatcagactaaagatacaaatcaagttctgccatctaactcgtgagatggaaggagataggtttgtaatacatctccatgctcgtgtattcttttcctttttgtcatatgtatgcactagtctcatatttttttatagagaaatgctagtaccatgttctgtacctcacattggaatggaattcaaaagtccagatgaggcttggatattttggcatcactatggaggtcaaaaaggctttgaggtcaggaaaaggtacacaaacaaaagacaatcggatgacaaagttacatcatttagatatgtttgtggaaatgagggtcatcgaggacaagacaagagggatcatctaacaaagtgtccctgagctgaaacccgcactgattgtcaagtccgcatgggtgtagtattggacaaaaagacggaaaagtataaagtgactaacctagttttggaacacaatcactccttgcacttgcctgaaaccttgcactttatggtttcacaaaggaaaatttcagatttacaagcttttgaaattgaaacagctgatgatgcaggaattgggccaaaggcagcacaagagttggctagtagctaagtcggtggatcacatagtcttagctatagccttcgtgatcgcaagaattatttgtggagcaagcggcaaagagagatggcatatggtcaggcaggtagcatgcttatgtatttccaggacaaaattgctgagaacccatcattccaatatgcattgcaaatggacagtgaagaacagatagcaaatattttctgggctgatgctaagatgataagtgactatgtacattttggggatgttgttagttttgatactacttttggaacaaacaatgagagcaggccttttggtgtctttgttggattcaatcattttagagaaacagtagttttttgtgctgctctcatgtatgatgaaacattcgactctttcaagtggctctttgagacttttctaaaagcacataatgggaagcatcccaaaacaatatatacagatcaagatatagcaatgggaaaggccattgaggaagtatttcctgcagcatggcatggattgtgcaccttccatatttcacaaaatgctgcaaaacatctatcgcaagggaataatggagaatcaagtattctttcagatttaagcgcatgcatgtatgagtatgaggatgtgacaaaatttgaatatgaatttaacatcatgagggaaaaggtgagcaagcaaacttggctagatagtatatacaagttgaaagaaaaatgggctaaatcttatatgaggaatgttttcacattgggaatgagaagtacgcaattgagtgagagtttcaacaatgacctgaaaattcatttcaaatctgattttgatatcattcgttttttcaagcattttgaaagagtggtgcaaggaaaaagaaatacggaactagcttccgaatttgattcaaggaaaaaattgcctagaatcaaaatgagggcacctatgctgctgcaagctagcaaggtgtacacccctattatatttgaagcttttcaaggggaatatgagagatcaatggcagcatgcactaaagcattggatggcgataatgaatttctagtatcaattaggagttttgagggagatctaacatttgaggaggagtacagagttgttggtgatccttcagagcagacatctatttgcagctgtgggcaatttaataggattggaatattgtgtgggcatgctctaaaggttcttgatttgatgaacatcgagtcacttccagcacaatatatattaaagcgatggacacgggaagcaaggagtggaatagtaacggacagcaagggaataaatataattgagaacccaatgatggaagcttcccttcgctacaaatttctatcccacaggtttctcactttggcccaacaagctgctagctatcctgagtgcacattgttagtaaataatacacttgacattcttagcaagcaaattgaagagcacctcagtggatgtgctagtacttcagatcaaagtgcaacccacaaggaggttatgcccccaaataacttgttgagtaatgcacgcctaaagaaaaaggaggttcgtgttagaggttcaaagcgaaaaagaatttggcttgacaaaaaacgagacactacacaaaaacgacaaagtaaaaaagggtaaaagtccaaaggtatgttctaagaagatattgcaataccatgttactattcagtcatgtgttcacttcatccttttacattatttggttcgaaggaacaaaagactaggcaaaatgcactccatgttggtgcagcaacacaagtggcagaagatagttttgctatggacaaggaggagcctggagaatacatgcacctaaatagcttcactcagcttttgacggtaatacatgcacctaaatagctatgaaaatatataataaaacaaccaatgattaatctttttctttgtaggggcagataaatgatgatcttttagttgacgatgcattttagtgatgaagtcatgttctggaggataacccaagtttggttgcaatactgtgataatacaagtatgatggagctggggaaaaaacatgagaacttttgtgtctatggttaattttgttttggcagatcctagtgaagcacttctgttctgttttggggttatcctatccaagacatactcttatattggcagcactcaatgatgtatatatgtctagctttcatttgctatcttgaaagcaaaactttagggacaaaatatgttcagtcattagatgtccaatgcagcaacaagtatcacattttaatgttcagtgttcactgtccaagactttctgccattgctatctgaaactctcaatctgattttgtcacaaataaaatgacccaattaacttcttcacattctcaaatgctcacaaaaatcagagtatcaaattgacattattatcacattcaatactgaatcacagtttcaattgacatcgattttcaatctcaattcagatattcccaaattctaaaacagagattttcgccctcttcagaaagctatggtggtgctgccatgcttgtcgcctccttcccatgcctgtccgggcttggcagcaacggtcgccctttctcccgtttttgttcggctcttgcgattccttcgacgtgggtggtggtgaagagcttggcgccgccgccgctgtggaagccgtcgttgtcaaggacggcaacgcctagaagctctcgcgtgggggaggacatggggccgagggatggagaagagggcgaggtcgaagcagtcttcctcggtagtccggtcctctcacgcccgcgtcgaggaatgcggcgagccgcagcggagcggcgggcagccatgccggggattgctttttcttttcttttttttttttgcgcgatggcagattgacgaatgacgagcagtctcgttcatttttgtccctccgtggttgctcgtaaatgggctgatgggccgtcctcgccgcgctcgtgcgatgcggaacgaaggaagcagcagcgccgtgagatgccgatcggatgatggatcgacgctggacgtccctctgacgttgtgcgcctaacgtcagacgatctgcttcccccgctggtagatttcaattatggctgtgtttagttcagcgtaaagtttgaattttggttgaaattagagatgatgtaactgaaaaattacgtgtgtatgacaagttgatgtgatggaaaaggactgtagtttgaatccaaactttggatctaaacacagcctatgactaaccattatttgcctgcgtaatattttactactactatgaggtatttactatttta

SEQ ID NO: 87014 - DNA, 4010 bp, Oryza sativa
ggtagctacattttgggacggaagtattagcaaataacatcattcaaggtattagtatttattggttatttaagctaagttcagatacatctttaatgtatcattaaaatgaaactctgctgaaattggctagtaagttagttcatactaataagttctggcaaaaatgctgctacatccacgtggggtataacttgattgattttaaacagcctacatattgtataaaaccaagaacgattactgttcattatggtgcaaaactggaccagacagttcttgttttgaaagttatcaccactgctggctctagcaccacataacattattgaattacaattactgaccttcaagcctttatagagtgctcgtgatctgcaagagcgaagacatgaatggtcatattcagatttaacgtactcttgaagacgatggattttctttcttctgcgccattgcttccaagaccaggcacaaggatatgcaagtactgaaagtatactatgtatagatccttcccaccactcgtatgcagccaccaaattgatctcatcgataaaacggttaaaagcatcttcatatctggcaaaaaaaaagtaacaagatatcacctatggcaaggaatacaaacaaaatactgatggagacatgaacattcttcggaaatatatatgacatagttgggatggtgcaagtaaaatatatgggactttacggaagatcgttattcttacaaattgcatgagatgggatggtgcagccgtgcaggtacattgtttggttggttatatagcatggtaggagactatctttggtaggtcatttggtagttttttaaatgatatgcattatattgcctgtagcttagttttttaacatgattacatgaatattcatttctgccaataagttcatgaaaatgaccaaaagattatttggatctttaaaggtatgtttttatatcgagtttcatctgtaacatcagtactaagcatgacattttgatctgagtctaatcattataattccaacttccaatcgctcataaagaacaatgcaattcttatgcaggtagtaaggtatgatgctagtagtaggatgcaatgtagaatgagccagctattaagaaatttaaatagtgtatgttttccctgttcaacattagtaaatagtaacacgtaaagtagctttttactatagaaaatgtatttacattgtgaatcattatgagatgaaataactataagtgatactctgctaatgtagattcttagaaaatcttacacgattccgattatagcatcagggggtgagtaaggaaggtgccaaggttcccggaaggtgttaggtcccatgaagtacattctgtgggcatggctttgtgtttcttctgccctgctagccccaggtacctacagaacaaatcagtgccaccatttatcgaaacaaatacaagcagaaagatttctttaacaacctgagatagaaagcataagtggtttctggacatcctttaaaatccaactgcactttgaatcagaaactattggagaaattatgaatttgtaaaaatcatggattgagcatttgactattgtgagttgacgtgcagatgccagatctagtgatttcacaatggggaaatatccagtgaaaaccatcaaataagtgaaaacccatgaaagccatgcccataagttctctaaatttagacatagatataggcattaaatacttttctaccaaatcgcaagtccaaatacagcttcatttgagaaataagacaaatttcaggtgaatagcgtcatgttactgttcacctgaaatttgtcttttttttacgcctaaataaagtttgagattcggtgggaatgtatttcatgcctacacctatctctagtaatcttttcataaatttacagaacttttaggtccagtttcacgggtttttacttatttgatggttttcatcgtatatgtcccctttcacaatagctctacattaatatttaatcgatcctaagattatgttgtatgaattgatacatacctcagccaatgaaagcaaaaaggggaaagaagcacagccatcattgtggattgcatttgttgaccggtatgtgatgtcactctcaccaatcttgactctgagagcacttaagacaagtgccaaaagaataatggtaaaagataggataattgcaaaagaccaaggaccaccaaaagtataaataagttcctcaagtggtgtgtaacagtttggcatcttgtacttagaagatatgcacttatatgggcaggacggctcggtaacaccacctagcatgtaaaaagttaatggttagtttctccaatttaacatcataaattttggagttacaaggcaattaaataattatagttccacataagaccatgtctttccaaggacctacctcttacatatatgaagtcagcgcggttaggaagactatccagagaacaaggcatacacagagatgaatcggacccaacaacatttttgtatgtaccgattgggcattcctggaatataatttaatcattactggttgcgaacaaactaataaaaagcatttgctagttaccaaaacaatagtacataaaaagaaactacctagttgcaaagtattgaccatatcaatataggatgttttattagctcatggatacagatagaaaacccggagtacacaatgaaatcctacatagttcagttaaaattaaaagcgtgtctgaatttgcaagtgacacagatcaacctggccattatgaactgttaaaagcataatataaacagaggtctgtgttcaactaactgttggttaagaactctgagcatcaagcagtagttattttggcaaaatgttgcttaagattatagcagtggcacagttatttgcagttttgcaccctctggggggcaaacagtttacgtagtagctgccatgcatcaccacaaaaaccattatttataaggaacaaataaccaccccatcctggtatttctggataagggcgagaaaccagtgtggcaacccaagttcaaaatagtttatctacgagtggtggtgatatcagaggacataaaatctcctctataacccctataattttcctctattcacatggagagaccaaattttggctcctattgcacacatctagcatgaggttaaccaacaggacagaaggacacaactatattctccctcttacatataagccttatatgaaataaagagattaaatttcttgaatacacacatttaaaataataatattatttcctatggattaggttattatcataacaggaacatgaagcaataaaggcacaatgagagaagtgctcatacggtgcaaaatgttccatatagtccaacaggacacttttttcctgttactgttccagtttctccaaaatgtccatcatcattaccagatcctccactatgcaaaaataaaaacaacaataaattttcagaatatttttttctaaattctagtactcaaatactttttgttctagctttgtcctaagtcaagcatgtatatctttgaccatcaatttttagaaatccgtatagttcaaaatatgagttgtatttattaaagtatttgtcagtgaatctaaaaaaaaatcatatgatgttaaaccatatgagtttttaaaaattgatggtcaaagatatacatgtttaaggacaaagctagaacgacaagtaatttgaaatgaagggagtaatacttttcaggatcaaagcaacacgcaaatttaattccatgacaaataaataatgggccatgcaacagcaatactagtaaaagcaggactatatcctgaaggtccacgaggatggtaataatagttgcattcatgaagtaagcatgcatttcgaaaaaagatgcacaaggttgctcaggatcactgatcatgtagcatactatctgtaggtccctgaacacaaaaactcaactggcaggacact

SEQ ID NO: 87015 - DNA, 644 bp, Oryza sativa
cgagttcaagctaaacctgaacaactatctgtcagacttatcatactcgccagttcgttctctcgctgaaataattgcattcaacaatgcacatcctgtcgaagttagtcctaacacaattcactaattcatacttaaatcctttaccttctttcaaagcaagataaacctctaaattttactgacagaatttctgagctactgagctgcaggaggagctgaaagagcatggacagagcatcttgctgatgtctgaaaacacagccgggatcggccctgcagagaaggctgcgatccgtcgtctcaacgagctgtcagtgaatggggtcgagaagctcatgaacgatcatcagctggacgccatcgtgacgccggactccgccgccgccgtcgtcctcgccttccatggcctccccggcgtggttgtgccggcagggtacgacgagaaaggagtcccctttggtgtctgcttcggtggattgaaggggtacgagccgaggctaattgagatggcttatgccttcgagcaggttaccaaagtgagaatgcctccaatgttcaagccatagattatgcagtttaaggttgcaagtgtaaaaaaaaacaaactagatgatatcccgagtgttgctggtgtgccgttg

SEQ ID NO: 87016 - DNA, 1160 bp, Oryza sativa
  unsure (1)..(1160): unsure at all n locations
gaattcgagctcgttaccccaaattgaactgcagagatcaaatactgaactggagcaagcaaggagcactttggctgaggaaagaagaaataaccttcgctcctgcaataagatcaattctaataaaaatagcagctcttcttctagaaagcatctacaaggcagagtatcctcaaagagtaaaaatacggcaaaggaaagtggagctgttgaaaacttggagacactgtaccgttgtgattctgatctgggttcattcatggctagaactaagaatcctgagctgtatcgcaatgggtgtacacaacgtatccgtgcaatcaagcagcgaagtccaaattcggatacatccctggtagaaaacagcaagcaaactagtgcactgaatagccgttctaagactggaaaaactgataccaacagaaacccacagagcacaaggtccatcatggaacagatacttcaaacaaaatttctggccaactgcaagagaaagagaggtaggcgaagcaggccaagttacatgcatgataattctggtgagcatgggcaaacagagtacaagtcgtctgatacatctgatggaaatgggtgtttgctgctacttcaggctcttgaacaagatctttcacctctaaaggcgtcttctggaagtgttggtgagggattagctgaccagaaggatgaattgctcaaggatgaaaaggatgctgacttgaatcttcaccctgcttcccctggaccaaatgatggaccttcagttaaccacatgccgatgtaaaggagggaaaggttttaggctattagagtccttggatttgattttgaggccaaaactgcccctgtatttgggaaccccctgccaaaatccagttattattatagcatggttaatagtggacagaggtttgattcacctgctggaaaccatggtcctggtttgccatggactggtgaaaaccttaaggaagtgactgaagctgccaaaggtggtccaataaagttttaagaccggttcccggagtgtcctccggtcacaaaaagtaaatgnaatgaaggacccatttagaaccttggtttttttaatttacaacataggcctcggtaataactttcggaatatgtattgagccctgagcatggttaatatgatgcaggta

SEQ ID NO: 87017 - DNA, 660 bp, Oryza sativa
ttggccctccgggcctgtgctcgcacgtggtcctgggagtacgtgaagcgatccggtgggacagcacgggtagcgcgagggtctgggagtggggtggagggcgactgctcctgcgtgtgcaccggcggtgcgcctcaagctgtgagggaccgataatgtccgggaagtcgaagtcactaatgtcgaagtgcgtggcggaagcccacccgtgctcggacgaagtcccggtaggaccctgccaagacgtgccgggcggctgtgacgaagtcccggcgtcctgccagaactacgcagacagcgaggccgacacacctgcctgtgacgatgaccccgcagcctgccaggagtgggcgcccggcgtcgtcccaggctgagcgaagcctacacatcgacgacgcgacacttgtaagcttacacataaattgagtatcaattgattgatgatgtacaaatagaccttgaatatacgtacctccgaagggagggggtgtcggcgtaggaacgtgcgcagctggacgaggagcagtcggtcggggacgcacctgtggtgctgcgtctgcctgagcaacgtcggcagcacgacaggtcagcgcacggagaaccgagcgcatcgagtcccgtatccgcgtgtacgtcgacaggtgctcgtctgcccccacc

SEQ ID NO: 87018 - DNA, 511 bp, Oryza sativa
atccccatcaacccctcaccaccaccaactcatttctccatcaaactctccactcgatctcctctccgtctctaccgcttctcttttttctcctctgcaccattgtcatcttgtctcctggtgctcgacgaggcgtcgtctaatagctggaaaaacaaaaatgctttggttacttacccaacggtgtcctgtcgaggggtgatcgggatgacgccggcccggctggtgagacccaccgtcggcttaatcccgaccaccgaattccacgacgccgggcagattatcgacccatctgtctccgtccccagcgtcaccgccgccatgttcgccgccgcggccaccgccgaaccgctgctcgaccagcacggggtagccgtgaccacgtacgggttcttcctcatggacaattcgacaaacactttgtttacgcgatgaaatgctggggagatgacatgcacagaggtttggggttgccactaccaccacttaccagcgtctcgcccccgcgtgc

SEQ ID NO: 87019 - DNA, 1611 bp, Oryza sativa
catttttttccccattgccatcccaattacaggacttggctatttatgtctcctctccacactgttcaattggtcttctgaaagatatattccctaaagttaagtttagtgtcaatgtgccatattatctgcatccaatccagcttgccttggcaccaacagtttgaacatccttacctgttgctgggaccaggttgttcattacgaatttcagtaattactagtccagcctgatgacctatcacaaccctgcatcagtagattgtttgcattacgcaggtttcgcaatggagagaaagaacgtctggaatatcaacaaagaatgaagaccacattctgagatgtcaacatattactaaaattcatgtttgcagtcaagcttatctttctttctttttttttgcagggaaaacttcttttaatttagacttgcagaagatgcagcgaagcagtaacatgctcaacctcaagatgaatagcagggtcctttttatcactcaccgttttgaacccttcaaacaaactatagcgccgacttttccaagttcaaagtccagtacaccctcaagcctagaaaattatgaaaaacaatatcatttctgaaacttctcacacaggaaaagtttttgaaccggcacatcctcctcgacgagccggcgcttttgcacatgaaaatttggcaagatcacatcacaagcctagaagttatggatgggcgcagttaatgtagcagcttaggaacttacttgaaggtaattgagttccacagacgaactgtctcatcattagaacctgtaagtaggattggcaggtctggatgggaacaaacacaggtaacacaatccatatgccctatgagtatttgaacacaagtcctgctcttgcagtcccagatctgactcaacaagatgaaataattacaacggcatttccacaaaaaatgatcaagaggtatgacaatactcttgcaattaaaatgtcttaccctagccgttttgtccaaagaaccagttattatgtattgctgatttccacgagtgaagtaatcgaaacagctcactgcagatccatgcccaaacaatgtgaattcacgacgggaagaacggaaattccaaacctgcatttgccatattatagactttaattcaaaaattctgtctatcaaaatgataggaggtaaaacctcaggccttcactgcacctgtacattcatcatggaagcagccgcaaatttgtatgaatcgtgcgggttaaatttgattccatgtgctaggacaccttgcatgtcaaacatcctaatgcactcccagcccttgttccagtcccacatcttaattgggtcaagcaagccgaccgacagcacataaggctcagttggatgaacgtccaaacaggtgatgttccatgaatgagctttgaatctcttcacttgctgtacaggggattcgtatgtgtacactcttatgaaaccatcatgatatccaaccacaagccattgcttccgcgcaatcaacttggctgcgctagctgcagttttggagtgattgatatgttagcatttgctgttacaccaggggtaaagtctatggctagcagtgagttaagtcaggt

SEQ ID NO: 87020 - DNA, 1479 bp, Oryza sativa
ggcgaattcgagctcggtacccatgcaagtacatatatgtgtaatgaggtgacagtcatcgatcaaaattgaaaagcagattattcatggaattattgtcatgagttttctacttgattataaaaataaattgaataatttgagaattaaacttaaataataatttataataggtaggataggaagtaggagtacacatcatcaaaagttacatagcttatcatttacccacgtacatacgagacaaacatactatttataagtgtaaacaactataagacagttgacaaaggcacacggacagtaggaataaggtaaagatcgttctttcttcgaattgtagcacccaactcctccatcatgtccaccttggttggcgagatgccatcagggagctcccaatcaaagtggtaaagcaatgaggctagagcgagctccatgattacttctgcaaatgccatgccagggcacatccttcgtccagctccaaacggtataaattcaaagtttgttcctttgaagtctatatggccatcctcaaatcgttcaggtatgaatgtctcagcatcctcccaatacttaggatctctacctattgcccatacgttaacaagcacagtagtacctatggggatatcgtaacccatgacctcacatgtctcccgacattccctagggagaagtagtggcactacaggatgtaaccttaaggtctctttgataataagttttaagtacttcaattcatttaagtcatcttcagatatcgtttgctttcctttgatgacgttacttaactcagcttgtgcgttcagcatcactcttggattcattatgagctcagtcatcgcccattgaagtgtattagctgatgtctcgctcccagcaccaaaaagttcctatatgcatgaaaaaaaacatgatttcccatatatgtaaaaaaatatgttatcaattacttccttcctttgttcagtgtgcatactttttttttattttcatatatactcgctccattcatcagttaaagttatttaattttattcttaaacggtaaaactttgtagattttgacattaacagtagtcaaattttaagtgcactcaggtaaaagaggtttggtaaaatatgtcttatatttcatcctttcacgaatataatggattatagatccagaaagtgtgattgaaccttcactaaattagggaagagaacgtacgttagggtacgattgtagatacgattgaaaaattaattattggtaagataaatactactctaagctcagaagtattcgtgtgcaattaagggagattagtacagtattaatcagcaagtacttgtctacttaccaggacgacggcttgatattgcccatggtgagaggcatctggaggctcccatccttctgaaccctgagaagcacatcgacgaggtcctcgtcgtcgtccacggcgccggcggccctccgctcctcgt

SEQ ID NO: 87021 - DNA, 697 bp, Oryza sativa
caacaatggagagaatcccacacttgcccaagtcctggcttaacaggcacattttatgaacatgatgatgcaacaacttcagaaccagcagaaccagggaaataaccatgccccttcccagaacaagttagccaaatttcttcgtgtgaggccgcccactttctctagtaccactaatcctgttgaagctggtgattggctgcatgccatagagaagaagttggatttgcttcagtgcaccgatcaggagaaggtctcatttgcatcacaccagttgcatggccctgcatctgaatggggggatcacttccgcctgaataggactactgctgaacctatcacttggcttgaccgctgctttccggaagacgcatataccatcgggagtggtgtctctcaagaagaaggaattcaggtcgctcactcaggggtctcgctctgttacggagtatctgcacgagttcaatcgtctggctcgctatgctccagaagatgtacgcactgatgaagagcgccaggagaagttcttggaaggacttaatgatgagctttcttatccactcatgactggagattatcctgatttccagaagttagtggataaggctatcgccaggaggacaagtacaaccgcatggagcagaagaaacgccggattgctcacttcaagacacaacaagggaataatcagaggccg

SEQ ID NO: 87022 - DNA, 1385 bp, Oryza sativa
caaaagaccatttaaccttatcataggctttctcaaaatcaatcttaaatattaccccgcttttatttttacgacacatttcatgaatagtttcatgaagaataacaacctcttccataatatttctcccaggaataaaagcagtttgagtaggactaattactttttgagtaacgccaattattctatttgtagcaaccttggtaaaattttaaaactaatgttaagtaagcatataggcctatactgttgaattttcatggcctccacacacttaggaaaaagaataatagtaccaaagttaagagagaataaaggcaaagtaccattatgacaatctttaaaaagatctaacaagtcggctttaataacattccaaaacacttggtaaaactcagctggaaatccatcaggacccggagccttgttgtgttccatttggaaaattgcctctttaatctcattctcggtaaattcttgagttaaagcctcattctctaattgagatacttgagggatatcatcaattttactctcataaacctgaagatcaaaatcatctggaggaccaaataaacctttataataagtggtaatatgcaattttaaattcgcatcaccccttattaattgatcaccatcctgtaattgaaaaattctggtttttctatgcttaccatttgcaaccaaatgaaagtacttagtattagaatctccctccaagatatctttagtcttagccctttgataccacctaatttcctcttctctcagaagcgtagataatctatttgtataatacactctaatatcaatttcctcctgagtcaaaagaatggtttccgtttttttatctagcaaatccaacttatctaataactcttttttctctttttaatagatgccgcttgtatgtttagcccatcccctcaaatgttgtcttaaacgatgaattttagcctctcaacgctccatgggagtattaccttcatcaacattagaccaaatctcttttaccatatcaacaaaaccatcccgtaatagccaacctggttcaaacttaaaactatgttgagcattacccggagacgaagaatttgtatttaaaagtaaaggagtatgatcagaaatatctctattgagagcaaaaaccgaggataaaggaaatttatgttttcactccgttgacattaaaactctatcaagtttctcatagattggatttgctagattatttgcccaagtaaaattcctacctaacataactagctctctaagactcaacccgtcaataacagcattaaaaagaaagggcaatctatcatcataattagcattgtttttctcatcagggctacaaaaaatattaaagtcaccaccaataa

SEQ ID NO: 87023 - DNA, 1052 bp, Oryza sativa
gcatcttttaaatggttgtggtcggggacgcagattctctcacccaaccatacagttccttgctcatcctccaagaaaccgatagcttttcctcttctcatattcttcttgatttcttgaatatcagaatcattaatttgggcttctctaacttgatcaattagagtgggcttcgcttctaaggctgcaacaaaacctctactgacaattcccaaatttaatctttcaaattccttgcataattccaatggcaactgtcgtcattccgtagcattgcaatagcctttcctgctaagagtgtgtgcgacaacattagccttttctggggaataatgaattcccctgtcataatccttaattaattcccacctatctccgttgtctcatgttcagatccggctgagtaaaaatatactttaaccttttgtgatcggtatatacctccgtacgagtcccgaaaagataatgacgccaaattttcaatgcatgaactactgcagctaactcaagatcatgagtagggtagttcttctcatgcggacgtaactgatgagatgcataggcaaccaccttcccatcttgcatcagaacgcaacctaacccaagtttggatgcatcgcaatacacttggaaacccttctttggatcaggtaaaatcaaaataggagctgatattaagcgattcttcaattcttgaaaactctgctcacattcttctgaccacttgtacttcacatctttctgaagcagccgtgtcatgggcttagcaatcttggaaaaattctctataaacctccgataatatcctgcgaggcctaggaaactgcgaatctctgaaactgtctttggttgttttcaattagttacggattccacattgctaggatcgacggcaactcctcctgctgagatgacgtgaccaaggaacttcacttcagacaaccaaaattcacgcttactaaacttagcatacagttgatgttctcgtagcttctctagtgcaaggcgaagatgttcctcatgctcttctctggttcgggagtagataagaa

SEQ ID NO: 87024 - DNA, 1108 bp, Oryza sativa
gggcaagagcacaagaagagaacccggggaaaactacttaggactgagaattaatttaacttttattgatcttaagtgagtttcattattacaaaactgaagactctcacaccactaaactcaccaactacctaacactcgaaagcaaacaaacgcatgcacttacatcccaccactgatgtaaatcacatgcgaggcacacacaaccaaacttaaaacaagcaaactaacacaacgatctaagacaacggtttgacaaggctttctaattcttccgggcatcggagttgattgaaggctcgttcggctcgtcttcatcatcttgaattgctccccactcgatcttggaatgggtgcgcttggattcttctacttcatcatcacttatgttgacgaccggagaatccgctagggctggggtaacttttttttccaccacacggacctttggcgccaattggtagcgatggacaaatagagctctcttccttgcggtaagacgaaccctggccttctgcggtggtgcttctcccttcaacgcggctagttccttctccaaacgatccactttgtcttctagcttgcaaatcttaccacgattccgatcttcacgatcttgagctgctaacacagtctccacacggctttcatccatagcccacagcatctcaaccaaatgccttgtggtagcatcattctcaattccttcagtcttaaggtaactgccacggtcacttccctggggttgacggggatggtagcgatactcagtgtcggccaactgatcactgtagcgatcgcggagctctcctatggcgatccttgccacctcctgacatgtatggatgtagtttcttcctccagcttcgaacatcactgaggggatatcttcactattactgttcaaggtgactttgactccgcacttctcttcgtgacgatcatgaggaatctgggcataaaaaggagcagtcccaaatcctatggcaaaggacatcgtacgcaactcctggacaaatccttcaacaccaaacaagtactcaggcttgtagcgcggcatctaaagacaagtgaaaggacggaattaaggcatttattccattaatag

SEQ ID NO: 87025 - DNA, 1339 bp, Oryza sativa
ctattggaatatcaaggtcgcgcgagttctcgtcgatggcggcagctccatcaaccttctcttcgccagcaccttggacgcgatgggaatcccacgaagcgagttgacaccgactgatcaacccttccatggaattactcctgagtcatcgtccaagccattgggcaagattacgttgcctgtgactttcggccaagcaaataacttccgaacaaagcagatcatctttgatgtcgctgaatttgatacaacatacaatgccatcatcggaagaactgcacttgcaaagttcatggccgcatctcactacgtgtatcaagtgctcaagatgcctggtccgaagggaacaatcactgttcaagggaatgcaaagctggcggtgcaatacgactagcggagcctcgacatggtcgagcacacgcccagcccacccgccacagctgagccacccaagaaagtgagcaaaacgaacaagacgccaaaaccagacggtgcaatcaagatcgttccgcactccagtgccaaccccgacaagaccgtcaagatcggggcatcactgagcgaggaataggaactcgcgctcatcaccttcctccatgacaatgcagacgtgttcgcttggcagccgtccgacataccggggatcccagggaggtgattgagcacaaactcatggtgcgacccgatgccaagccagtaaaacaaaaactgcggagatttgcaccagatcaaaaacaggccatacgtgaagagctcgacaagcttctcaaagctggcttcatcagagaggtactccatccagagtggctagccaacccagtcatggtgtggaaggccaacgggaagtggaggatgtgcgtcgacttcaccgacctcaacaaggcgtgtcccaaggatcacttccttcttcctcgaatagaccaactggtggactcaacagctggttgtgagttgttaagctttcttgacgcttactccggctaccaccgaatcagcatggcaaaagaggacgaggagaaaacagcattcatcacgccgttcggtgtattctgctatgttaagatgccgtttggactgataaccacaggaaacactttccaacgcacggtccaaggggcacttaatgatcagcttaggaacaatgtcgaggcctacgccgatgacattgttgtcaagaccaagacaagtgactcattgattgacgatctccgggaaacgttcgacaacctccgacgatatcgcctcatgctcaatccagagaagtgcacgttcggagtaccatcgggcaagctgctcgggttcctcgtctctggaagagggatcaaagcaaatcgagaaa

SEQ ID NO: 87026 - DNA, 1443 bp, Oryza sativa
ccctacatgatgtccgatggcctaagagattccgactgtgagcaattgaaaagtacgatgggagcaccgacccagaagaattccttcaggtctactccacggtactctacgctgccggagcggacgacaacgcgttggtgaattatttgccggcggcgttgaaaggttctgcactttcatggctagttcacctcccgccatactcgatttcttcatgggcagatctgtagcagcagttcgtcactaacttccaaggaacttacaagcgccacgcgatcgaagacgacctacacgcgttgacacaaaatccgggcgaatcattgagggactacgttcggcgctttaatgagtgcagaaatattatccccgagatcaccgatgcttccgtgatccgcgctttcaagactagtgtcagagatcgctatatgacccaggagttggcgacaaggcggatcacgactgctcgaaaactattcaagatagtcgatcgatgcgctcacgcggacgatgcactgagacgcaagaacgacaagccgaagacgggaggagaaaagaaaccagcgaaagacgcacctgaatcaagcaagaagaagagtcgcaagagtgggaaaaggaaagctcaaacggaagtcctcgcggcagagtacgcggaccctcccaggcacccagacccacaaggcaacgacacaaagaaaatatggtgccctatacacaagttggacagacactctctggaagattgctttgtcttcaaaaagttgctcgcaaagcaactggcattggagaagggcaagcgagtacgtgtagtcgagaaggccgctgagcagctactcaggactcggactcagcatatccagattccgatctccatgtctcgcacatcttcgcaggttccacggcttactcctcaaagcgagagtacaagaaagtggagcgtgaagtttgttcgacatggcaggggggtgcgcccaagatgaagtggtctgaacagaagatcgagttctcagatgaagaccaccccaagattgctgtcatcccaggacgatatccgatcgtggtcgagcccactattcggaatatcaaggtcgcgcgagttctcgtcgatggcggcagctccatcaaccttctcttcgccagcaccttggacgcgatgggaatcccacgaagcgagttgacaccgactgatcaacccttccatggaattactcctgagtcatcgtccaagccattgggcaagattacgttgcctgtgactttcggccaagcaaataacttccgaacaaagcagatcatctttgatgtcgctgaatttgatacaacatacaatgccatcatcggaagaactgcacttgcaaagttcatggccgcatctcactacgtgtatcaagtgctcaagatgcctggtccgaagggaacaatccctgttcaagggaatgcaaagct

SEQ ID NO: 87027 - DNA, 2551 bp, Oryza sativa
agtttaatagtagaactcactacttactattagtcaatgttaaaactaacatatatagtaagttggctataaggttatctttattttcttcatcctctctctttctctcactacgaatttaatgcatatttcttggagcttgtgtgtagttagctcttgcatgagagccaacactccactatacttttgtttatctctctcttctacataagcatatagcttgcttatagcccactattatccttactctcagtagcaccttaggtcatgggttcgactccccatgggagcgaattttccaggatttaaaggcattatgctttcagtggtaggcgacgtacccgtcgacagcgaggcgcctgtggtgactaggatttgccggcccggtcttcaaagatgctcataggggtagggtttgtgtgcgtgcgttcataggggtgagtgtgcgtgtgttgtgagtgtctgcgttgaactgtgtaattcttaaaaaaattgagaaattttaaattctattatataatgatcaatttttgaaggagggagtacaaattatgttacctcggaatcatcaacaattaagttacgactgtactaaaataacattccatggccactaacgccggacgcatagttaagcaagtttagattttaaatttaagctcaaattctaaaaagtggtcggagatgtaatttatcttctgttatcttcttatctctactctttgaaagaccagtcatccttcttctctcaccctacaacgcgcgccaaaaaaaacctgtaaaaaccgaatcggcccccctcccatcgtactgcaaggtttttttttttcttccaccaaagaattaaccgatcagaaaaagcaaatagagaaaactaaacctataatacaattattttgtcttattccttcatatatacttatatctcattgtaaagcacagccatagcgcaatggggaaggagtcgtttcgggtctcgttggttgccgatggaccctgacccgaactttagcatcaacggctaagatggaatactatactgttggaagtattttttagcacactggagctctcccattagtttgttgatcgctttattaattgtcttctgtgtttctcgcgaaaacttgttggtgatgtagcaaaacttgtgaagtaacagcaatagagtttgctggttccgaagataataaagatgaagtcgctccaccatgatgacaaagttgtgttgccgtgatgaagtgaaccggtagtgaagacgcgcagttgtgaagataaaagcaccagtcggcggcggcataacacgagtcggcggcggaagacgatgatgtccatcagtagtggtagctgtataaaccagatgtagaggcgagggcactagtcagcagcagacgagacgaccggcgatgaagatggtaaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgcaggcggtgacaccagtcaacggcggatgcggcggccggtcggtgaagacgtagacgcccaacaacggcggcataaaggccagccgtgcaggcggaaacaccagtcggcggcggcgaaggcaagccgatcggtgaagacgtagacgcccaacaacggcggcataaaggccagccgtgcaggcgaggacatcagtcggcggcgacaaaggcaagccggtcggtgaagacgtaggcgcccaacaacggcggcataaaggccagccgtgcaggcggggacaccagtcggcggcgacgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcgaggacatcggtcggcggcgacgaaggcaagccggtcggtgaagacgtaggcgcccaacaacggcggcataataggccagccgtgcaggcgaggacaccagtcggcggcgacgaaggcaagccggtcggtgaagacgtagacgcccaactacggcggcataaaggccagccgtgcaagcggaaacaccagtcggcggcggcgaaggcaagccggtcggtgaagacgtagacgcccaacaacggcggcatacaggccagccgtgcaggcggaaacaccagtcggcggcggcgaaggcaagccggtcggtgaagacgtagacgcccaacaacggcggcataataggccagccgtgcaggcggaaacatcggtcggcggcggcgaagccaagccggtcggtgaagacgtagacgcccaacaacggcggcataaaggccagcggtgcaggcaaggacatcggtcggcggcgacaaaggcaagccggtcggtgaagacgtaggcgcccaacaacgg

SEQ ID NO: 87028 - DNA, 1402 bp, Oryza sativa
tttatctcgtgcgaccccgttttattattgccgaattcatgtttcgacagttggcgcgccaggtaggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcatccatgtcttcaccgaccggctggccttcgccgccgccgactggtgtttccgcctgcacggctggtctattatgccgccgctgttgggcgtctacgacttcaccaccggcctgcctccgtcgccgccgactggtatcctcgcctatacggtcggttggtcacaccaccgttgatgggcatcgtcatctacaccgctggcctgcctccgtcgccgccgactggtgtccccgcctacacggtcggttggtcacaccaccgttgatgggcatcgtcatctacaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgctgctgttgggcgtctacgtcttcaccaccggcctgcctccgtcgccgccgactggtgcctccgcctacacggctggcctattatgccgctgctgttgggcgtctacgacttcaccgccggcctgcctccgtcgccgccgagtggtgcctccgcctacacggctggcctattatgccgctgctgttgggcgtctacgtcttcaccgccggcctgcctccgtcgccgccgactggtgtccccgcctacacggtcggttggtcacaccaccgttgatgggcatcgtcatctacaccgccggcctgcctccgtcgccgccgactggtgcctccgcctacacggctggcctattatgccgccgctgttgggcgtctacgacttcaccgccggcctgcctccgtcgccgccgagtggtgcctccgcctacacggctggcctattatgccgccgctgttg

SEQ ID NO: 87029 - DNA, 1070 bp, Oryza sativa
catccatacagtccaacgtatttggaagagagcaaagatttgccatgaacagggaatagcagtgaatgttgatcaaggaagcatggaaactctgggcgcaagaaggtcgaaatagacttgtcagttattgcagctattccattgcatcaaaggagaaatattcggtcactagcacaagcccttggtgttcccaaaagcacattacataggtggttcaaagaagggctgatacgacgtcactctaactcgctaaagccttatttgaaggaagcaaataaaaaggaaaggctgcagtggtgtgtttctatgctagatccgcacacattgccaaacaaccccaagtttattgaaatggaaaatattatccacatagatgagaaatggttcaatgcatcaaagaaggagaagactttctacctgtatccggatgaagaggagccatatttcacagtgcacaacaagaacgccattgataaagtaatgttcttatcagcagttgcgaaaccaaggtatgatgatgagggtaattgcacttttgatggaaagataggcatttggccttttactaggaaggtaaaatatccttcttattacaaatgttgttaatgtacatttctttctgatattcatgggcaaacataactaatttcatatactaacaggaaccagcccgaaggagaagtcgtaatagagaaaggggaacactagtaaccaagccaataaaggttgatagagacaccataagatcattcatgatctctaaagtgctgccagctattagagcatgttggcctcgagaagatgcaagaaaaaccatatggattcagcaggataatgctagaactcatctacctatcgatgatgcacagtttggtgtggcagtagctcaatccggacttgatattcgcctcgtgaatcaacctcccaattccccggatatgaattgtctaggtcttggattctttgcttcacttccatccttaacacataataggatctctagaaacatggatgagctaatcgagaatgttcccaaggaatacccgtgactacaatcctaatacttttaa

SEQ ID NO: 87030 - DNA, 910 bp, Oryza sativa
caaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaaactgaagtgatgtttcggtgatacttctccaccccttgtaagtagcacttgtgctcggtcacaatgctaactttccaataatcattccatttacccttatatgcatggacacgccacggacattcttccttcatgcacctcacttcatacacataatttgttgacttgaccaccctaaactctctctgcaatgaaactgcccaatgcttcaccgcctccttcatctcatccttatgagcataccttgcaccctcaattatctcgttctccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataatgaggggccatgaccgttcaaaagccatttccacataccgtctccaagcagcagtgctgtccatcggcattagttcccaaaaataaccttctattgcacgactcactacaacagatactgacattgtgtagacttcttggtctattct

SEQ ID NO: 87031 - DNA, 1186 bp, Oryza sativa
ctgggacgccgccaccggcgagggtgccagcttcacacaccggcattctccttcgtcatcaacccgcccaaacaggacggcggcatcgacaacaagggcgccggcatggccttcttcctcgccggcttcccgtcgaggctccccggctcctacccctacaacctcggcctcaccaaccagaccgccgaccaggtggccgccggcgacgaccggttcgtcgccgtggagttcgacaccttcaacgacaccatcgtgcacgaccccgacgccacctacgaccacctcggcgtcgacgtcaactccgtcgagtccaagacgaccttgaccttgcccagcttcaccctcgtcgggaacatgaccgccgtcgtcgagtacgacaacgtgtccagcatcctggccatgaggctgcacctcggctatgggcttagtggcccccgtcaccggccggattacaaccttagctacaaggttgacctcaagagcgtgctgccggagctggtctccgttggcttctccgcctccacgaccacatcctttgagctgcatcagctgcattcatggtatttcagctcatcgttggaaccaaaggccgcggtgcgtggcagagttgtagcgggagccaccgttggcacggtaatgttcgtcatactcctcttcgccatggtagcagtccttgtacgacaacgtcagagcaagaagagggagacagaggaggcaaagaacggaggcatggatggcagcgacgacgacgatgacgacgacggcgagaccatcgtagagatcgagatggggacggggccaaggcgatttccatactacgaacttgtcgaggcgaccaagagtttcgcggcggaggagaagcttgggcaaggcggtttcggcacagtgtatcggggctacctcagagagcagggcctcgccgtcgccataaagagattcaccaaagattcctccaagcaaggcaggaaggagtacaagtcagagatcaaggtcataagccgtctgcgccaccgcaatctcgtgcagctcatcggctggtgccatggccacgacgagctccttcttgtttacgagctcgtccccaaccgtagcctcgacatccatctccacggcaatggcaccttcctcacatggccaatgaggttattaactcttgctaattttgtcttaatctttgtagtgtcaa

SEQ ID NO: 87032 - DNA, 1573 bp, Oryza sativa
aattgctgatggaggtgtcatgcagtgcactagggaaattgctgactgtcgttggtggatgcagggacagagtttctgcagtaatttccgactgctacccctgggaaattatgatgccatattgggtatggactggctcacaatgcacagcccaatgaaggtagactgggttcaaaaatggatggaattccaatacctgggaagggatgttcgaattcaaggaattactaatcagccagcacagtgttctcatataacacacaaccagttatctggcatgaacaggaagggttcactgttgtattttatccagttacaaaatatggccatacaggagaatagcactatttctgattcagtcaaacctatgttgttagagtttgctgacctctttgaggaaccaactgaattacctccgagaagagcttgtgatcacagcattaacctcattccaggggctaaacccattaatctgagaccttataggcacaatcctgctctcaaggatgaaatagagaggcagatagctgagatgctcaagtctggggtgattcaacccagccaaagtcctttttcttccccagctatacttgtcaagaaaaaagaccacacttggagattggtaatagattacagaaagttgaatgccattacagtcaaaacaaaatatctagttccagtgatggaggaactactggatgaactatctggttcaaaatggtttaccaagctggacttaagatcaggttatcaccaaattagaatggctgagggagaggaacacaaaacagcctttcaaactcattctgggcactatgaatataaggtgatgtcttttggcttgactggggcacctgcaacatttttgggggctatgaatgacactctaaaatatgtacttagaaaattcgtcctggttttctttgacgatatcctgatctatagtccagattttgagtcacatttgactcatgtcagacaagtcttacaactacttcagcaatatcagtggaaggttaaattaagcaaatgttcttttgcttagtcacagttatcttatttgggccacatcatcggtgcaaatggggttgcaactgatccacaaaaggttcaggatatactcaattgggagattcctaccaatgttaagaagttgagaggatttctgggattggctggttattacagaaaatttgtacaaggctttggtctgaaaagtaaacctctgaccaatcttttgaggaagggtgttccttttgtttggagtacagaagcagattcagccttccaggctcttaagacatctctggcctcagctcctgtcttggctttaccaaattttcaaaaaacctttgtggtggaaactgatgctagtgactatggaatcggtgcagtactatcacaggagaagcacccaattgcctatataagcaaagccctgggtcccaggaccagaggtctgtccacttatgaaaaggagtgcctagcaatgatcatggcagttgatcactggaggtcttacctgcaacatgttgagtttataatactcactgatcaccacagtctcatgcac

SEQ ID NO: 87033 - DNA, 3838 bp, Oryza sativa
gctctacctcccttagccattcatcgctcattatggatgttaactcccggacagtttctcgtaggaacccgagttccataggattgggaggtgacaaaggaacgggtggtttccttttgctaaaatagttcagggtattgccgtagtctttgtcaaaaccgtccctgaacataattgtggcacaatccggaacctgaatttcttcattctcgacaaacggctgctcaggaaccttttcatcaatcgagctagcagaagtggatggttcagtgagtggctcgatcgttagaggttccactatcttggacagggatgccttcggctggggttcattgggctgcgtcatgaaggaagtattttctaggatgcgatccaaaattgttcttccttctgacggcgttttgtgcatgaacgaccctccaacggttatgtccagatagaatgcagattccttatccaaacccgtatggaaatattgcagaagcacatactcgggtaaggacagggttggtccggattgtactaaatagtgaatctggaccaagttgcaccgattgattcatttttgatctgcttgaaactaagaatttctactcgaaaggcagtaatacgagtaactggaaagaaggcaagacagaatctgtctcacaacttttcctagctaccgtttacacatccaacggtagaggtgtaccattgctttgctctctcttgaagagagaacgggaacaatttccaccgcacagtttcttgtctcatgccacgaatcttaaggcatgatcaaacttgttcaaagtctcgcagatgatggtagggattttctagatcaaagccagaaaaaggattttccctacccacttattaattcaagacccatttccttacccagtgtattaattggccttcatgaaagaaggggcttattaaattcccccccaagaaccaaccttttcaaaccaaggttcttccttgtccaaaaaaatttgaccaggattccttttttagattaccaggggtaaaggtgaactaaaaaagtaaaagggatccagggttaacctgggttcggaattgatcaccacccgttccccgccaacggcactaggaatggctgttggtattaaatacggttacagataaaatctgcaaccgcacggatttaccgaggagcacctttccctacggagttttccaggggtatcgaatccaaatgaacgtgtatggtcaaatcttcctccggttcatccaaggacacaaagtaaatgataggccaggatagagaggatttactagtgagagacagtatctagggaaagcttaactttaatcctaatgcaatacttcaggcactggcaacccgctgttcccagatgtcgctctagtacgtacccggaaagggaggacttaagtgatctcaagggctgtcaccacctctacacctacctcaaacgtaccgtgggatacgcagcaattactggataacaattacttaaataccacgtctaagcaattaatatctactttagtgtttataactcatcaaagcaatcactatattttagttgattatagtgaacaataatcccgtatgctatttaggaactaaccaagagataattctcacaagataaatctaaattattcaagaagaatattatattgaattcagagtaataaatagaataaaagaaataggagaagattaccgacaactccggaattcttccgacttcttctactctactctcttcctattctagtgtacaatatagtacaatagagcctcttataattcagctcaagcttggaagtgtgtgtgagagtgaatgaagtgaggtccttttatagggcagttatgacggttgtgagaaggggaaatgtccgaactgcaccgcaaccgtcattggagaacatctggagcatccacgccaaaccccaggatgaacggtgatcgggggttcggccgaaccagagggttcggtcaaacctgggctgggccctcctggcctggccttcggtcggtggactctcgggaccttcctctattcatttctcggagttttcggttgatttactgatgtttcgatgaagttcacaaccctacttgtatggatacataattctcctcactttagtctgattttcctcccaacttcagggtttatcatctgcatacaaatatacaccaacacttgtggaatatgtaagattaagcacctattactatgttggatgttttattatctagactttatgaaaatgttggcggtatgggattgtcatttaacaaccgccaacaatggggcatggcatcgggtccacgagattgatcgccgcagactaaggctatgttcgtctgttcgctggagcctgttcccaactggaacagtgtgcacgaaaaataaaacggtccattaacaagtgattaattaagtattagctaatttttttttcaaaaatgtattaatatgattttttaaacaactttcatatagaaactttttacaaaaaaacacaccgtttagccgtttgaaaagcgtacgtgtggaaagtgaggaagatgagttgggaaacctgggctaggaacacagcctaagggtctgaggcagaagcggaggcgaaagtttctctttttttttcgtgaagtactttcctccgtgtgctgtgatgagatgattaaagatcaagtttctgccttaatttctcaattggagcatgatttttcattagttccattgttttcagaatggtaccaataatgttagaaggtgctttattttatacctagaaaaatgtctgttgtagagaaatgaagaggccatggtaggacaccttgccatatattttttaagaagaatggctaatatgcattggctagggtttaatatctaattttattggcacttgcccttaatggaaaactttgccttgtttaaggggaggattaccttattttcttttttggagcccacctttagaataaggaatttttaccgttcttttgataacttattggggacaagtaatattttaactaacaggtgcagggaccacctaccaaagtaatttgttatggaaaagaaatagggtgtttttggggggtttttcaaacaaacaatgtgaagtacctactttgtaatttgccttaaatatatggcataatttgaattaaagctcccattaaactgattatttttactaacacaaaattttagtcatttattaaaaaatattaaagatcgtagcgttagcacgggcatatactagttttaaagatagaatgaggccgaactaaacaatgctaatttaattagtgaaaaccgaaacaacaacagggaaaaaaacaacctaaatactctgagcaacagccacatgactaattaataagctcaaagcaaagcatactccctacacaatgccattgacattagaccatctacacccccccccctcccggggattggacaaatctagcatccctaagaagcacaagtgaacaaggtcaacatcctaaccaataccaaaacacaaccccattggacttagtgttattgttgccacatgttgcccccctcccccttcctcccacgtcaacgttgcacctctaacttcactaccaccagctttattgaaatatgcgtaagctagattagcaaccagggagcagccaatcctacaccctattagatgggagtgctaactcaaccaggaggtgggaggtgtcatcatcttgttagatttaattctcaggatctaatttgcttagcttaacacatggtcacaaattctaagtgtggaattgagatgattactgaccggatgaactgaagccataagcttt

SEQ ID NO: 87034 - DNA, 809 bp, Oryza sativa
cgagctcggtacccgagaagaaattagaccatcacatatctgattcaaggtctaaaagtagaagtttgtcattcaagcgatcaattagcagggattctgcaggaaatagtagcaggcattctctagcccttccctttggcttgcctggctcagttgaattgcttgaaggcaatgattcgactgtgggggaacagacagagcagggtggtgatggtgaggtccaacagaaagctcctattggacgactggctagactaaacaagccagaggtaccgatacttttgttagcaacactggctgcaggagttcatggagtgcttttcccaatgtttggagtaatgatttccaatgccatcaaaactttctttgagccagcagacaaactaaaaaaggatgctagcttttggggtttgatgtgtgttgtcctgggtataatttcaataatatcaataccggtggagtactttatgtttggaatagctggaggtaaacttgtagagcgtgtccgtgccttgtcattccggagtattattcaccaagaagttgcttggtttgatgatcctaggaattccaggttggttgcccattctttattgggtgttttctcttcctcctaaatatcaaggaattttacacattgggaactgatgatgaaatttcatcctacagtggagcgcttggtgcaagattatcagtagatgctttgaatgtccggcgtttagttggagacaatcttgcattggcagttcaggtcgtctcaacacttatcacaggaattgtcatagcgatgatagcggactggaagctca

SEQ ID NO: 87035 - DNA, 1224 bp, Oryza sativa
aattcgagctcggtaccccatagcaccagatgctcaacaactaatagaaccaataaaggcgcgcctgttctcttaccaaggaatagcacagaacaaacggtaaatggcattgtttgcacattatgcatgcctaatttatctctcatgtggtcatgcatacaaatatacaacatttagattagaggatacttatttgtcacaacatgagggaactatactagtacccagattataggatttttagaaaaaggaaactcaagctaaagtgagaactggagcaaaaggcatatcatgcaaactcagaattaatgctgtaattttgaagttcgcaaacatgaacattttatttgagacaagactccaattttattaagaaatatgtgtgcgacaagccaacaagtcaccagacaagaggtatcatgccttgatcagctgcaattgctgctgcagctgctgcagccgcagtagttgaaagccgctgcagcaatcacatccgaacacacccgtcattaaaaatcactaaacataaaggtatatcgagacatatacacacctcagataagaggaaacggcataccctgtggaacatagagtaggattcctatactcctagtagcagccattgcctattgcaaggtctgctttatcttttggtatcttatggaaaaatcatattctgaagttgctatttttttttcagcttttggatatattcaaaccatataaggatatcaaaatcttacagttctcatctatggttaacgccttcggaggtttttctgatgcagtaagcttccagtcttcaacaattttgtgctagttctgaataaaaggatgcatagtaactttattgtttaaaccaggctgtggacacgaaatttcggaatcgagtaaagagatatgtgggcctatggtgctgtgtgcagctccgtgaaatagggcacatatattatgacatgtactgggatgagaaaccaggctggaagccccttcctccacagaccaaggtggaggaccatccaccttggttggaggtacaggaatgaggctaactacaatcacggatgttattttttgattcaaaggcaagatagattccttactacagattaactcctattatcatagcagtcactacctgttggaaatccaattgattcttcttgactgcttactgtgaaggaaatagaaatcaaatggcaatcagttttgtagctctgatct

SEQ ID NO: 87036 - DNA, 556 bp, Oryza sativa
caactacaaaaataggttttttttattctttttttttgacactaaatgcatcttttgtttgtaacagggctataggtaacgcatcaccctctatttctgctattgcagaaggccaatctgcagctcataggttattcgaaataatcaatagaaaaccaaatattgacatcactggaacttctggaataatattagaagatatcaaggggaatgttgaactcaaggatgtgtgctttagctaccccgcaaggcctgaacagttgatactagatggcttatgtctacaagtacctaatggtactacaatggcaatagttgggcaaagtggaagtggtaaatcaacaataattagtttggtagagagattctatgacccacaggatggtgaagtgttaatagacggaattaacatcaagaccttgaaactccactggataagaggaaaaatgagtcttgttagccaagagccattgctttttatgacctccatcaaagataacataacctatggtaaagaaaatgctacagatgaagaaatcaagagagcagctgagct

SEQ ID NO: 87037 - DNA, 579 bp, Oryza sativa
aacctatttaacggttagggtatggaagggatcaaaatcaaaactcagggggtatacaaggaggtgaataaaaattcaaggacatagaaggaaattcagggacatagaagggatcggctaaagtttcaggagcatagaaggaattttctcgtgctttaatgcataatatttgtgtgcatttttccagcttgtagatgaacaacgctagggtaaaagaaattacatctctttatgtcgtgtcatccaataccctgaaactacgaaaacaaattattgtgcaattttaccttggtgtcttaggccaaacaaaacctaaagtataggcaataagtgatgttccatatatctttgatgcataatattgtgtgcattttcccaccttgtagatgaacaaacctaggggagaaaaaaatacatctctttatgttgtctttgagtgtaggtctaccaacgatgcatagactccaccattgatcctcatgagagagtcatgttgtcccttttcagcgattgaaccattcttgatgactgcaatcacatctgcccctttaatcgtggacagacggtgtgctaccacaa

SEQ ID NO: 87038 - DNA, 529 bp, Oryza sativa
acgcaattttgcttggaataagttcactctaggtcccttaagtcaaaaatttatcattaaaccacaataacagataagtatgatacgtcctcaactccgaaaaccagtgaaataaggtcctaaaacggttcggaaggtgattttaactgacgttgcacttaaagttaagaaaatactatgggactcacatgtcagcgagtgttatgttaaaattaaaaaaaattgcggtgggcgccggcggcaagccaggcttgccatgctcagccccagctgccgttgccacactcttcttctcgctggcctctgcatccctctcgacaacgcctctgtacccgaagctgaagtcgtcccgctccacgccgtccgctgccgatcaattagtcaagtagcaagaacagagcattataagctcgccgccatatgcaaccacggaaataccggtgccagggagggtggtgtgtgttgtacctttacacggcgaagcgacggtgatgcggactttcttgacagcgatgcagacctagatctc

SEQ ID NO: 87039 - DNA, 636 bp, Oryza sativa
tcctgcagcccgattgcttggatctctgagatccaaacataccttacagataagactctacctgaggaccgcgaagggagtgaacgcgtacaacgcatttccaaacgctatgtgctggtagaagggaccctctatcggcgcgcggctaacggaatcctcctgaagtgcattcctcagaacaaggcgttgagcttcttgctgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcaggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactact

SEQ ID NO: 87040 - DNA, 762 bp, Oryza sativa
ctaaatggctgtagaaacagaatatcatccatgtttggaggaatgaatctaatgactatttcatgtcaccggatacctaatcatccactcttctgcagctcaatggtatagtgcatgaactgcccagcgatgcagcagaaagcttgaaagccttacaaaatcaggtgcaggcactgctgagggagcaaagaagtcatccttctgagcttctaaatcctatggatcatgatggtattcaactgtctagtggtggaaatgcattacatgatttttccaatcataggtcaggaagtacacgctacttgttcatgtcacaagatgccagttctgcaagtggctctgccatttcacttacaagtgaacccccttcccatcgtggcatggaacaccacgcaaaggttcctaacgattttgtaccgaagcatgatactcatggagaagttcaattaattgagcagtttgaacctggtgtatatgtcacacttatccagctgaaggatggtagcaaagtattcaagcgggtccggttcaggtacatctccctatccatgctgcaatctagatgttaaactgctacatcctttccatctaaaattttccgtctccttaaatttgtcggacagcaagaagaaatttgcagagaatcaggctgaagaatggtggcgggaaaaccaagagcgggtcttcaagaagaacagccattcgactgttcctcaaacaacatcaacgaaaacaggatcttctaacgaggaagaacatcac

SEQ ID NO: 87041 - DNA, 722 bp, Oryza sativa
  unsure (1)..(722): unsure at all n locations
tagtggatcccccgtgtggcgcccccacccgaagccgccgacgacgatgaggccgagcggcgcagagtcgtcgacgccgccgctccccatccaggtcgcgctcagggtcgccgcgctgaaagcggcacatccagcgcctgatgagctgccgcgcctcatgacgttgcagttcctcgccggtcagctctcccctgtcatggtcaaattgcaagggatcgattctcctcaactcgggtacatccaacctgtcgtttgattgcgaatccatgtagacgaagctatccagctgcttggtgggtgtggcgccgccatacgacggcgacgaggctaccgactcaccagtgaactacgacctctcctcatgctctcgaatccgcttccaacatcatcctcgtcaccgtatggtacgccgccaccgctcctcctctgcctgacgacgaggctgacttaccgggagacatttttgacaccgggctgaccagcacgtcgcggccgacgacgacgtacacctgcgcgagctccggcagcgtgcgcgcgcgaagagggaggaggtggggacgtcgacagcgagcacacggagagagggaggatgccgcgcgggagcaagccggggctccgagtccgccagagtccacctccacggcgcccggccctgcctccacctccgnggccaccgcccgggcgcccaaccccgccccgcctccacctccgggcccacaccg

SEQ ID NO: 87042 - DNA, 561 bp, Oryza sativa
ccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccatagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttatctagaaattccataaacaccttattcatcaaattcatgaagaaggcaggtgcattagtgagttcgaaagacataactgtgcattcgaacaacccgtaccgagtgatgaatgctgtctttggaatatcctttcgcggatcctcaactggtgataagctgatcgtaggtctatcttagagaacacaatagcttctttccactgatcaaacaggatcat

SEQ ID NO: 87043 - DNA, 632 bp, Oryza sativa
  unsure (1)..(632): unsure at all n locations
cgctatagtcaaattcctaaatgatccagatgtcaaacttccagaagttacatgaagaaagactatcactacctacgtactggagcatatggcccagtctctgctttacctctatgtcgtcagccccgaactccttcctccatctaagcatttccgaccacatatgttttgctttatcaatatcaaattttcgcgctttcaggaacctacatgtgtaacatgtcataggcacatgaagaaattttaaatcaaataagnnnnnnnnnnnnnnnnnnnnnnntaaggagaaatccaagtaactgtgactctgagatcagaaaaaaattgcacctcaacatcacgtgataatcatcatgacgttctggcaacaagccctcatcatgtaagcactggtgaaatctttggacagcttccagctccttgacatcccttatgtcctctatagaggctacatggtcgccgaccctccttcttctcttccttctcaaggaacgcctaaatttattccagcactgatagctcggttcttgaaggagactgccttggcctttttgtcaccttctgcgttgccctcatcggatttccactctttcttatcatcatcatgcgcaatgccttcaaaacctgcacct

SEQ ID NO: 87044 - DNA, 724 bp, Oryza sativa
tctcgtgtcttctgtgattgatctcttgttatttatcgtttatttgcctatcgcttcctaacaacctgaaaatataagttctaactgaaattggtctcaacatattctggaactgcagatgctgcacaagacgcatgcccatccaaaatacccttctttcttttcaggattcaaaatgcatcatgtacaaacatactaactagtgcaagtctattttcactgtttcagttctgttccggtgaccttattaaacctgatacgtcttcactaatgaattacatggtaaatttacattaaaatgatcagctgccctacacttatacactaaaatgcaggagcatcaattacagaataaatgcgtgtcataatgccaattgtagggattgaaggaccaaatcagcaaagggaatctgatgctacctctgcttacatatcccaggctcatccaattcagttgcatcttatcgacattccatcctataactactataataatctgtgaattcatcgcgttttccaccacctgacaccaattttttagcttttgcataaagctctcttccagctttccacaggtagttcaacccaacaagcagctcaactatggcagcctcgctctttttctggtcagcaaaatgcaacgtctgcaggagcagcacacctgtaccgctcgacgcaacatttttctgctcgaaattcctctccgattgccatcgcagcatgt

SEQ ID NO: 87045 - DNA, 503 bp, Oryza sativa
aaatagtctcgactgggtataaaccacgcagagtctcagcaccaaggagaatggcatcactccctaaacaatagaagtatgttaaactatcagaaggcaattgaaaatttaacattaccaatagctcaaacaactcaccgtcaagcactgcatttgccacatccgtagcctctgcacaagtaggcctgaggttgtcagtcatactgtctacaacacgagtaacaacagcaggctttccagccatgttgcacttgtgcaaagcaaacttttgaaataaaaacacctacagtatgaccagcaaaggtcaaagagcaaaataaataaggtttacctaacccaaagacaagtattgcaccataatttgaaaaaactacaattcttgttaataaggtactaagtgtagcggatgtacaattaagcagggccttctgatgggctcgacgtaagctaaaaatactaaccttttcaggtggaagatcaattccaaggtttcctcttgacag

SEQ ID NO: 87046 - DNA, 753 bp, Oryza sativa
ttgagcaatatgatattgaatttgctgaagactctgatgatgaccgtccattccctccacttactaataatgacaagttagcattagaggaatgtcgtgcgtttgagaaggtgtttgggaggaagccggacagctctgatttgtttctgggcagttgagtaccaccttccgcaccgtgtcatgcgacagttcgggaagaaacaagactggccggttgaggacatctcaactggagttgaattacacaagtaaatatttcttatctttgtttgctttcattgtcaatgttcaattttgtaccatttaacccttgtcgatgctcactattgtttcatcaccttctacttgtctaggtatgacagggtgagaacaaagaaggtgaaagactgggggctagagcataatagatacattgatgaatggaggacagccgaaaggaacgacaggtacatcgagactatacaccaaaatcatcttttctcagagtaccttcgttggctgcataggacatatagattgttcctccgccctacttggacggaagccgacatagaggatgaccgcgacttcgatgagggacggaatccctatgatatccggactagagttggatatcaaatggagcacgccccacttagagacagagtcgtaagttttcttgcatttgtcaaagttatttccatttgcaccctagaccctaacatatatcttctcacgctttcagtcgagagagctctcagggggctgcaggaa

SEQ ID NO: 87047 - DNA, 700 bp, Oryza sativa
ttcctgcagcccggtttcccccactgtttgcaacgtgaagctggggcgtgtgctcattgatgggggagcagccctcaacatcctttcccccgcagcctttgacgctatcaaggccccggggatggtgctccggccgtcccagccgattatcggtgtgacgccgggtcacacttggccgctaggtcatatcgacctcccggttaccttcggtggatccgccaacttccgcacggagcgggtgaactttgatgtggcggacctcagtctgccctacaacgcggtcctagggaggcccgcgttggtgaagttcatggcggcagtccactacgcctacctccagatgaagatgccgggccccggtggccccatctctgtccatggcgacctcaaagtcgcgcttgcttgtatggagcagcgcgcggaccacctcgccgccgcgtccaagcccaagggaggcgacgagaggcttggcacctccgcccccgccgtcccgaggcagcggatagtcacatgcgacgaggtcccggtcaaggaggttgccctgggcgacggcccgtccaagaccacacggatcggtggtcttctggacggcaaataggaagacgcgctcgtctctttcctgtgggcaaacgctgacgtcttcccatggagaccggcggatatgcccggggtcccccaggaggtgattgagcaccgtctc

SEQ ID NO: 87048 - DNA, 711 bp, Oryza sativa
ttcctgcagcccgacgagttcgtgcgtggttcgatgaacagtggtcaaaggcttctgtcacttgcaactttttaacggcagcttggtagtatatggagtacttagcttctctgaaatattgctagttgtatacttgtatctctctctgtgactttatctagctcggtctgtcagcgtagggacgggtgagtttactgataactcgctcgtacgtatgcacacgtaaggatgacgtcgttaatgtgttgccatttgattgtcatcgtcagggcttaaacggtgcggcaagagctgccgcctccggtggctcaactacctccgcccggcgatccggcacggcggcttcaccgacgaggaggacaacctcatcctgtcgctctacggcgaaatgggaagcaagtacgtgcatgcatgcgtgcgctctagtctacctgcattcacatgacctctacctctgtgcgagtatattgattatacttctgcgtgcgtcgccgtggatgtgcacaggtggtcggtgatcgcgtccaagctccccggccggacggacaacgacgtcaagaactactggaacaccaagctcaagaagaggtacttggccgcggccgcaacagaagcaaccactcctcctcctcctgccgccggcgacgatgacaacaacccaacgacacaagcctccagccaacccgcttctcctactcctccggcgcccct

SEQ ID NO: 87049 - DNA, 633 bp, Oryza sativa
acatacagacaccatgtacgctagtacacacgtatacgtacatgaaaaggcagagtgtgcgcagtacatgcagtacgtgtcgttgtagccttgcacgctcgcctgcagccagaagcagcctacaaacctagcgcggccggccggcgcggcacgtgtgcgtccacgccatcgatcagttttctttgatggtggcagccaggtcgaggcagttgctgacgaggcggttgacgtggcgctgcgccccgggtatgggcgacgtgaggtccgggaactcgtcgaaggcttccccgcagtcggtggagaaggtggaggcggacgacagctcggtcatcaggtcgtcgtggctgccgccgctcttgatcgtgtcgcgcgccttctgcagcgcgtcggccagcgacgagtaggcgcccttgcacgtgtcgagcgtcgacgacatgctcgtgccttcggccttcaccgcgcgcgacttcatcacgtcggccagccgcttctccgccatcatggccttggactccaccacccgcaacgccgcgtccagcagctgcttcggcgtcatcacccccggcagcgtcgtcagcgttccgcacagcgccttgtagtgcacctgcatcatatgtcatgccaatgcacgca

SEQ ID NO: 87050 - DNA, 528 bp, Oryza sativa
tcataagcatttaaggcatcggacaaattttgagtaaggtgctccaaaaggaaaaatatataacattttacttaattccataaaggacaaattttgagtaaggtgctccaaaaggaaaaatatacaacattttacttaattccataaaggaaggcctcaaattcaaatacataaggagatacatatcactattctgaaatgagttccttacctccttgtcctcatcagatagggtaggtaagtcgatgtgaatctgcgagcaatgcaatgtgaaaagcgacccagccagagttgctgtgttttttatcacacagaccacatcatttcctttaatttgagaaacctaaaccagacaaattagagttttggtatcggaaaatgtgggcacaaagcaaatcctactgacattgacataagaaaaaaaaatgcagaacgctaagcgcagtatgccgaatatttttacctctaacccaactgaagtagtctcactgcctgtgaacaagtattgcccaacaaatattgtgtcac

SEQ ID NO: 87051 - DNA, 544 bp, Oryza sativa
ggatctgctcatactggtccggctttaacccctgctgaagttcttatagccattcatgatattaatcctgaaaaggatagagttgccctgaagaaggtgagctattggttatgttgatgtattcattatattccaacatctcaacagcataaattagtgcccagtacacaaattggatgtcttgatggattttgtatcaagagttcaagacagacatgcatatgcacctgtgcagtagatatcctttttcttggttgacatgagttttttctcgtttctgatggaaatgaaaatattttcaggtcactgatgcttgcacagcttgctttgaacagcgcacggtatttactcagcaagttttggagaagtcactgaataaattggtactaacttgactgctgttattctttacctattattcttttacatattcttctctttgattaactgtttggattgttatgtaggttgacaatgtaccaattccacttcttttcatgagaacagttattcaagcacttgatgctttcccagctttggtaca

SEQ ID NO: 87052 - DNA, 5745 bp, Oryza sativa
aactctgtttgcaccatgtcaaaagagaactggtcagcttaagttagatgaaacaagaatacagattgtacagactttacaagggttatcacctggtgccatgtatcctacagtgcctggcatactcgttaatgtgatagagttgtcatctccaaacagcaacttggaaattccgaagtcggcaacatgtgcaaccatatcattgtcaagcaaaatattgcttggctttaaatcaaaatgcaggacaacctcaaagtgatggtggtgtagatactccattgccatcgcaacatccagcatgacactgagcctttggatgaaactgaggtgcagcccatcatttgagtacaaccaattatccaaacttccattgggcatatactcaagaactagtgctttgaagtcaagattagagcaagtgctaacaatcctcaccaagttgcggtgatgagccattcgtaacacgcggcactctgtgtcaaagcttttggaagctacttcctgttgcatgtttaggacctttattgtgacaatggactcatcatctagctggcctttgaagactttaccaaagcttccactccctagcaggttatcatcactgaagtttcttgttgcacggacaagttcatggtatgagattaactggtaattcagcaagtctgcatctgagggtagtggcatctttcctggcttattcattttccttcttaccaacatacacaagcaaaatgctaaaataaaaaatgccacaactgcaggtaatatgaattttagtagccgttgtattgaccttgagtgagttttgctctggcatgattctattccttggctcggaaggccacatagtgccttgtttcccatcaatgacttgacagtgatgtttgagaacacacctccttctggtatctgaccctccagtctattgaaagataggttcaaattggcaagataagtgagattggccaaggactttgggatgacacccgaaagcacattggaggaaaggtctaactcctcaatacttagtaacttgccaactgaatctggtattgaaccttggagtagattactggatagattcatatagatcatcatctggagttcaccaaaagaaaatggtatatcacctgatagctggtttcttgatagatccatcttagtaattgctgtcagttttccaacatcagcaggtagagaaccactcaaagagttctgtgataaatcaagctcaataagtttctgaagatgccacaaactaattggtattgttgaagacaacgagttttgggacaataccacaacttgtaactggtttaggctaccgatggtacttggaataggactgacaagttgattgttagcaagattcagcttaactagacttgttaatccagtgatttctactgggatggtgccagacaaggtgttgttggagagattgagttcttggaggttgttcattgatgtgatctgcgtggggatcatcccgcttagctggtttcctctgagagatagcatcagtaggttggtaagcttagccaatgtactggggatgcttccagtgatcctattgttgtctgctacaaaaatttcgatcagtgtgctaaggtttccaacacagggtagtaaactcccttcaaatctattgtatgacatgccaattgtgttcagattactgcaatttgataatgcagctaggaattcaaggttcccactgagctggttcccatcaacatagatgtcacgaagattccacaagttcccaaatgacattggcaccgatccagttaatccgtttacgaacaaatctattgtggtgaggtcagagattgcctatagattcgggaatggtacctgttatttggttgtttgcaaagcttatatacctgaggtttctcagctgtccaaactctggtggtatttctccctctagattgttctcgctaaggtccaaagcaagcagcccagtatgattgctcagttcaactgggatctttccagtgagctcgttggttgacaagtaaattgcagtgaggtttggcattgtcgccagccatgatggcacagaacctgtgaaattatttacagctagggagaacaaatcaaggttttgacatttggaagggcccgatgggataggtccatcgaaccaattttcaccgagagagaaaaattccaacatagggaggtgaaagctctcgtttccaggaatcggacctctgagattgttccgtgtgactgctatggcttgcaggtaggacatattgaagatagcagcaggcatggagcctgagagaagattattttctaggactagcatctccagcttcgacaatgatccaacgctaccaggaattgctcctgttagcctatttgacccgagttgtatcctactcaggttgggtgtgttattgaacaggccttgtggtattggtccgctcaagtcgttatctgacaatcttaatatctgaagattgttaagatttgccaactcttgtggaatccccccaaagaatttgttgctattaagataaagagactcgagccttgtgaggttgccaaggatggaggggatggtacctgacaggctgttgtatgaaagaacaagagtttgcagtcggggcagcctatcgagctcggttggcacaggtccgatgagggtggtgttgctgagtacaaggctggagaggaaggagagattgccaatctgcgggctgatggttccttcaagtgccatgtcttcaaactcaagcccagtgacccacttcccgctgctgtcgcatgagaccccaatccatgagcagaagggtgcactggcagtccaattgctggcaaggatgccattagggtccttgacttgctccttgaagtcgagcagtgcagcgaggtctgtgttgttgtatggaggggtgagtgaagtggcgcatggtgccaataggatgaggagcaccatgctgatgcagagaagagccatggtagtgaaggaatgaaggttgatgatgaggatacacaattacgcatgagcagtgtgctggttctattggtggttttattggaagtgtggccgtgtgggatgtgcaattgacatgtgcattgtgttgaatggtcaaaaagttgttttttttagtggaaatatgtgtgaaaggaagaaagcgttttagactttttcgtttgaaaacaaactttcatttttcagagctggttgtacactgcagtttcttggtacacttcaaagtttcaaaatagaaagaaggaaaaaaatgaattccttccaagaaacaacctcttccagaagtcaaggagcaaagctgtaggagtatgtcatttccgtcattgatagcttcgttttttttctgttctgtttttaataatagattaaaacccggtctctacaccaacatgggtgtacacagccaactttgatgcttcatgcttggcgccagtacttatgtttgtttgattttccaagaataaaacatctggtttaatttttttttcagaaaatcacttaaatagtcgttctacgctagctagatttttttttaaataaaaactgggagataatctaactccaagtatatttttttgaaagcaaactccaagtatattcatatgccatttccatctttgatactatcttggtatgcttggcaccattacttatgccttttcttttcacgaatgaaacatctggtgtgatttttttcaggacaatctttttaaaagtttgttcctggctgttgtttcaggtatcaaagaactgtaaaaatactgaagcgcttctatcctagagatccatttcttattagggcccgtctagttacccaaaattttttttccaaaaacatcacatcgaatctttggacatatgcataaaacattaaatatagattaaaagaaaaactaattgcacaattatgggggaaatcgcgagacgaatcttttaagcctaattagtccgtgattagccataagtgctacagtaacccacatgtgctaatgacggcttaattagtcttaaaagattcgtcttgcggttccgaaatccccttccgacatccggtcaaacgtccgatgtgacatccaaaaattcccttttccccaactaaacacacccttaacccttattcagcagttgactaagagtctaagagaagcaacactttccatgtgtttggtcaatcctgagtagactatgctctgaatcgtgctcaccaacgcaccatttcacaccaaccgccatttcacatgtctattattgaaggcggtcaggttcagcgaagcaagttgatgatagtcgctcttccccatgctagactatccatatccatggagccatcaaacagcgtcatgatcactgataattgatagtagtacattgaatacaagagaagctgtacgtgcacaacttcccttccattaagtatttaattgcttgcttgcattgtttgcttattttctgtacgatggagggtgggctgtgggcatcatgatggaatcgtggacctctcatatattgttgggttaactgaaatttttcagtggtcctttgaaaactagtagaaatattcattgcgttctttggcaggttattggaggattaagccctaaacaactctctaacacgtagtatattactttttgttagatggctgcaaacctgcaactcaactactgttacaggtatcttttcaaggaaggctacagctttcatgatgcagttcagcatttgcaaccaccacagatgacacatggccttgccagctttgggttatcatctgcagggctgcaggacaagactatctaggcttgtaatacctccttgatccgctgcagtttcacagtcacatccttcatcgtcaccctgtcctcaggcaagtctctggtacactgcagccccaaatccagcagctgcgctaagcagctcctgctgccggttgattcaccttgggcatcatcgctgctcaccgtgtcgtcatacagagagatgccaggatgtacgacgtcggcgagccttgacgggagcgctcggttgacccactccctcaagctcagctctccgacgaacatggcgtcggttggcttcttccccgtgaagacctccaggagcatgaccccgtagctgaacacgtcgctctttcgcgatgcttttcctgtcgacccgtactctgtgatgttcatggtaaacaaagatcaagggggatctgcagaaattggcgatttcagtggaaccaaagatgaacggtaaatcgacaagtgattacctggtgccatgtatccgattgttcctggcatgctcctggagaatatggaggtgtcctctcctagcaataaccttgcaattccaaagtctgcgatgcaagccgtcatgtctgcgtcaagcagcacgttgcttggcttcagatcacagtggaggactacctcaaagtgctcatggtgtaggtaagccatagcgagcgccgcatccaacatgatgctcaccctctgcatcaatccaaggcaatgcctgtcactgtacagcaaccattcgtccaggctcccattgggcatgtactgcagcaccaacgccttgaagtccagattcgaacaggtggtgagtatcctcaccaagtttcggtgccgagccatgcgaagtgcacggcactcgacttcaaaactcatggtagctctttccatgtccatgttgaggacttttatcgcgacgatctgctcatcgtctagattgcccttgaagactttgcc

SEQ ID NO: 87053 - DNA, 733 bp, Oryza sativa
gggcgaattcgagctcggtaccctatgtctgcctaaaatggtaatggggcctagggattatgtatagtcaagggattgacttgaccatcaaactttaagttcattccattctggttacaagaaacaagttactttcatccttggccattagcattgtctttttggaatagtataagaaaatattggaaattatttaagggaattctgaaaatcattttggaattctgaaaaagtttcttaaaaaccactggaaaaagaaccaaaccggcatttgcacctcttaaaatggctgcctaccaacccttctgaatttgaaggtaataaatataaattcctggtaatattcccttcattccaaatattccttgattaaatggggggtcaattatggtagggcactaaccagcatgtatttggatatcaccagtggaggatttgctgaaccttacaatgcaccggtcaacacggcaaacaaaatagtcatgatttttcctcctgtgtaacctttctcaatgataagctttccaccataccaaaaggctaatccatagctgccaaatacaacgcacatgacaaagcccatgccaaaaccagtgataatgccttcctcaatagtagcctggaatgacttctttataaaataacggtacattgctatcgctttcttctcaccattgaaggacacaacctgttaacacaggatattaatcaaacttactgtctgctactccaa

SEQ ID NO: 87054 - DNA, 552 bp, Oryza sativa
tgaatgcttccagtgccttggggtctgatgtccactctggcgtgtcacgctgcccaagatagatctcatccgctgagtgctttgatagaatctcaatgagcgagacaccgagaatggtttggaattggctggtgatggtgcggatgaagaacttctctgggttctcgtccagctctgtgtactccttggaacccggctcgggcatcggccgccggcttatggtcggacggtttggaagatagcccgcgtatgggtactgcccgaaattgacggctgcgtggagtgctgatgcaatccagatgattgtggtgcaggccttggtgagctcaggcaagctctgcatcttgggccaccagtccgcgtccttgagatcaccatgcccgacttcccgcacctccttccaccatgcttgcagctccacatctccctggaggacaccatcgtttgggtagtagatggcacagtactcagtgacccactgctcgattgcttgccagatcgccaggccatctgttgcataagggtagtccttgatcagtagcttcaccttgg

SEQ ID NO: 87055 - DNA, 912 bp, Oryza sativa
tttttgtcactggattgcagatgcaaagcaaacatggcgtgccacggatatgatgatatttgaacgtggacttcttaaaccgtgctccacttcccaatgtatatttgttgatgattttgtgttatatgaattctatttgataacagtggagcgattattgtttaattacggtggtgcagggttaattaggaggtgagaagtacagatgctataatactcccggattatcttcctgctatgattctataagcacttttatcttagagaaaatttcaaaaagaaaacccgtgttttggggattctgtaacacaaaacgcccagttttgcaatttgtttatttgtcttatatatttatctgtaagcacttttatcttagagaatgtatgagatactttttagtacatatataacattagttgctttttaacaagcgttgatcatttatgtgtatatttaacctattattatattataattaacatgtattatgttaatctttttcagcacaaaattgagaaaaaaaatgaagtagacgagaagaatatgtccttttagccaactaatgtgaattgatgtagaaaacaatcttatgtaataataaaatatgagtattttacatgaatatgaggtttcttaaaacatttggctcaaaacatggggcttcgtgaaacaaatcacagtaaccagggttttatgtaacggatactccaataactgtggttttgtgaaattcactctttatcttatatgtaattattatgttttcagtggtagacgatgtacccgtcgatagcgaggcgcctgtggtgacttcgtcaatctcaaaatttgccggctcagttatcgaagatgctcataagggtagggtttacgtacgtgcattcataaggtgagtatgcctgcattggagtg

SEQ ID NO: 87056 - DNA, 2228 bp, Oryza sativa
atcatccggaaggccctgttccgtgaagttccagttcttgtaaactgctgaagacattgccagagcatgtttgccaggaaagacagtttgttcgaaaatgccaccgccgttgatgagtgtctggcgtgccaatgcattgattgtcatcgtgtcgcgatagtgtggctggaggagcttgtacacagggtgtgtcacactgagctggcggtttgtagcgatcacgaagggctccatcacagcatgtgtgttgagcctacaagagtttacatcaatgatgaggttagcttactgctttcaggaaagaactacagtttgccactgccagtacgtaccagtggctgataagctggtgccaaccggagtcattaacagcaacataagccttggccagctgccacacccaagactcaatgccacttgatgcaggtgtatggaccttgctctttgcagatgttaggttgccctcgatgtgtggcaagctcagttcaattgctagtggcttcagggtatcatcatcacgtaagaacaacagggtccttgtggcataggtgaagataccatcaaggctgttaatgtcaatgaggaatggcatgaaatgatcatgatgatccagaatgtagagcctgttgctatccagtgcctgtgcagagccataattgacaacaaatcaactttggcagtttgtcaaatgactatcgattgcactgtaaatgaaatggatcactgcctaacctgttgcacgctgaggccttcgaggttcttctcaatgtgagctggggtgattgtgctagtctggtcaccgtacttgctaggatcaagagtactttttggtgggaattcctatgaacagagaattatacattagcatcagcttgttttgttcatgcttgctaggagcacaaaacatcaaagactatgtaatgttggatagttcaccgtgagacgcctgatgaccatgggattcagaccagcaagaatctctcgtgcaaattcctcatctgtcctccaagcaacctcgttctctgcaacaatgcatagtacaacagttcgctaattgtccactgctcatcgactatggcaattgacacaatggctaaatcatggtacctttgatgatatcaggtttggggaacttgagcaggtagctgcctccaaccggaagcaggtccttgataagttggacagggaagctcttgcgcagctcctctagtgctgggatgctgggaagcttcaggcctcccctgtagagcttcaagatgtcctcgaacgagtcaaattcaccaggtgtgagatcaacatatgtgcgaatggcaggcaagatgccctgaacaattgccttgatcgagtacccagcaaagtctgacatcttgaggtgcgcgaagcgctcatcgcttggcacgtaaatttgttccagcagtgataatctgctctccgagtttgggtctgcagccatggatattcacgcaaattagatcttactagtttatgaacttgtctgtcaagaagtgctctctagatgcacagaaccaagaggaacactgtaccttttttggtcggaattcggccagtacggccacgacgcgggtaggggtgcttctgcgagccacctaggacagggcgtgggttgtccctgtctggttcaccgaggtcattgtaaacatcgtaccggtagatgcggtcatgctcttgatacggcccttgcctgtcctcccctctgaggtacctcagctcgtcttcacggtatggcctcagtgcttctggcatttggctgggaaggtaagactgcatccaatggaagataaaactgtaggaattaatatccagattccagaactagagaagtcctcactttgcatcacagacttcattctcttaattattggcataatagatgcatctgatgcactcttgcagttgccacaaactttccatttgtgtctagtcattaattttggtgttcgtgatttcacagaaactgttgctccctattactacttcactttggatgttctgcatgtagtttaggagcttaattgcagaactttttactaagtatatgatcgatgattaattaaatataatatagtcattcactatcgtttaaactatgcacttacaagatgttaaattactcacgataaccttaaacaggataagaagatctgccaagaacagaaagggaggcgttgtggtatttagacttgctaatcactcctgacttacattgg

SEQ ID NO: 87057 - DNA, 693 bp, Oryza sativa
gttcacacacatgtaagcgtttggaattttggatagaaatttcgggcgtgacaacatactcctgaattgatgtaagtttcatctcccaaataaacatgtcaagaccattcaaaaagtgacgagaaacctcagattgtgtgtaattaacatcataagaacaatcaatagatctaagataactcaaaattttgttaaacctagaaagatagtcatccaaagcttctccaggtttcatctcaaattttatatactccttttttaaaagatcccgatgaagttctttaatattggtaattccttgatgaaaattactcaaaacaatccaaatctcattagcggtttgaagatgagaaacacgatcataatccgaacgagaaatcccactcaaaagaatattgcgagctttgcaattattttcaaattcaatttttaaagcagcattattaatttgatcaggaatcacataaggattagaaacttttctccaaatatcaagatcctcagccataatgtaagattgcatcttactacaccaagaagaaaaatccgttccatcgaagacatggggcgtagttgtaaatttattagccatggcaaaacaactctagatcagttaaaatccaaagaagaaaacaatgctctgataccacttgttggatcgaaacacaagaactaagccaatgatgaactact

SEQ ID NO: 87058 - DNA, 652 bp, Oryza sativa
gctcatcatgtaccctttctgcagctgctcatcaacctgcttcttgacctcggctaattcgttggccgccattctgtacggtctcttgtaaattggggcggttcccggtgccaagtcaatccggaatcaatctctctcttgggtggcatggtagtgaggtcttcgaggaacacttccggatactcgcagactatgggtatatcttccaatttcctcaaattcttctccacggtgtccactgggatttctgcttcaatctgattcaaagagaccccttgctttggtgagactagtgatttgtacaccacggtttctcccttctcgttggtcaaggtgactgtgcgattcgcacaatcgatgacccccttaaacttggtcagccaatccatcccaagaatgacatctaggtctttggattcgagaagaatgaggttggctagaaatggtgatctttgaatttctattgttatagaagggctgaattgaaccgaagtggagctattccctggggtatgaacccgcatcggtgtgctaagttcctctcttattaacccatgcatcccaacaaacttctttgaaatgaacgaatgcgttgcaccagaatcaaaaagtactgttgcagggattgagttaatagaaaacgtacccagta

SEQ ID NO: 87059 - DNA, 632 bp, Oryza sativa
ggtgcatatcgcgcgaggcgattgaactcgtggaggtactctgtcacagtcctgttgccctgatggagtgcccggaattccctcttcttttgtgccacaaccccatctggcacctgcgccttcctgaagctacggcagaactctacccaagtgacttcagtacctggtgggcgggtggccatgtgattgtcccaccaagctgacgcgggaccttgaagctggtgtgtggcgaaagcaaccttctcctgatcattgcattgcaggagattcagcttcttctctatggcatggagccagtcattcgcctccatagggttggtggtgctggagaaggtgggtggcctgacacgtagaaactctggcaacttggactgagggggagggggaccaaactgttgatgctgctgttcggcgtgctgcagcatccgctggtgcatctgctggtgctggtgctgcatcatggctgccatcatctgggtctgatgtgccattacttggactagcgtcggattctcgggaagtggtggcggaccattgccggaatcgctgtggggatgcgccccatcagtgcgctcttcgccgttgctgccctcgcctgttgcgcggctaccattcctggtgtagaccattga

SEQ ID NO: 87060 - DNA, 529 bp, Oryza sativa
ttgaaaactgcaaataccggtttgtaattaagctattagcgagaagcaattaaacggaaaccccagccagagaaaacccggctgtttttcctgttcaggaaacgaatcaaccaaccaaccaatcacgccgaggcaaaagctttggagcggaaacacgcacacaccaaaaaaaaaaaaacacgaaacgaaacgcacgcacgatgagcgttttgctttggccggcgagcggcggcggcggcggcggtgcttacttgggtcgcgggcggtggcgctgacgaggcggaaggcgacgccctccttgtggccgaggatgttgtggacgccgtcgaggagggaggcgtggaagtcgccgaggccgagcacgtccttcttcaccagcaccgccgtcccacggatcctcccttccttccacgcctccttgttcctccccgtcaacctgtcaaagaacccctgcacctgcatcctcgcagatcacaagtcacaatcccctcctcctcctcctcctcctcctctctctctctctctctct

SEQ ID NO: 87061 - DNA, 3201 bp, Oryza sativa
aaaaaattcacacgattttgcactaaatttgtacattcttcccactgatgccttacaaaaatcaatggagatgtgtaatactactaccttttgatgagatcggcggggaggccctgctcggtgaagttccagttcttgtacaccatggacgacatccagagcgcgtacttgccgggaagacggtcatctcgaagatgccgccggcgttgatgagcgtctgccgcgccagggcgttgatggtcatcgtgtcgcggtagtgcgggctcagcagcttgtgcaccgggtgcgtcacgctgagctgccggttcgtcgcgatcacgaacggctccatcacagcgtgcgtgttcagcctgatcaaccaacaacaacaaccgatgagtacaaatctccgtcgatgaagcgatcgattgctctggttttgaacgtaccagtggctgatcagttggtgccagccggagtcgttgacggcgacgtaggccttggcgagctgccacacccaggcctcgacgccggtggacgccggcgtgtacacggtgctcttggcggcggtgacgtcgccctggatcataggctcgctcagctcgatggcgagcggcgccagcgtgccgtcccctcgcaggaagaagagcgtcctggtcgcgtagatgaagttgccctccaggccgttgacgtcgatcaggaacggcatgaaccggtcgtggtggtccagaatgtacagccggttgctgtccagcgcctgcaaatcgcgacacagtaaatttccacacactattgccatttgccagcaacaattcaggtttgcaagtcacgattgatagcaaaatctgcacgtacgaaaccaacctgctgcacggtgaggccctcgaggttgctcccgatgtgcgccgccgtgatcatgctggtgtggtcgccgaacttgctaggatcgagactacttttcgagggaattcctgcgggatcaacatcgagttaaatttgccacatttcacgttgcagcagccgtgttcactatcaatttggcatgaacgcatcactgatcactcaccgtgagacgcgtgatcatcatcgggttcacgccggcgagcacctcccgcgcgaactcctcgtctgtcctccacgcctccttgtcctctgcatacatagccaaacattacatcgatcgtcagttttcacctaaagattctgatgaaaagtctctacgatgacaggttgcgctcacgtttgataatctgaggcatggggagcttgaggatatagtcgccggcggcagggaggaggtccttgacgagctggagcgggaatcgcttgcggagctcctccagcgcggggacatcggggagcttgaggccaccctcgtacaggtcgaggatgtcctggaacgagtcgaactcgccgggggtggtgtccacgtacgtgcggatcgccggcacgatcccctccgcgatcgccttgatcgagtagcccaggaagtccgccatcttcaggtgcccgaaccgctcgtcccggggcacgtagatctgctccaccagcgacagcctactctccgagtccggatctgcacgcacgcatacgtgtacaaaaaacatcagtcaaagtcaaagtcaacggtcaaccacacaaaccgggcccaccgtcagtgagacattgcagctgaacatggaccagttctggtgtttcactatgacaggtgggcctaactgggaggtatgtgagtgaaggtgccacattctagtgtaaaaatgtataaaaaactttttagaccttaaaatgtttttttaagaatcgtaaaatttttggttgggggatgcgtaccgggtggtggtgggtttgcggccggtgcggccgcggcgagggtagggggtgtcgggggagccgccgaggatggggcgagggttgccggagtcgggggagccgaggtcgttgtagacatcgtagcggtagacgcggtcgtgctcctcgtaggggccctgctggtcgtcgccgcgcaggttgcggagctcgtcgtcgcggtacggcttcagcgccgccggcatctggctcggcaggtaggcctgcgcgtcgccgcagaaaatatatcacaaagttaattatagcacgtactcgtattaatacgcatcgctaattactcctacttaattggttagttgattgcccaaatcagtcccttgatacggcaccggccttggacacctggctgcacgctgaacaagaggcaggcaactatctgttcactttaaaacttttaccgtgtcatgtgttcgcaaagtaaaatcgagtgctgtgtcgttgatcttgttgaaaaagcttctcggggccatgaaacaatgccgtctaaatgggtgtgaactgtgaactgtggcaactatgatgagttgatgactcacgtgaactcacatgccttcctgagtccaaggactattccaatttctagtactatagccacttttatgttgttatcatcaggaagcatatccattgtagagctgcttcttttttttgaacagtgctactaaatccacttcacctaccacataaacaacttacataaagtccattcacttctcacctaaccaaatatcttccctatggacgcctaccaaacgacgtgaatcaagcaacttactacataaagcatctacgaactggccaaacaaagaagaacggcaaatggttactgtaatagtgtaatttacatgcagggtagcataatacagtatgcagcagagaagaactcacatcgttggcgaagaagacgcggtcgtaacggtacttgtcggcggggtagacccaggagttggcgaggaagaccacggcgccggcgcggccggggacgtcgtcgagggtgatggtcttgaggaagaactcgttgctgtggtggttcttgacgatgatggcccccggcacgccgagcttgtcgacgtcccagtcgaacgtcacgccgaaccgcgactcccccgtcgtcagcgacggcaggctgctcgtcagccactgctccaggctcgcctccgcccccaccttcccccggttgccgttgtctgcacgccgatgagaggatcatgcccaatccgtcccgttaattagtccaaaccaacgactaatcatgccccagctgttaattatactacgtgtcaccacctcgcgacaccagctatagtttcaggcatctagttcaaatgaggtactacttcttctttttttttt

SEQ ID NO: 87062 - DNA, 5082 bp, Oryza sativa
ttttagtcccggtttttaatggaaccgggactattgtggatttgggtcgaccgaccaaagatggtttctctaccagtgggacgcaggcgatgatggcggccatggcagctgtggcagacgaggcggacgcacgcgacggcgagtcggcaactgctgtggtggatgacggcgaacgcatgcgacagcgacgaatgcagtggaccatagtggcggccatggcggatgatgatggataggcgacagccacgacgatggctgcggaggacggggcgatggtcacagcggacgccgccgccgccgacggtcgcagcgaatgaggcggacgccggtgatgacgccaaccttggcggaggaggcggacgcacacaacggttacaacggcagtggacgacgacgatgggcacggtggcgattgcgacgaacttagacacggatgatcggtacaaggggccccagaaccttgggcggagcgtgcagctgggcgacaaattagtcgcccgctcgcgctcgcgcttgacccctctctcctccacgtaatcgcaaaatccgagctggcgttcttatcgtcgattattgtacccgctctaacaggtgggaccatatattaatattatagtaagcaactattgtataaattgactattagattagctataaataaattggagctagtagtggactatattattaaacttcagttctgatctcttgctgcatacttgatcatgtggttaattagcgttgccgagatgcgtagcccggttggcctaataaacgtaaaagcctatatttaaattttcaaaattttcaaaattgaaattgcagatggttttaagatattttcaatatacttttttttagtattgacttctaagtcgatacgaacaaatatataaaagttgtacctataaattaactctttattttatgtttaagcttattaggaaatatggacaaccaatgaggctccaaatgatgttcggaagggtaactttaccatccttaaaaaagtatatcgggagataccatactttctagtgtaaaaatttagtatctccggatacttagtacttcgatgtaccaaaaactaaaaactttagtgtaaaatttatatacctcgaggtactttttaaagtaacataaaatttctcttttcggaagctttcccggccgttacccgacggggttagtatgatttcaaaattcaaatcaaaccatggctaatgacggtatataacatttaagttcttgtagagtataatgacggtcaataacatttaaccatagcgaaagtttttctatgttactagttataggtccacgcgatcatcattttctttattcactttagtggaggatttggatctgatggattgatggtttttaaaatgataggttttcttgacaagtgaaagtcagttctatttttttttaggagtggacgggttttatggaagaataatctggtgcgcatagtacatacttcctccggtcccataaaaaatcagcatagtaatgtaccacatcctagcactgcaaatttagatatacgtatgttcaaattcgatgtattagaacgtatcacatcgattttttttacgaagcgagtactccatatatcaacatatgctaaatatgcgcatggaggagtcggattatagcaggtacaatagcaggctataaaccaactgcaaacatattttaaggagataaataagaagagagaagagcagtggactataaatttgtagtcagctgtagcacgaactttaagacgtagtgtgtgtaacaggtaggagcaggtattaatagtgtagtatgtaactattgtatggatgagctattagaatggctataaatgaattggagctagtagttagctatactgttaaacttgctcttagctccgatttttgcgacccttgtcacaatcacagttgatcgagtaccaaactttccattcgtggattccgttggtggcgttttttccgagggtagttggattcatccacaggatgatgcagacgtgtcagctgctactatcgtattggcaggcagtacaatcaacacttatccagacattgtagcacacaagtactcctgctcttaccacaacaaaaaaaaaattaaacaaatatttatccagattcatcctcagaagttaattttttatgggacggtatgtatattttacaccttcaataaaaatcattttttatttataaacctttatcttataaacatgaaaaataccatatcaaaatcatagctagaattgattttataagatcataactatcacaggttggaatgacaagcacatcaatgtagaatcaaatgctggctctagacacgtactcccactgtcaaaaaaaaaaaccaaatcccaagtgttgtggaagacggaatacggatgtcggacggggagagtccccccaaacgattaatcggaatacggatgattagtcggaatatgacggaaatttaacgttttgcaaatataagtacatagttaataatagtttgtccttttagaggtaattaaatccatatgaacacattctagtttcctagtatatatatttaaatagaacaaccataacatgacattaacttaacatacacgtactaaagttaataatgcaaaaaatatcataatgcatatttatgcattaactagtggtaggttcagtttataatgcctgccattgctgctataacaaattatatataataataccatgataatttgcattacacgttattgaaatcttatactagtattagtgcatttgaaaaatatttggtcttcaaagagattaatatagtagtacatgcatgctgtacaggagtacgagagaagacaactaacaggataggctattgtgcgtgggctgggcccagtgaatttgatcatgcccgattatatactgccaatacggccgattagtcggaaaaacgctggattaatcggtaataacaggaattacgcgtttttggacgactaatgaggaccgttttgccaaaatgtgacggactgcttaccgtcaccgttttaacgggcgtcatagcggccgtatcaaccgtcttccacgacactgcccaatcctgagtttaaaactggacaccgttttttttcgagacggaggaagtatgccttaggctgtattcttaattcaaagttcccacccttagtttctcatttctcacatgcaaatttcccgaattattaaccgatatattcttttaaaaaaatgtataaaaagttgctataaaaagccatattaaattatttttaaaatttctttagctaatacttcatttatcatattttaactatcgttccattaggttaggcgctcctaaccccttcggaatttctttagctaatacttcttccgtttcacaatgtaagactttctagtattgctcatattcatatatatgctaatgaatttagttacatatgaaacggatgaagtacttcatttatcatattttaattatcgttccattaggttaggcgctcctaagggcaagtactataagcctctacatgttgcccctaaatttgccacataaaattaggtgatgagttggaggagagaagttaggagagagagaatgagccacctctcatgaaaggggcaacctccacataatctctaagaaaaatataagatgatgtgagagtaaactaatattggggtttgtgtactagaggtggcatgttgtacttgttacctcttaattaatgagaatatgacatgatttaaattagatctggtactcacctccattataaaacttaccctaaccccttcggaagaacgcgacctttaataagctcaaggaaacaaacccaggcaattcggccgttcagttcttaaaggcccatccactatacgtgccaggctatgtaggccgtaatccgggctttcgacgcgttgaagtcactagttagcccataagtatacgggccttgggtcaccctaaccttggcaacccagccggacgaggatacagacccagcgtacgtaagacgtacctaaacaattcttacaaacttgtatgaaccgtttgatttagttaactaaattttttaaaaaaaacaagatttaatcacatcatgatacgtcaggatttgtaaaatgtttgtacaagaaagtttgcatatatcttttccctgccgtggaaattactactccatgaaaagagctaggctaggaccaaactatttttttttctgctttctacttaaaagctcagctggtttctatagactagctatactgtgggtgacatgtcttcactgtcatgcatatctatatccaaaagtcagaatgaaacttatatatagacgtaatttaagacggtaaaatcccgcttatatatagaccagcttaaagaaataatagcggatgctctgaccgtctatatgtgataaaataagcagacaaacaaaggccatctagaagagagacatactttttcgaactgaaaaacccttttcaaaagatcatggaagtaaaccggcaatgcagacaaaataaggcgtgtttacgagcgtagaggaattaggcctcgttctttttctaattaagatgagattctatctcaatttgtgttagcacgcctttaaaatggttgaacggtacaacgttactttaaaatatcaaataaatctatttattaataagttgtaataattaaaatttagttaatcacgcgcgctgatgacttttttgcatgtcccttatttaatcttaattttaatcttactctaaacacaagtgatacttgttctttgcgtctcagcttattacaagagttacatatgaaaagataaaactgctttcgtaacatgaaaataatctaggactattatagcatattctcgtaccctgcggctccgactagctggccagcggcctagcgttgtactctatccatcagctgtactaaaaaaaaactatttttacgtgcgattaaaattaatttttcacatatagctgccagtaacgtaaacaatcatcgttccaccgtcatcgaatataactcagataacacaaaatcaacaaa

SEQ ID NO: 87063 - DNA, 1581 bp, Oryza sativa
ggcgagctcccaggattgcttcagatggagaatttcatcatctttcactgtggcgtggttcatcatggtgttgtctagtagcgccttgactcgagatttgttgggcgtgatgagcattttcaggtcaccggcgagacgagcttccaccctaacacgagcagtcgagggtcggggttgttagagataatgcaatctcctgtaatctctgtatgcgcaagatgaggaggccggtagtttgttaacctgataaggttgttagagcatgtataggagatccggttcctcccatctatggcgcatatatatctgtaaatgatcgcacgattcagtgctgaattaacacgaaccgtcgcatcgacgacattacctctagattgagttttctttcaggggtggcgggcggcgacggcggcgcaccggagggctatctcggcggtgatcacggtggcgccggagtcgaccacgaacgactgctccattccgcgccggttgacgatgagtcgggcggcgacgagggcgtccgccccggcggcgtcgaggtagcgaagtgcctccacctcggggaggtaggggaagaggcaggtcatgaaggcgacgagcccatccagcgaccgctggaacatgtccggggcatgctcttctccgccgccgccgccgacttccggacgccgggaagaggacctgatgacgctgttgacgacgatgttggaggtgggagaggaggccgaagcagaagccgccgctggagatgaactcctcctcgagacacttcaaccgacagtggtcgtagcacctcgcgatcttggcaagaaccggcacactctcggctttcgtgtcgcctctggagtattcgtccttgaagtttcttggcccgtagatgcggggaaggtggcggcggccgcctgggacgctccggtgtgacatctatagtcgatggtttggaggatcgggtggtggaggcggcgatgtcgtcgaggatttggagatcgggagggggtggcggcgctgcacctctcctcctctctttagtcgatcaggaggcgaaacgccggcgccggccaaaacgcgcggtgctgcttgcctgcttcctttcggtttttttttttttgtgtgtgtgtgtgtgtgtgtttcactgtttggactgtgccgtggattgattcgtttccttactataaacatcgccgtattttctccggctgggtttccggctaattgcgcgcgcgttctctctctctcacatcttaatatttcgcaaaaaaaaaggatcttaaggaaaatcagttggctgaaaagacttttgaaattgagagaaatttatcgacagatgtttagcgatatcgttcgttttttagatgggccgtgacggaccggcacggcctgctcgccgtgccttgccggcacgcgtgggtcaggtgcgtggcccaagcatggcccaatgaaaaaagggcctctccgtgatgaaccagcactgcacaggcacggcccaggtcaaaccatcggaagaaaggtgacttgaactaaccgagttcttcctcgatagttatttttccatccaagcaggtgtacagaaattggggtgca

SEQ ID NO: 87064 - DNA, 531 bp, Oryza sativa
tctccccgaggggtcgggccgctcccgtttcggccccgagggctggggcgccccggccccctgtgggtttggcgccacgtgtgtgggttaggtgagcacagcggcgctcacctaaccgcgtttattgcgggttggacgagcgccccatgtcgcatttaatgcagcgcagcacactcgttcggtccgtgacaggtcacagtgtgtgaccggtcacagaccggtcagatcgtgggttaggtggcaacaggcggcctgacacacgcctcgccccgtcccgtcggaatgatgagagcctccaggcactcgtccctagccggagccggcgtgggaactcctggagttggcacgtcagccccggccagatacattccaggcttcatggcaaccattgcaaggaagtcattgtatgaagaagggcagacgtgtagcatgctgaactgacacgtggtggacaagaatgaccggtctgtgactggtctgacgccggtcgcgtcatcggcagacaaccgtgctcccgcgatgcatctgcct

SEQ ID NO: 87065 - DNA, 12129 bp, Oryza sativa
tgtttcagtttgttggatatatcagtgtggaattccaattactcagtgacgtcatgctatttttgttcactaaacttgaccaacaatctttgttttcacagacaaaactaagagtaaattatattattgttattgaagtgatgcttgttgttgatatcataatggatgttattttcatatggtcagtgtgtaacctaaactaaaatagttttaaatgataaatagaggttccctattttccagatctgtctacttggtgttttttgcttttctttttttatttttcatgctgtgcttctaactctaagtttcattgctatatcaactcagaaatgaatttaaacacgagcttactttactggagaaggcccgccatccaaatttggtccaatttgtgggagctgttacacaaaatgtaccaatgatgattgtttcagagtatcatcaaaaggtaagctgttatgattgattcaactggaggaggcaacgattgtctttttacacataattatttcctaatcatattccttcaaattgataatttccttggtgcaatggttggcagtctatggacaattttcacataatcttgataagagtactatgaacttacctgaacagtatgcctcttttgtcatcaatgactaaatctgttttttttttcggattagggtgatttagccagttatcttgaaacaaaaggtcgcttgcagccttacaaagctatcagattttcccttgacattgcgaggtatgtcagaagacatattcaatagagtaaaatgaagctcatgtctgctagctttggaaacctgattttatatttttctacaaattgagagagcattcgttttttctcatttaggggattaaattatctccacgagtgcaagccagagccaatcatccatggcaatctgtcaacaaagtaagctgaattaaattaattttatcattgggttggttcaatgttttgaaccatactgtctttcaacttgtgcactgtatgttatgatattttggtaaggttgcagaagcattgtgcgggatgatgaagggaaacttaaagtggcaggctttggctcacgtagtctgattaaagtctcagaagataatccacaaatggatcagacgacatcaaaatttaacagtatgttgaactcttgttttgatgctacaccctgaaattgctcattggcagtttatatcgacttcagttcatacatattgggcatattctagtgtcagaaactatggcaaattggcaatatattgtactacttaaaattcctaggcgatgtacaaaagtgcacatttgattggggagtgactaatcgtgttacttattggtctatacttctttaaaataacatgtggtttctagagcctcatcagttgcccatattcactaataagccaaacggcttattagggaatatcgttgaaatggatatatgcatttatgcattttggaaaaaaaaagggggcactttatacgtgcatgaagcttataaccgattaaatgtactttaaaacctggttaaatggttataagttatttatgatgttaatcctttagacggaacatattcttttttttagataatggaatgagtaacatcccggcctttgctccaaagagctacagtcctttagtcaattttattggccccgttgcagctgcatctgttctttacgtgaagttaagacttatgaatgtttttctccctgtattgttttgtatcattttaactaactttccatggcctgtaatagaatcggtttactatgggctgtgtgcatgttttgtattttatcttctattatgtgcaaaagagtcacttgaacacttggtgttctatcttgtactcaacaatcttcataccgtattttgcctaggtgtatacaccgctcctgagatgtacagaaatggaacgtttgacagaagtgtagatgtatttgcatttggtctcattctttatgaggtatgtaaaagcattcatcttacacgcaacagaatcaatttgtactcctatatgctaaagagttgtcacagttgaatgtattgaaagagaagaaaaaaaaatccacagtggtggtttgatttgactccgatatttacttgaactggcatctttttaaaatggcattttctgcatggacttttatgattcagatgattgaaggaactcatgctttccacccaaaaccaccggaggaggcggcgaaaatgatttgtttggagggtatgagaccaccgttcaagaacaaacccaaatactatcctgatgatttgagagagtgagtgaatctttactataagcttttcaactagtaactagaagtagtttctatgcactgtattattaccttggtggtctcgcaatgagctttgtttctgctcaatcaaaattcgcaaccgagtttaatcgtttggtttatactccgctgataagtcgttttacggcttattatcaatccaaaaattaatttatgggtaaagcttttatatatgttctcttagcgatttaaaagccaatataaatatgataaaaaatcttaaaatcaacttaaaattaggttataaaaatcaaaattctggttccgttcgataagccaaaaggcaaacgatgtcgctttgcaaaagctgcttccttcacctttttttcttagcagctcggctgtactgtggaggtttagactttagcacctaaaacatcatcaagcacggtgttcttttcaatgcaaaaccgcctatgtttcattttgtcttcatgccatttgcctctcacggtggttcgttgcatgcaggcttatacaggagtgctgggatccaacaccttcggtcaggccgacgttcgaagagataatcgtacgcctgaacaagatatccacgagttttactaagcagactcggtggagagacacttttaagttaccatggtatacagctctccgagctctcaaactttagttcatctccaaactattttgaactttttttatttcccctgattgttctaccatcagaatctgcctggttctcacgttttcacctgatacaggaaacaagcttcagagagatagcctggttgccgtcaagatttccgccctttttgcatatgtgagtaaacacggtgaaaattgtatcgagttgtcgaggagatagtggtcatttttcacgtttttgtatttccaaaaaatatttgtaactataatcagcccgcttttactttcttatgaattatatcatttttaactggaataatgtgttaattttctgaacgttcaacgctgctcgcaagcatttccccaaagccccccttgccgatcaattacattttatatttgttgaaacttccacacaaatttcgtgagctataacatcgtaaaaagtttgaaaaggaagtctaatcaacctctttgttaagaggacattaccatgtaactctgcagcggaaaaaaaaaactagatatatccatgagctccattgcaggagggcaagcagataatgaagtacatgaggaatataccttaggagttatcatcaactcctcatataatggatccatgagctccattgcaggagggcaagcagataatgaagtacatgaggaatataccttaggagttatcatctgctcctcatataatggattttgacattttacttaggagtcgtattgtttgaccacttctcttatttaaaaaaatatggaaaaaaaataaaaagttgtgcttaaagtactctggataataaagtaagttataaataaaataaataataattttaaaaaattttaaataagacgagtgcttaaacagtgcaagtaatcttttatattagagacggagggagtactatcaataacgtgtgctaaaaaagaaaaggtagcggaagcatatactccaccaaataggctgctcgtattggcacctcatcaaatacaaaatacagagcataaaaccgggggaaaaatagtaagaccgtaacaaattccaagttctacagttattttaattttcaaaacttatactgtaattccaagttgcaggtcacaagctgagcaaaatattgtgaccgagttgctggaaggagtacgcgcctaccctagcagattctgatacctttgataggatataaaacggcttattagaaaaataaattacgggcaaaacttttatacatgtgtacttagcgatttaaaaaccaataataaaaaataaactgcaataacaaactctaatataccaactctaaaattaaatatttaaattcaaaatttgatagctgcttataagctgaaagacaaacgatagaaacatgccgattcttttctccgcattagaattggcttctccttcgacagagataactaaatatggatatgtaaaatgagaaaaaaataccacataattaataaagttttaattattccaaacataaaaatttgatttatccaatattttaagacaagctatatatatatatatataaataatttattcttttttaatagatgatgccattaacttttaaacacatatttgaccatttattttattcataaattttatgtaaatgtataatatataaatcgtacttaaactaatttaagtgataaattaacttataacaaaataaattataattaaatttttttaataagataaatggttaaacatgtgacaaagaaagttttttctgaaacatgtgaacaaagaaagttaacggatgtaataaacttcaacaattttagaaaaaaatgttaaatctgcatcttagacagtccccacatgtcattcgctgccgcgccgcgaaaactttatttccccctctccctattttctcgcaattttttctcttctctcggccgctgcacttttttctttctttcttctcacggcttgtctccccttctcccctccaaatacccagcggctgctcttctctctcgtccctcctcttctctctctcctcctcctctctccaaaaccctaacccctcctcgatccaagcagctcgacgggctcggcggcgcgcctctcgcccggcggtgagccgattcactctccacccccgctttacctcgagacgatccctgggcgtgtttttctttgatttctttcccctgggtttctctgctgggggattcgcgtttgagccgcgagtaggtcgttgggtggagtggatcgggagccgggtgggtgagctcgctctttgctcatcggtgtcgcgttctttttgtttttcttttgggtgatttggctgtggtcatcttaggattgatttgtcagtgttgatcaatgcaaacgaattagtgtttttcctaaaagttctttttatttttttccatgatgttgtagcgctacactggtagatcctaagtgccgtgtgtttggattgtctctgggttgttggttctctgtagctaccagaactgtatctttccctcgattatttgccttcacaggaattgtaaatgagtggactttaatttactgtgttacttgggttccctgtatctgtactctagcaacatgggagtagctggttccctagttccagctcgcgatagtaattttcttatctgttaggttcaatgaattgattcctattccattctttacatttgttagattctagcaaacttctaccgatgttagtgttgtgctgagatgcccttggatgcttgaagtgaatttctggtgatagctatcttgttgatttaaactcccacttcaacacaccacgtgcagtattgtgggaactctggataatccttatttcatcgttgaaaccagcaaatgtagggcctttgggggaaagtagcaaaatttgtttaaacattaagctagaattcttggaatgaatattgttcactcatatgtgctgcttctttcttttttccctttgtggataatccacacgtttatgcttgaattggattatttcagggtctttgtccgaaaaaggcatgaccttggccttctaattggaaaggtgtgaagcaattaagtatggcttcaagggcggtcatcagaagaaggaagtatcttttggatcatgttaacgcacctaccctctcattgtcccccttctctaccttccaacatggaagatctggttctgaggatgaatcaagaatcggacagcgatttcttgagcaaagctctggggattccaaatgggagcaagggcagtatggtgtgaaattgataaagggagatctactagcccttggtaatgggcttctgcggcgcccagcccatgggatttctctacctgcttatggaattggaaggaaggaatttgggttgcctatgggtgctagacatttgctgcagtcagtccgcacagcctcaactgcaacagctgggcaacctaagttggatattgaagatgaacagagtgaggatcagaaacagaacaaaaggaaaaaggaggcatccccagaagaatgtgatcaggctgtggaaggcctaagcagtgcaaaagctaaagccaaagctaagcaggtacaagaatctgtaaaggctggccaatcaattgtacgaaaattctgggcgaggcttctgggtattggtcctgctctccgagctgttgcttcgatgagcaggtctcacttccttctctttgccctccagcccataattttaagacaagaatattaatttcccctttccctttcttttattaacatttgtttctttttatgtgttcagagctgattgggctgcaaagctgaagcactggaaggatgaatttgtgtcaacgctgcagcattactggttagggacaaagctactctgggcagatgtgaggatttcgtcaagattactggtgaaacttgctggtggaaagaacctttcaagaagagagagacaacaactgacccgtacaacagcagatatcttcaggctggtaccttttgctgtgttcatcattgttccattcatggagttcttacttccagtgttcctcaagttatttccaaatatgcttccctcaactttccaagacaagatgaaagaagaggtatgtcagtgtaacaacttgagttacataatatgctaatgtgatcaatattgtttaggcgtttgattttctctacttggtgttgtcttactgatactttactaatgcatgtgtactatcattatggtaacaagtcaataggaggttgtatgcatcttccatgtttgctaatgagagatttttgcatctcgagtttaatttggtgtccccttgtaccacctatactggaaccacaaaaactattgcagtgcaaatcgattggtttaagaatgtagttcactcatctgtgcaggaagcgttgaaaaggaaactgaaagcaagaatggagtatgccaagtttttgcaagatactgcaaaagaaatggcaaaggaagttcaaacatcacgtagtggagaaataaaacaaacagccgaagatcttgatgaatttttgaacaaggtataagttctatacatgcgttgtttgtcactagaaggttagacgattttctgaatttgtttgtcgaataactcactttaaatggtaattaggttaggagaggtgaacatgtctcaaatgatgaaatcttgaacttcgcgaagctgtttaatgatgagctgactttggataacatgagcaggttaccattcttaatatacttgtaagttcatcatcacattacactagagctgattgctgattgatatttcttttttcaatttttctgcagaccacgcttggtaaacatgtgcaaatatatgggtattcgacctttcggtactgaccactacttgaggttcatgcttcgcaaaaaactgcaagagtaagtacttgcgtcgagaagattatatgacatgtatgaaaatatttaacttaacaactggagtgccaattagatttgcatatttggtgtcttaaatctgtttgacataaatatgactggaagtttggaatggtcaattttgaaatacagcgagtgatggatacctggggatagcttattgcttagtactttctctcataaagcttagaagacaaccatcaaatggcatactgagtgatttttgcaatcttgtagtctcttatcataattgcataatataagaacagaggtgggtggcctgcaaattgtaaaacaaaggagtgatttcaagcaaaagtctacggcacctaattcatatgcaaagaaaataaacagtaatttttttgctggatatgcaactgaaacttagtaaacaccagaatttgtatttgtttgtatttttcaagatctatgtaccctaagtggctgtggcatacatttgactcgaacagtttctcaggtttaacaactatgattatttgctgtacagataagatattttaacagtatcttattattcaatgcactagttgttttgctatttactttgctgccgtttgcattttccataatagtagggcgaaatatctggttattgtttgtagtgagggcccaccttcctgatccatagggggcgtctccccgagttttttttttttttggttgggggttggggggggggactggctttcgtggccttccccagcccccggtttcaggtgtattgaaatgccctgggggaggtctttccccttgggaccgagtttatttatttttggtttgtaattatattcttctatatgtagcattaagaatgacgataagatgattcaagctgagggtgttgagtctctctctgaagaggaacttcggcaagcctgtcgtgaacgtggtcacctaggtttgctgtcaacagaagaaatgcgccaacaggttggttttgcattgtttccgctatatgcatatccacacaatttattcactcttttacttgctggaattatttgttactctcgctgcctatacgtcactcttggcattcattcctttctcacattatatgccattcttcctttttgggacgaattagttcacacctttttccatccactgtccatttagtccaaacaacatatccgtgataatgatatctcatgcacatgtctaggcttaacttcggtcattttaacacacctttgattcttgtgtcaagaatgactagtgatgcggcatactcatttttgtgtttccatagattagagccatccatcaatttccatgccgggcttatagttttgttctacaaaagaatatatgtttgttctgtgcaaaattatttgtcctagttgttactttctcattctttagtttattacttattagtttgagacatatgatctcattagattatttcttcttgggtaatgttctgttaggtctgataggcagatgaaggaaagttgtaactagcacttagcttctgcatttccaccttgaattgagcacataaaaaacttgatcacatagcttttaaccatactgttgtgtgttacaaaaaactaactgctatcttgtaactgaatatttttctaagctagtaattttgcttcctgtccagctccgagattggttggatctctcacttaatcatgctgtgccatcctctcttctcatactttcaaggtaacattgattgatatcacatatttctcgtttgctatgatactgctgtttgatttgttcgtgcttgattctaactcatatctggtgatgttagagcttttaccgtatctgggaaaatgaagcctgaggaggctgttgtagcaaccttatcttctctaccagatgaagttgtggatacagttgggaccgtattgccatctgaagattcggtttctgagaggaggagaaaactggaattccttgagatgcaggaagaacttatcaaggtgatgtatacataatatggtcctttctttatgtacataagatatttcacttctgcttgtgcaaattaaacagttattcttggggcatttatgaaatcagtaaatcactttgattgtacaaatatcagccgatgcagaactgccctctgttaaaaatgcttcctgtgtttaatctttatgtaccatatcttaatttatattaaattgtatttgacctagttcagaaacacatccatttataggacaactgatggatcatctgcactctgcattctcagattctgatttgtgtgaatgttaggcgtattagtatttagtattgcatgttctgttgtgcccttgctaggtttcatgcttgaacctcataggatcttccatatcctcttggtaatgcatatatcagaaacagtacatggtttatactattcaaacttttccttgtgaagaacaaaaaaaagaatgactgaaaaaagagtaattggagaaaacaacacatatacgatagtgcatctaaattgtgatgcattaactgattcttgtgtgacgtgtgttttcacacgtgccaaagttagactgttaagtttctgtttatgtgcccatattaagaagtttggaggagtcattacaaattttactcaaatttagactgttaagtttctgtttatcagctaatccattggatgtaagaactataatatgctgtatttacacttagcttgagaagaacataagtctgttgatgaaatctgatgtgtcaactttagtttaatattgtggaaggaacatgctttttcctttttctgaaacaaattactttcatttcaacaaaatactgctagaagtaggacttaacagtatcccaattattttatgttctgcgtgatacttctaaaattcctatgttgaactgtagcccaattgttctatcttcaagatatattggctacattggattgtaatgcttttgatatgaaaataattccgtgggagagaagacgaacgagaaagaagaaaagccgaaccggagaaagaagaaaaggccaactcaaagaacaaaagcttgtgaggagaatttgctttgaaggaaatgactgtcctactgctagggaagaagaagaactgagagaagcaaaacagcacgataaggaaaagctctgtattttagtcgagcactggctgtactggcatccgcatcgagatgatcctagttaagccatactttcttttggtaactatacactgactatagtatccttataattctattgaaccactactgtttttatatgatagaaaataattatgcatttcttttactgtaattatgagcatacaacaggccatgtttctgacttccttatattgcagtctgttagcaaggagcgtcaagagttcctcagccttgtcaacaaagaggtatcatatgaacttgtaaagtgatattagagtgacaattgttcatgcagttatcttccatttttgttgcaaatacttgggagggttcaataactcttggtctttgttgaatgcagattgaactgtataactctatgcttgaaaaggagggtacagaaggtgaagaggaagctaagaaagcttacatggctgctagagaagaagtcggacaaggctgctgaggttgatgaagaagaaaaggtctcatcggcgctgattgagaaggtactgatacttttcatcctgcatgcaaattcatagtttaccacggtgactgaaatgccccccccccctcccccctccaggtaacatgcatattaggttcatctctgttttaaaatataagtagttcgtgtaaatctctctgcttgaaaatataaggagttcgtgtaaatcctaaaaagaggatcacttgaaactttgatttattgttttttgataagttttcctctatagatggaatctgcataattttattcccccttcatatgccagcttgagaacaaaacactatagctaacatcaactgtgttatacttcagatatacagattcaagaatgatatgccagcactcattctgaaatttctagtcttggttttttttattgccatgattgacttgttacatgttatgtactttcgtctttcttgattgacttatgtatgaacttcaccttagatgctggagatgtttctccaatactactattgctgatcaatacggtcctataatatttatgatttgcggtttagtcgttgacaatcgttctgtattttaggttgatgctatgctccagaaattagaaaaggagattgatgacgtggatgcacaaatttgaaac

SEQ ID NO: 87066 - DNA, 560 bp, Oryza sativa
cgattaatataaccccaattctcatacattgtgtacaatccatcgtaatactactaaactcagaaaaaaaatacttccaactcaaagaaatgttcattcttcggtactacattggcctctactgatgcgggaacttgacgggtgcaggggacgcgaagcccttgtggtacagaagctcggccatgacgctgtacgcgcgctgcgtcaggtggacgccatcccagctgatccgctcctcgggcctcgcgcacaccgccgtcccgcccgcgccgcacatccgctccatctcgaagttgtacttgccgccgcccgcgccgcagcacgcgttggtcagcgccgtgccgtcgaaccccatctcgcgcgcgcgctccagcatccgcacgtacgcgccgaagtagtcggcgtacgcgaccgtggcctccgggtacgaccgcctcagctcccggatcccctgctgcagcagcacgttgtgcatctgcgcgaacaggttgagacccacgaggcacccgttcccgtcgtacgccgcgcgctccgtctcgttcaccgccgccaggtagctc

SEQ ID NO: 87067 - DNA, 1353 bp, Oryza sativa
atgctggccgtgccggagaacctggacgcgacgatgcggctgctgttcgcggcgtgccagggggacgtggccggggtggaggagctgctcagggacggggtggacgtcgacagcattgacctcgacgggcgcacggcgatgcacatcgccgcctgcgaggggcagggggaggtggtgcgcctgctgctcagctggaaggccaacatgaacgcccgcgaccgctggggcagcacggtactgcgccatccttttctcttctctcctctcctcgcattgctatccatggtgctctgttctaagttctggaatctggatgaagactgttcatgtactactgaacattttctagtgttcgttctgtgtgatcaaagtatcaaacattactagtaatcgagtattcattttgtttctgcaagactgcaactagcgaagtgtaaggcacgtacgcactatccatgaataagtcgattgactgatcgaacataaatgatgcgtgcaatgttcttatgttcagccagcggcagacgcgaagcattacgggcactttgaagtttacaaccttctgagagcaagaggagcaaaaactccggtactataatcacctacttaaactcctgaagcaattgattgttgcttacttgctttgatacatatatacagaacatatatagtgtcatgttttttttttctttttttgcttcttagaaacaaaagaagaccccgatgacagtttcaaatcccaaagaagttccggagtatgagctgaacccacttgaactcgagttcagaagaggagaggaagttacaaaggcacgctcaacttcccctgttttttttccagtaatttgtttattcatatgtttggtatttatcaacttccacttaagtgctaaggcttatgatacttaaaaggcatgtgtttgtgtatgacacctgatttatatctggacttacaatgattaataaattgtgctccactccccatggaaactcaatctagtgatggttcttagtattttcatcagttgattgttttgtgagttctatcttctaaattatggtccatgtcttttcttcttcacattcatgcaaatgcacatgccctttttttctcttatgactttcacagaatcttgacaaatcctacttgccataaaactttttacagggtcactatgttgccaggtggtatggatccaaagtgtttgttaagatacttgacaaagacagcttctcagacgccaatagcatgtattagctgcctccgtaattctccttactattgtaccttatttatgcctcatgcagtcgactattccctaccatgagtccatgatatacatcttctcttca

SEQ ID NO: 87068 - DNA, 544 bp, Oryza sativa
tgacatatatgcatattttttttcgcgaacgcacaaaagattgcacgtcaatatattagaggaatagagtttttgttacacaccgcaattggccagacccgcctatgccagggaaggggaaaaacaaagtcaaaaaaccaaggaagagaaaaaagaaaaagaaaaactcgaacgctactccaaacaacgagaggggccagagccacgctacactcccaacaagtccccaaaggaagtgatgaaccttgagttcctctcgacactcaaggctattgttggcccgatctttcggtgagttgtgataactacgatttgggagaaacgttgacgatccgactacaaccgtacgagacgttgtgttgcgccttagcgatcgatacacctctccgtgggttgttgatcttgccggtgcagatcaaccctattcctgcaagcaaatcgaagaaacaagcaagaacaagataaaagcaatctgatattgcaaatagaaatttaatacaaatgataagttggggtttcgaatacaagcagacggacggtctag

SEQ ID NO: 87069 - DNA, 687 bp, Oryza sativa
ctacaggtttgaacggcgagaccgtggagcgccgcgtccgtcaagtcgtgatcaagcggccctagcaccgggaacaacttccctggccctctttgcaagaaagggggcagccgaacgcgaagccgtaatcaacgtgagtgtactcagcgacccttttgccttttttcttccggggatcgcactgtgacttcatgtagtgcaggctctccctctgactgatatcatcgggccgctcgtggaccatcaggcggcggcgtcgctgaaggaggacattgccaaggaggcatccgatgttgctgccgctgctgtcacaacgagtggcagcaacgttccgagaagagggaggatgttctcctccgtgctcagaaatcgtcgaaagatgcccaccccctcggtaagctctcatggtccttcatcgcgtagttggaaaaccttgacctcacatcatgctcgttttactctaggcctcggatgcgtctccgccacctccgcgacggcagcggcttgtgacgcttggtgagaagtaagtggatgaattcgaggttttgttatttcgttgaactctcgcatcctgtcttgatggcagcctttcatagggcggcgcgggtgaaagcagcgcaagatggatctggaggaactctagcgcgtctccggccgtggcctcgacagatgtcgtggtcgtgccca

SEQ ID NO: 87070 - DNA, 539 bp, Oryza sativa
cttcaccatgtttgacaaagtattgaccaatattccagattgattgatcaaagcatggtgcacggcatagtcaacctgatcctgaaagttgttaaactgtaactgcgccatattgccatcctgattagagccaacaccttgatttccttgagaaccatctgcagcacccttatcactcggttgagccacatcacttggagcttgtttcacttctctatccttagaagaaccggtcccagggacatcagcaactacctttacttcatatttctgcacaactgtccccttgcgggtttgcatgaatgagttcaagaataggttacgtgcttgttgcatcattgcttcaagatccttctgctgatcaggtgtcaacttgtccggagtgatattcacgatgttgccttcttcgacttcagatagacctagcttctggatcttagctttaacagagcccggttcaccagccgaagacaacgatgctggcggcttctcatccatgaggaaaactctgacttctaatcagtcccaccgggcatgcc

SEQ ID NO: 87071 - DNA, 539 bp, Oryza sativa
cataagccttctcgaaatctagctttaaaatgatcccttctagttttctaacactcaattcatgaatcacttcgtgtagaatgaccacaccatctaaaatgtatcgaccaggaataaatgttgtctggcattctctaatgattttccctgcaactcttgacagtctgaccgctaacaccttagtaatcagcttaaaagcaacatgagcaaacaaattgacctgaattgtttgattgtattggcattcttaatcttcggaatcaaacttatgaccccaatagttgagcctccaaagatctaagttcccttcaaaaagagcatcaagcatttctttaaattgcatcttaagttgtccccaaaactctttcatgaaactaactggcagtccatccggtcctggggcagtgtttgataccattaattcatcatgccttggtgttagaggcggcaacagaatgggtcgaggccgaattggaccggaatgaccccatcccataacccacaactggaggaaatgatccccacccccgccagggtcc

SEQ ID NO: 87072 - DNA, 1409 bp, Oryza sativa
cattttggatccagcaaaacagaagtagaagcaattccaaccatatctgttgtttcagtttcagcaaccgcaccctttgtgatctcagcatcaataccaacaccactaggacccatcggtataccagtttgagcaccaacagaagctacaccataagttgtcgccgctgcatcctgaacatgaacagtagcatcattaggagccgtgtcactcattgccttcaacccatcttcaatcttgtcactttcattcatcacatatacaaaattttcttttgtttttgatgcatctaaagccaacttaatcattttctgtgacaagatgttgaacctgagtaaagggttgctttcaagaacagcagcaggcatcaatgtgtttggcacaaataattcatggttcttgtctttcagcctccatctttcaataaaatatttctcaggtagttttgttatgttcaagtgaatgagtactttgagcacatgaacacacaaaataccatccttcttaaatcttgaacaaatacattcatattcttcagctatagcatcaacaaccacaatatacttcctttttctgaaatcctgcagtgcatgaatctctgatttgtacacctcaaaaatagaatcgtgcactttcacagtcacatcatacttggtatagctttgcaagatacgctgaaatgcccaaaatatcttcctagtatacagttttgcagcttgcttctcaaattgatattctgaccaagtatctggaacaatattcctagtcagcgattcctattctttgaagcactcataaattgtttttgcaatcctttcatactgtgctaggaatgcagaaacactatgagatgaacaaatgtcagctttgtaccttgaatttgtcccctcactccttgctgttgtctgaatcaaagggcaccaattgcttttgaagtaaactggtgcccatctctttctagtgacccacataagctgaaaatacctaacattatacagattctttcttcttatgaaatctttccacaaatattcaaattcagcctctgtctgggattttgtaacaatatcatggaaatccttgtaaacttcttcatcctctgaattgaatgtccttcctgttttgtcccttgcatttgataacatatggaacaggcattcctatgaacagtgtctggaaaaactatggcaatagcagctttcattgccaagtcttgatcagttataatagtagcaggagcctttgcacccatacaatcaaagaacgtatttgacaaccaactgaaagtctcactttgttcatcttggaggaatgcataacccaataagcaattgcaccatgactaggtattcctacaaatggagcaaagggcaaatcatacctatgtcttgtacgtcgtgtaaaactat

SEQ ID NO: 87073 - DNA, 512 bp, Oryza sativa
cgctgcagatgttgacgcgctgcacgaggctcagctcgccggccggcggccccgcgtagaggcaccgctcgaggctgccgttcgccatgaacggcagcaccagcgccttgaagtccggcaggctgcacgccgtgacgatccgcatgaggttccggtggcggatgcgcttcagcacctggcactcgcggttgaagctcttggtggagttcccggactgcagctggagcaccttcacggcgaccatggtgccgtcgcgcagcgtgccgcggtacacgcggccgtagctgcccgtgccgatgagccggtctgggctgaactcctccgtcgcctcgaccagctcccggtacgtgatccgcgggaacttgtacttcatcaccggcgacgagccgccgccgccgcggcgtcggcccctcctgaactcctcccgcaccgccgccagccgctcccggatcttccgaatgctgaccgcgcagaggatcgtcagcacgaacgccagcacggcggcgcagatg

SEQ ID NO: 87074 - DNA, 595 bp, Oryza sativa
cgacggcaacagcaccccgctcccgccgatcatcaccggcgctcgctccgtcccggtacacacaacacacctcaccccactcacaccaaattctctccctcttctcacctcaacatgttcacgaaatgttctttgtaaaaaaaaattcaggtgagcggggagttcccgatatcgaacagccatggccatggcgagttctcctcttccctgcacaagcgcatccacccctacccggtgtctgagccaggtagtataacgaattcactacactaattaatcaatgttcttgatgaacacacattgatcatctcaatcatctaccgatgaattctgaccagggagtgcaaagtgggacgagaagaaagaggtgagctggaaggagaggatggacgactggaaatccaagcagggcatcgtcgccggcggcgcccccgatcccgacgactacgacgccgacgtcccactgtacgcaatcctcagctgagcagcttacactgatcatgcatgacaactagtatattgatcatgcctgaactctctgtggcttgcaggaacgacgaggcgaggcagccgctgtcgaggaaggtgtcgatcg

SEQ ID NO: 87075 - DNA, 880 bp, Oryza sativa
ccctccctttttttgttccctccttatccttcctagccccggtttagcccgcccgccgttagtcgtcgcttaagcatcaccgcctttgggcccctgcgcagcggtctccaccggcggttgccgtggtcgcaacggcgcgtgcgcgtgcgcgcaccgtccccatgaccgctcggccggctttgtgccgagccgagcctagcctggccgccgccgcacagtccgatcggccccgggccgatccgggccgtcgatcccgtggaccggcggtggatcacccgcgtggtcccggtccacggtagaccggccacccgtgcgccgctgacatgcgggcctcgcttgtcggcgccgcaccccccccctccgtgctgacgtcagccctggaatatattgcgcaataaatgatttaaggtttttcttttatagtaataaacacagtgaatcttctaaaattcataactaattcatccgagctccgtttaagcccattcaagtctcagtaaatcaagaaaaatgtgtagaatacattaaaaatggttttgttccctgtttcagtagtcttatagcctgtttgcaatgtttgctttgtatgtcgctagattccgattcctccgacgctccggtgtactttgagatagtcaccgaggttcctccagcagcagagcaaggcaagtcatgcttgtcacttgaacatgttgatcctatagtgcaaatgctctattgttttctttcaaatattgcattgttttataatattactatgggatggttacctattgttacagccatgtttttggatatcttgctcctttgttagcttggggttatagcatgattagagtttggactaggaattgcttagccatgcttagttcaactagtt

SEQ ID NO: 87076 - DNA, 1568 bp, Oryza sativa
gactcattcatgtctccacacccaggttatgccccagtcccctagattgaaatatgacaacaaacatttgctatgggcggggggtccgcttcgaaaaagctgtcagcctgccccgctttggaagagcttcggaacagtttttccctagttaggtaacccggttttgacaccatggcccctatgaatcatcaagctgcagcttcgctaccaggttatttacaaaatgaaagaagaaaatacgaaagaaaagcgtccattgtctaatggataggacagaggtcttctaaacctttggtataggttcaaatcctattggacgcaatcttatttctatctattctttaaataactatactaaaaactaagaaaactttttgcatgattcaaatgaaaaatctttctcaacgatttctcctctactaacaagagtagacatgcaaaattgttgtttgttcctgaagggaaaaccgttcgagctgttcctgaatagcttccttcaaaaggatttccgcttcctcggtgaatgtcttgctagaagatagaatttcttggaattgaggtttggtatcttttaggtgtttacgtagctcatccagacatttctttacctgtccaatttctaaggaatcaagatatcctctcgttccggtataaatagtagctatctgctcttccactgggagagggtttgattgggattgtttaagcaattctcgtaatcgtcgaccccttgccaattgattctgacttgttttatcgagagcagaggcgaattgtgcaaaggcttgtaactctgcgaattgagctaattccaatttagatttgccagctacttgtttcatggctttaatttgagccgcggatcctactctggaaacagaaatacccacattaatagcaggtcgaattccagcattgaatagatctgcggataagaatatttgcccatctgtaatggagattacattagtaggaatatagtcgaaaacgtctccagattgagtctcaactattggtacatcggtcatactttcttcccctaaaagagaattgaatttagcggctctttctaaaaggcgtgaatgcaaataaaaaacatcccctgggtaagcttcgcagccggggggtcttcttcatagaagggacatttgacgataagcttgtgcttgtttggagagatcatcataaattattaaagtatgccggtacataaaatactcagacagggccgtataaggagcgaggtattgtaatgtagcaggggaatccgccatctcagctactacaatagtgtcttccatggccccctatttttcttcttgatcccaactcactactaagcaagttcgaacgaaatgcatatatattatctctcatatcagatgtgagtccccgcctaacatacactgacttatcgaggttcacactgtctcgcgggtaaagcaataaactctcttttccaggtcagtcaccaatcattccaaacgtggcaggaattggacaaaccgaggcccggaatgtaacccttctaccaatagtgtgagagcactattcctccaaactctata

SEQ ID NO: 87077 - DNA, 760 bp, Oryza sativa
acagtagtctatgcatgtacgacagttacacttagcatacatgacttagattgttaaaacataaatgtctcatgacttacagatgtttcttggattaacagaatggctgaccgggaagaataaccaaatttattaccggaccattccccaaagggaagcagccagtactagaatgaaaaaaaatggaccaaggatccaacccattctttaataaggaaggaaccttgaaaaggaatccgaagggaacccaccagggccccttgaaagggaatgtgaagggaaccaagaagaagaagctagtggaagtcaacccttccttggacaaaagaggcacgcgggcaacgaagtgcagcgaaaaagcttgaaggtcggcacatcataacggaagtggaagaagatggacgtcctagtgccccggccgaagctgccaagaactatgtacgtcacaacggttgggttgtgcgggataacgtgcctatcagtacggtgtactggcgaaaaacaagggcacgcggagatcatgagagctttgtcctagattcggaaaaagagatgctgtggaccacaatgctcgagacattcacccttcctgcgggtacagaggacaaagtgaaaaggtggactctgaagaaaatggcaaaacagtttcagagcttcaagggagatctgtaccagaagtatatcctgaaggggcagacacccgaacttcgacacattccccaagctaagggatcactgggacgagttcttgtatataaga

SEQ ID NO: 87078 - DNA, 591 bp, Oryza sativa
gttccttgtcagctgataaattctgtgggcttagcactcagcatgttgttttacccgtgcatatatgagttataccttccattatgatcattatttaatcagctgtttaactgttggttttcttcttcagtaaaaccggtaagggtgatgcccttttgttcttcagtctccaccccgatcgcacaccagattttgcaagcttgcacggaggtggccggttcattaaagttcaaagttgttcgccacttaatggatccatgtgaggtccttcgacatttctgtcaagcagggagcttccactgacgggtgcgaggatgagaacgtcctctgcccccagtgggctgcagtaggggagtgtgccaagaatccgaactacatggtgggtaccaatgaagcacctggcttctgccggaagagctgcaatgtgtgtgcacagtaagttactgatccacccttgtgatacatagcagcacgccctcgataattgttgccgcggtaccgggtgtatataggactgagcatagcatgtgtaacctggaaggagttaagatgtactaagatccatttcgcctatatgcacctagaaaaggg

SEQ ID NO: 87079 - DNA, 589 bp, Oryza sativa
  unsure (1)..(589): unsure at all n locations
ctcctcaccgagccaccagttttagcctcaccacacccgcaggagccgttgttactatatgtatcagccacctcncaggttgtgagcacagtattggtcgttgagcgtgaggaagaaagccacgtccagaaagtccagcgaccgatctactttgtcagcgaggttctagccgactccaaaacaagatatcctcaggttcagaagctgttatatggtattctgattactacagcaggaaattatctcactacttccaaggtcacttggtaacggtggtcacatcgtttccgctcggcgatatactgcacaaccgcgaagcaaacggacggattgctaaatgggctttggagttgatgtctttggacatatccttcaagccccgaacttcaatcaagtcccaagcattagccgacttcgtcgccgaatggaccgagtgccaggaggatatccccgcagaaaagatggagcactggaccatgcattttgacgggtcaaaaaggctttcgggcactggagcggaagtggttttaatttccccagctggagaaagattaagttatgtgctttggatacatttttccgcatccca

SEQ ID NO: 87080 - DNA, 1339 bp, Oryza sativa
ccaagccttgctaggcccgactgtagagtacggaggaagggtgttggccggttctagtgtggaaggcgcatcacctgctcgaagcgggtagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctacatcccaccgcttcgctgggtcacggtcgtctgccgctgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggcattgcgcgcctgcttgttgttccttcaccaggtggtcgcctaccatcacttgcctggccagatggactagcatctgcgccgcttggaacttctgcattcttcgggcatttcttgtaagtatggccgcgcagatcacacttgctgcagtgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatg

SEQ ID NO: 87081 - DNA, 1024 bp, Oryza sativa
taatagtgtgttgttaatgtgtttaacctcataatctgatttatccttaccatttcaggtaggaaatgctgcttatcacaacgacatgctatatgaagaacttagacggtccattcctcaactcaccaagctacttcttgcacctgaggaggataaaaccaagggcaatgctgcaggagcgttgagtaacctagtgaggaactctaacatactctgtgaagatattgtctcccagggcgcaattcaggtttgccaactgttgcttactgctcatgctcatgcatcttattctcaatacaggtccacaatttttatcgttgttaagttgtacagcaagggaaacgacttgcagttatcgtgggtgaatgaatgaagctactaaatgaaatcagccgcaaatgcaaaattactgtgctgagtcagtggtagtattatcttaatgatgcattttagagaaactaaacatgatgcaggaacatgcatcaaatgaatggcattttatacaattggatggcttgacaaaaaacataacctacacccatttttctgctatcatcaaccttggcctatctgaacatactctttcatcccctgacctgttgctatgcaggccctgctgaagatggtcagtagctactccaccgtggctctgagccccagcaggaaagacgtgctaacagaatctccgctgaagatcgtgctcttcgcgctgcgcaagatgtgcgaccacgccgcctgccggctcttcctccgatcgtcggagctgctcccggtcatcgtgcacctgaggcaatcgccggatccagccatctctgagtatgcttctgccatcgcgaccaaggcttgccagccttgagcctttgacatccctggttcctcccggccgtggcgggggcatgatcatgccgccgcaatgcgaatctgaaatctttgtaatgtcctggaattgtaatgtagtacagtatatcacggatcaactatttgtatatatatgacttgatccatataattacccgacatatga

SEQ ID NO: 87082 - DNA, 4608 bp, Oryza sativa
atttgcattacttgttttgtagcaggtgtccttgcagaagcaatgtttatgtgcagtggtgtttgagggctactttgctcattgtttatttgtggttgctgcaaggatgaaattgtccaataaggagcatacccaaaaaagggttgatgtttgaaaaaaaaagacaagtaaaaaaaatcagaggttattaccgcacgttgttcaaccatatcgatgttatctgatggttcctcttcatataagaattctgcaaagtcatcttggtactcgttttcatcacagtgttgtccctcaagcctcctattccccatgtttgcagtgaagtttgctaacaaaaaatcatccacataaaaaataaaaaaaaagtaacaagaaaaaacatctaacatgattgtgcaaatataaatttggctagataatctttttattctttctagacattttgattccccccctctgattgttactatttacgtctataaaataaattaattatagtacaaaaaaataattttatgtgtatagagaaaaagggtcaaagttgtacctgataaatgttgaactccatctttattgtttatgcatgttttgggtgtgtgcatgtacctctccccctgcatcacctgcatgctgctatgttcaatgtccatgatgtttgtacctgatgttgtttgggacaagaagtgcccaaggctggcacttttgtttgcttttgatttatcatcaaaatgatataagcattcaaatttgggttgctgtgtgtgagttacatgagaagaaattaaaaagttacaaatcaggatagataaaaaaaataaggtacattttttgtacattaaagtgcaacacagatataaaaaaaatgtaagtttatcagtcaatcaatgctgcaaatatttacaggattaaaataaaaaataataaaacaaatcagtaaacagtactggtagaaaaaaaagtgacaaaccaaaattttattacatgtggagtttagattttgttcttgatgtgtataagataagatgacactgtaaattaaaagatgacccaaaaaaataaaagtgatttagaaaacacctctatgcttctatgctctagtttcatctgttctctaaaatttgaactctacataggcacaacagtctatcgttttgtgtatagaggtgttttctaaaacaatgtctatccgcttctaaaaaattcatccacacatatataatatgtacaaaacaaaaatatggaccagtgtacaatgcaaaacaaacattatataaaaaaaatagaggcgtataatacacaaaaaaaagagaaagtgagaaaaaaagcagtttgttgctcacaaaacaaacactaaaaaaactaagaaatactagtgctttaaaatgcatgatatatgtttgatacatttgtgctcttgtgtggaatgttgtctgattcatcttgtgtaggatcttggctcttatgatcttctgaagagtttgaataattcacaagaatgaacttcgtcttatcctaaaaatattaaaagagcataataaaaaaagatataaattgattaaaatcgttgaaacaaaaatggaacaaaaaaaatatattaccattgtgtgacctgttatgtcttcaatatcatatggaccctctatatcgataacaaactctgtagagttgctttcaagatccttagtgggctgcaccttttttgcaaaaaaaagaaagacatatgtagtgaaaaagccaggaggaaaaagtataaatggtttgaaatttatattatgcaaacagtttttgtatataatgatatgacataaaaaagtaaatagtgtttttacctgtttccttactgctttgcgaatcttttggtcagaagaattttttttcgatgggctaattgatacaaccgacaaaggggatgctgaatgtaatctcttagctctagtcctggatgccacagagttgtttgattgctgactacaaacaaagtccttactggatgcttttttatctggaaaatgattgttttagagtgaaattatgctaaacaagacattgcttaagcgtgctaaacaaaagatacaaacataccagaaaagaaactggaaaaaaaatgaacaaaacaagataatgctatagtacaaaattgaataaaaaaaacttgcatgctgtgtttctttgcaagcgttgtccttgttgctgtttgactttgagttttcttgttcagttggttttgatggtggtgtggtttgtagttgggaacatgtaacattctctgaaaaaaagtttgtttcagaaaaaaagtattgctgtcaaaacagatattaaaagaaaaacagctaccagtaagacaacataaaaaaatggagtagatggtgtgcagtgagattatattttcagattcaaaaattttcagcttgcaaaagctatggaccgtggcatagctgaatcctggagcatattacagcttaaaaaattggtgataaaaaataaaactaatcagtgtgatccatgggtagcctactggaacaaaagaacaagatttatatgggtagcctactggaacaaaagaacaagatttatgtgaaaaagattgaatgaacaacatatagttgttcgctttgaaaaaaattaattgagcaatagactaatagggctctgtatgaacatcataatatatcttctatatttgtgaaatacaaaacatatatttgggcctggtaacttatggttctaataacattgagtactgacacagaactaggctatgcttaatcctgttccagattttaaagaaagtatacatgcccagtaaaaaaaaatgctatagtccagaatgaacattttttttggactggatatattggtgttggtggtagggaaattttgcttagcattggcacaaattatttgaatctgttgggtttgtgtgctatttgtctaaaaagaaaaatttacaaactaacagaataataacatatacctgtagggggtgctcctttgctagtgctggtgttgttgatgttagactttgttttatgctctgcagttgattttgtttgtggtgtcttgggtagttgggaacagacatcagtgttgttttggtttttttgttctaggggtggggcattaccattatgtgctacattgctggcaccctgcttgcttccccccttgctcttctcttctccactcttctcttcccttgttgtggtgctatctttttgtgtgaataggcttgcttttgacatgtagacgcaatccaaaaccttggcagctagttgtgcattttttttcatatgttgtgtcagaatgttctcttgtgaaccacttgcaagctgtggaaatgtcatcaatgagctgcatttaaaaaaaaacacaaataggagtgagtgtattggagcatgcatatacaaaactaagaaaacaatttttttaaaaaaacagagcatttggaggagcaaaagaattacccttgggttaaatgatttgctatggtattgctggagagcatcgctgcatgacatgttgctattgttgccctgttgcttaatgcagcgggcccctgaacatattgcgtcataacttaatttctccattgctttgatctgagaaaataaacaaagtatgatctaagaaaaaaaagaaacaaattgacacaataaaatttttctgttgattttacttactagtcgctttccaaaatctcctgttttgcattcatccatttttgaatactcttttatcattccgcctttccaaacagagattcttggtggtggaccaattggaatacttctaattccaaaatctttgaaatcaagatatttaatctaaggaaacaacccaaaagaaaaagaataagtcaatgtttagaaatattatgggtataaaaaatgacttaagtaataaaaaagagatgcatacagcaagtaagtgtccgcagccgccaagggtttttgatgtttgttcctttgatttactctccttttggaacttggctatgtatgtcataagccattcataaacaaactttgaccagttccactttgagctggacttgacatcaatcagaggttcgaggtattttgggctagggtgagtgtctaagttggggcaaagaaaggttgatagtgcaaccaccatgaaacaacgtaggacatcatcttctgatagtttgttcacacccttgtcgctaagcaacttagtgccaaagaaggaaattaagggttttgtgctcccataatgctgatgaaaaaaatgttttcctacatcattgtcatgcttgatcgctaaacctccatttgggataccaagtatgaagttggtggtgtttggattgattggtatggatctcccattgacaactatatctgagcagctaaagtcagtgtgactagctatccatttgacaaaagatagtagtatagcacacctttgaaagtttagaagtgaaccaaaagcagatttctcaataattgtcctttgctcgttgctgagcccttcaatcaaattggaaaagtatgtgatgtttagtctgcttcttggttttggggactctgcacttccagaatgatcttggtcatattcaagttttgtgcgctggaagaaaaaaaa

SEQ ID NO: 87083 - DNA, 693 bp, Oryza sativa
gttggtggccccaaaggaggacaacatggagacgatcgtcgcccaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaac

SEQ ID NO: 87084 - DNA, 554 bp, Oryza sativa
  unsure (1)..(554): unsure at all n locations
ggagttcatcaacgtcgccatgagcatggaccctgagtggaagatggtaaatttctcgtcttacatgaggggaaacagctgatgttatgttatagtcccatttctgctgatcagaatgtgttgacaatttatttgtgtgcacgcagtacaatgctgatcttggtcgcatcgagaagtgggttatgaggaaggcgttcgacgacgaggagcatccttacctgccgaaggtagaaatggcagttcttttttgtttcttcagatgcaatggtaattttgtccgtgttctgaactaatacttctgaaattctccacagcacatactgtacannnnnnnnnnnnnnnnnnnnnnnnnnnnnnnnnnnnnnnnnnnnnntggcctgaaggctttcaccgagcagcaggtactaattaccgaccatttccctgtgtcctgtcctataaatcgcctaattaaattgacccccgtttactctgtcatttcttcaggtcagtgatgaaatgatgaagaacgctgccaaagtgtacccgcacaacacgcccgtcaacaaggaggc

SEQ ID NO: 87085 - DNA, 593 bp, Oryza sativa
  unsure (1)..(593): unsure at all n locations
cagcacacggttccaaattagtactagtacaagtgtagtagtactacactgtactgtacaacgcttgaatacacatcagtcacctgcgggaagagcctctcaaatatcatgcggtagtagtacgcctccttgttgacgggcgtgttgtgcgggtacactttggcagcgttcttcatcatttcatcactgacctgaagaaatgacagagtaaacgggggtcaatttaattaggcgatttataggacaggacacagggaaatggtcggtaattagtacctgctgctcggtgaaagccttcaggccannnnnnnnnnnnnnnnnnnnnnnnnnnnnnnnnnnnnnnnnnnnnntgtacagtatgtgctgtggagaatttcagaagtattagttcagaacacggacaaaattaccattgcatctgaagaaacaaaaaagaactgccatttctaccttcggcaggtaaggatgctcctcgtcgtcgaacgccttcctcataacccacttctcgatgcgaccaagatcagcattgtactgcgtgcacacaaataaattgtcaacacattctgatcagcagaaatgggactataacataa

SEQ ID NO: 87086 - DNA, 564 bp, Oryza sativa
  unsure (1)..(564): unsure at all n locations
gcccccaacaaggaagagttccacaaggagacctgccgcaaggtagcaaccgctgacactacaaccgcgactaacagaagctgttgctgaaattcctttctgatgctggcacgaaactgtctctgaattttctgactctgatgtacgtgcaacgcaggtgaaagcacttcatcannnnnnnnnnnnnnnnnnnnnnnnnnnnnnnnnnnnnnnnnnnnnnnnnnnnnnnnnnnnnnnnnnnnnnnnggagttcatcaacgtcgccatgagcatggaccctgagtggaagatggtaaatttctcgtcttacatgaggggaaacagctgatgttatgttatagtcccatttctgctgatcagaatgtgttgacaatttatttgtgtgcacgcagtacaatgctgatcttggtcgcatcgagaagtgggttatgaggaaggcgttcgacgacgaggagcatccttacctgccgaaggtagaaatggcagttcttttttgtttcttcagatgcaatggtaattttgtccgtgttctgaactaatacttctgaaattctccacagcaca

SEQ ID NO: 87087 - DNA, 671 bp, Oryza sativa
cccgcgcccactccgcccgtaccgcacgcccacgtcgccgccctctccccgcatctcacggcccgtgcgcgcgctcgagagggcgggattcgatttgaatactctccccctctctctcctcctccacctctccacgtcgtcgccgcggaaccgccgctcccggccacgtccggcctccccacctctatataaccgaccaccgcgcctctctccacctttttccctcttttgccgtccgctcccgagctccctatcgccctagcaccgtgcgcccacccgccgccgccatctccaccgctccggccgcctctagcagccgctagggtcgccgccgcaccccgccatcggcaccgccgcgtccgccatcccgaggtccacctcgtccgctgttctcccgtccaattccatcgccggagctcgcatctcctcgcactccggtgagcttccaccattgccgccgccttcgatcggttatgtcgtgcgccatggaccacctccctctctctaacccctcccaaccttttctctaggtcctcccggagcccgtcgccgtcatcctcccgtctctcgtcgttgccgttcgccgtcgctcctccctcgcgccggccgagcccctcggtgaggatcggtctccccctctcttcctctctctccctttgccgcgccgcccg

SEQ ID NO: 87088 - DNA, 689 bp, Oryza sativa
gtggatccatcaaatgtggaatcagttacaaagtggaccccaccaaagatagtttctcagatccggagttttcttggacttgcgggctattaccgtcggttcatcgaaaatttctccaagattgccaggcccatgacacagttgctaaagaaagatgaaaaattcaagtggtcagctgagtgcaaccaaagttttgaagaactcaagaagaggttagtctctgcaccagttataattctgccagatcagacaaaagacttccaagtctactgtgatgcatctcgccaaggattgggatgtgtgttgatgcaagaaggcagagtggtcgcatatgcttcgcgacagttgcgtccacatgagaccaattatcccactcatgaccttgagttggcagcagtggttcatgctctgaaaatctggcggcactatcttattggcaaccgctgtgaagtttacactgatcataagagcctgaagtacatcttcacccagcccgacttaaatctccggcaacgaagatggctggagttgattaaagattatgacatggggatacactatcatccaggcaaagcaaatgtggtagcagatgctctgagcagaaagagctattgcaatgcagtatgtaccgaaggcatgtgtgacaaattgcagcaagatcttgagcacctaaatttgggcatcgtaga

SEQ ID NO: 87089 - DNA, 810 bp, Oryza sativa
gtttgtgttctacgcagtagactagaatacctgaacaaaaagaattattggcatgcgtggtgctgaagaaagagaatttcagactacgaacaatagagacagattctctagcagcacatgagatgcccatacatgacatcctttgcgattccattttatgtaccaaatactaattaaaaattgaatgctaattagtcttttagacttttcattgaatcaatttttatagttaacaaggaaaatcttaccaagccaccagagaagaacaagactgaaaagtccgaggtagccaaacagtttttggacatcaaccttttctccttcctctccagcaaacttttttagaagcactaaaataatgttgaaacaattagcagttgaatcaagacagatcaactaaaggaagcaaagaactaaccagtgaataaaccatatgacatagctgacagaagaccaaacatgtcacctagaagagttctctgagtggcactgcattcataaagtttacagattagctgcagaacttgtggccaacaaagtgagtgctgtctcaaagttacaaaatcatcttcaacatgatcttcagttacaaggccatcttaaaaatggaataaatagcgcttttatgtttttttatgcacttatatttatatgaaaagcaattcagttgcagcaaccaatctactacaagcaagcaaatgcaagggctttatgagcatagcaaattaatcacaaacaattttatatgtcctgaggcatcagtgcagaactgtgatgtttatttaagggtaaaacgcactaacccagaat

SEQ ID NO: 87090 - DNA, 704 bp, Oryza sativa
gtgggccttccaccctgatcgtctgtcagcaccgtccctatcacccgagtaacttcgacaacgactacaacggtggcagtcacaacaacagtaagcagcacaaccacaactcgactccacccccactaatggcaccagctcagtcagatccgccagctgtgtcagttcagtcagaacaacccaagaagggggctgtaggaaagccaggaccctgcttcaactgtggcaagcacggccattttgctggcaagtgtccgaagctgaatcgcactggacccaggttcatccaggcccgcgccaatcatgtgtctgcagaggaagcacaggcagcaccagaggtcgtgttgggcacgtttccagtgaactcatatccagcaacagttctctttgattcaggtgcctcgcattctttcatttccaaaagatttgctgggacacatggattatcgatagtagaacttaaaataccgatgcaggttcatacccctggaaatgatatgaggacagcacactactgcccctcggtgactatagagatcaaaagatcaccgtttctatccaacctcatccttctcgaatctaaagacctggatgtcattcttggaatggattggttgaccagaaacaagggagtgattgactgcgcaagccgcaccatcaccctaaccaacgacaaggggagaagaacaccttccgttcccagc

SEQ ID NO: 87091 - DNA, 793 bp, Oryza sativa
ccatccatctatatctatctggcccagctacgtacggtacatgcaatgcaaagccatgaagcatcttttctccctgatcgatcgtccactggtccatcaggtattcaggtgaattgcaggtatatacttatgaacacacgatacggccgacgggttgctacggtgtcccttctttccatctcttcagggttcagactacttcagaaattagctcttcaggtttttaagcagctgggacgtcgtcagtactgcagtacagtgacaatgtgtacagattggttggtcgatcacttaattggttgcttagcttaaatgatgtgctcagatcatcagcaggggtactgtacaattgcatatcgccttgcagaaggaaataaattagtaaacgtcaagatgcattaatatataccttgatatcagcatatatatttattatgtcatgttagtgtcaatcagcgagtaattaacgcgttaagcgtacaatactggtgtacatggcgtgtgcgatagcacacatacgtagccatcaaactcactcaccattaagagtaatcgagcagtagtaattacaagtatacgtactgctaattaatcgctcagagcaggcaaacgatgttgatacgtgtggccgccggccgacgcgtttgcagaagatccggggcggatcagacgcttgcgtgggggaaacaagaaggtgttttgcttgcttggggttcggatcatctgcgccgcgtcgaacgccggacgcgccgtgcggccacacgcggcggcggctgtcgtcgccgtcgccggg

SEQ ID NO: 87092 - DNA, 773 bp, Oryza sativa
cctcgcgtcctgcgtccaccaccaccacctccgtggcgccaccgtcctcgagctcggcgccggcacgggcctcccgggcatcgccgccgtcgcctgcctcggcgccgcgcgctgcgtgctcaccgacgtgcgcccgctcctccccggcctcagggccaacgccgacgccaacgggctcaccgccgagcaggcggacgtgcgtgagctccggtggggtgggcacctcgagcccgaggtccaggtggacgtggtgctcatgtccgacgtgttctacgacccggacgacatgccggcgatggcggacacgctgcatgggctatggcgagacggcgacagcgacagcgacggcggcggcacggtggggtgggcggcgagcgaggcgcgcgacggcgtgcaggactgtatcgacgtgctgcgagagcaaggcttcgaggtggtcgaggtagacagggtcactaggccgctgctgcgcgaccccgagcaggccgccgacttcgccgtctatcgtctttttcgccggacaacttcgccgtccatcgtctccaatccaacgccgataactacagccgggtgttgactttcactctgtaacagtaaagccaagcttgtaacggcaccagaatcacctttgaccttttattttccaaaaggccattttgtacgtactttcttctcggttgcaggacttgtaaatgttccacaatgagtcaaggggacaaagacatagcaataatatatgcaagtctactgtaggaagctacagtagtatacat

SEQ ID NO: 87093 - DNA, 520 bp, Oryza sativa
tttgggtgccatcatcgatactatcgtcgacaccttggtgaatgatgttgacattgcacgcttggtttgagtggtcactaatggggcatggagcatggttgttggtggtatcatcatcattagtattgctaatgttgttgtctgcattgtgtccatcttcttggggcggaaactcttgatgtgcaacagaagatccgatgatctgaagtggctcagtgcgctgtctttggttaccacatgaagatactgggatgctgacaatcctcctcttacagttcttcatccgattatgctcactttcgagttgtatggctttgtccacaagtttctcaaaatcttcatattcctctaggagtagttgcactgcgatctcatcttttaacgcctggagaaacttctcttgtttgtcttcatcattttccacatcttccggtgcatagtgagccaaacgatggaactcgtgcaggtactctgtgacggtcaaatcttcttgattcaggtagcggaactctcgttttct

SEQ ID NO: 87094 - DNA, 2707 bp, Oryza sativa
acatttttgctggatccccaccaatgtaaggtacaaaagaaattattgcatagatgattattacatgtacttgtgtgcttcaacttgtttccttttactcagagcttaataaccaatcaaacatcattgtacatataattttagtgtcgtcactaactcaagtccactgaactcatccgatatggaatacaaaattcttatatacaaacattcttcagagaaagccgaatctctttcaggaaaaaagtggactacaaactagcccatagagctacaattcgaaaaaaaaggaacaggatttccccatttaatgtgttactgaaagaaaatattttgccttaaaaaatatgacatgcaaatcgcaagctacatttatatatatcagatagaatcttgcattgtactagaggataaccgcaagaataaaattcagttctcaaaaacagggtacgagagatacaacattttttagtaaagataagtttgcatttaattttggctgaaagattttcattgtttgagttcaagggctccttgtgatcatgccaccttggggcttgggcagataaacacaggcacatggtatgtggccattgagttgtgaacgacaacctgatcgttctaactatatacaatgtactttagcactaacccggtccaccgtgcccctactattgtgtaagctaacctatggaaactcaagaaatcaaacaaaaaatgacgctctaacaaaagacgatgacagcaacaaaaggtagcctttttcaagaaattggttacgggttaaacatactccggcgggtacgcttcttgtagaggatgcgatagccacattcacggcactggatcacatctcctggcttcagtgtgttctcagctccgcaatctgaagacaaagaaaatcacatttgatatcaaaatttgacaactgaaccgaattcaactagccataatccaatccaaccgatggagagagaaaccatcaccccaaaataaaaactgggaacagaaaaaaaacatcccatcccatcgtgcgatggagctccaagcttcgacggcgttttaactgctgagtcgtaagccaccccccccccccttccccctgatccggtgcacggaggggctacagccatcttcaatcatcaattacatcatggaacaagaaacttgcgttctccctccgacgcccgtgtttctaattctccaacacaaatcttctccccgggccaaaaaaaaagaaagaaaaaaccactgcggcaaatcggccaaaccctaaccggcgatgcgagaggtgaaggatagaaggaatgacctccacagagatagctgacgggctcaggttgttgcggatccatcggacgcagcggcgctggtggagcgcggcggtcggccggaggcggcgcgaggcaagacgacggctgcaggcgccgggcgggagaggaggcggcggcgcgcgcggctagggtttcgacgacgacgacgactcttgtcaagcgagacgaggttggtggtggtggagaataaatcgattctattgcctttattttgggccgagccatgtcaagaccggcctaactgggcccgttaggcccgttatatgggccggcctaacgccgcaagcagcgtgcgagacaggcgacaggctgtcaaaggaataagttcatccgaggtcccttacttgtcaacatatccgattttcgtccttcaaccggaaaaccagatacaatgggtctctcaactatcaaaaccagtgcagatgaggtcccttggcgatttagatagcaattttggctgacatggcacatacgtggctaatttgacacggtcttcatctggcgtggtgcttacgtggcaattcaatccggaaaaataatataacctgtgggacccacatatcagtttcacacacaaaaataaaaaaaaaagtgggacccatgtgggctccacatgtcatcctcccagccatcctcttcttcctcctctctccatctctctcaccctctcctctctactcgctggcggacataacgacggcctggagaggcgtgacctcctccactcccgccccccgggcctatcgccaacggccactgggaaagaagcggcgcgcgagcgtcagccaaagggaggagaggagcggcgcgtgcgctcggccaacggaaggagaggagctgcgggcggaggccgaggggagcgggagaaatccgcgatgcgctccgcatccacatgctctctcacggtgccccgtgcccccccgcttcacaacctaccttgtcacgtgcgtcaaccaccgtctcccgcactcgccaccaacgcctcctcatcctcgagggtgatggtggggtcgagaggctcctcgacctcctcgacgcggctgacaccggcctcgatgcacatgctgcacttgagcacgagaacaatgtgggtcgttgaggccgtagagatggacgcggagcgcggcggtggcggcggagaggggacgcgcggcgctggtgtggcggaggcagggcgcgaggaaggaggagaggctgcagtccgcggcagcatcgaggatgcggagcttgatctcgacctccatcacgggggtggggaggataggggaggctaggatttggggttgcgattgggattggtagggaggccgatgcagtgggacttggagtgcgcggcaccaggcagtgggtggagaagggggttggagttggag

SEQ ID NO: 87095 - DNA, 2298 bp, Oryza sativa
tgaaacagagaaagtatatgttagctaaacttctttcagaagaagaaatcaaatagaagcgataataacacaaaatactacatatgatggctaatagtaaacactgggaaaaacttatgattcgggaaaaatcgaaggcaataatacgctcaaatcctacatcaccaacttttataactttttggactacatgaggatacttctgttactctagttgaatttagggctgaggacatatcccacgagacaaacgcacagggctggtcctgactttttaggtgtcgatgcgaaactaaacatagaggcctttatcatactatataataataatcgatagatacatatactttatacatatgaattattgtcgtaaatatttaaattgcatttagaaataatatttatatagaaaacattgtacatgttacctcaaaaaaatttctaacatttctagatgcgaagtcattgataatggtaccaatattaatttcatccaataatttcttctcaatgcataaagctgccaaaccatttgacctttttttttgtacaatgaatatctcaaatagttcttcaataatttcaacttcgaaaagcttctttcagtagatgccacagtcacgagcacagtaaataagatccgataagcaatagaaatattagggtaacaatttgcatctctgacaaactcaaatatctccatggcagacatatggctatctggcaaagtcaactgcataacacttaactcagaaattagatcattttaactcaacatcagatgaaccccctagagagattattatttttattatttttttgcaaatttagtgcaactgtcttttagttcagcaccatctaatgacttcaagaccgtggaactcataaaatccccaatatacttttgaattcttgaagttcttcaaatctagctttcaatgaagtgattgccataccaaccataaaaaaaagtaatcaactttgaaagccctctcagcttgcaaatttacttcatcactcacaattgcatcaaactgtctctttctggttgcatgacactttactggaaatgatgcatttacacccaattgagatgcaatatctttggctttgatcaaactagaagcaaacccctcatttctatacttgtgaaagtaagtcattatgccttctatttgctgtaaggtggacttaatgcacaagatggtgactgcaacttcttactcacagtgtttacaacaaataaaatgtcacgccaaataatcataccaagtataaactaagtaccaactacctcaaataatttcttttgcatcactcctatctttgggttcgataccattagattcccttaactgtaacaaaactaatcttagcttatgagcttgatatctagttgctttaatacttttgatttgactctcccatcgagtattgcacaatggtttcactgttaaacttggaacatgttcaagcaaaactttccatctttttgttgaaccggaaactaacacatatatctgttgcacaattccaaaaaatgaaatagctttagcacaagatttagccatatcagagagagtaagattaagactatggcaaacacatggcatatacaaagctcttggattaatatcaagcaattgtctttgcacccccttttattttcctttcatgttagagccattatcatagccttgacctctaatatcatcaatactaagaccaaaggacttgatggaatcaaccaatacattgaaaagctctgaatcagatgtatcatccaccttcaaaaaacccataaaatactcctctaattttattttgccataggacatattaacacatcggaccaacaaagtcatttgttcttgatgactcacatttggggtggaatcaatgataatagaaaatattttgcctctatgatagattttgtgatattagaagccaagagagaaaaccaactcattctgtattttgtgactaagataataatgataatgtatctcgttgttctgaatacgtctaagatgatcttgcatcaccaagtcaaactctgcaaccatctcagcactagctaagaaattgccattctgatcattgtaaagttgctcattggatcctttaaaagccaaattatgtttactaagaaatttgacaatagcaattattcttataaaacttatcgtatacgttttttctccttagcaattaatgttgcaaatctttgtcaattgtttcatttttttatcaatctagctcttaattcatccaagaggtcatgttggtgatatg

SEQ ID NO: 87096 - DNA, 3376 bp, Oryza sativa
cgcgtccgccggagcatgcttcgccctcggcggcggcggcggctttccgcggccgcgacagcgagtcggcagatgcagcagggctatctgagccaaccacgggtggaatgcggtattccctgataaacccacgaatctgattaccagactaggttttgttgttgttagtgtagtttgcgatctatttgaggggcgatgatttctttctaagttgggatatactgaggtgaaataggcgttattcgtgctttcagaatgggcaggattgggatcaggtggtcacttggttgaaattgccttgatagttttcccttcatttcgattcgatttgggtatatgctagtaatactgtaaatctgtaatagtaagctacgacggcatgtaggcgacttattcttgtcaataatcagttctattttcaaaaatgtgtcagtaataaggttgataggatatgaatcagtagccaacaagacattccaatcacaatcatagtagttgtatcgacgaacagaatcaatcaatcacaatgtattttcagagttgcagcgtatagggcagaggtgaaattatcggtgcttgttttgtcatgtaaatgttttttcaacgtcttaacctctgaattaaggtgctctttctttttttctcaggtgattttgaattttgtctaccttggcattggagcaggatttgtttcaactcttcgtaagtggctttccaatgcaacgaaattaggacatcttaatatccactgttggacggaaaccatctctttttggattacgaatttgatgaataataggtgtagtaatgtacttgtgtttctgtattgatactacagtagtgatgttcatatcgttttaaggctactactagaaacaaaatttcctgatatattggctatgttttggtagaggtatcatgttggacaatcactggagaaaggcaggctgcacgaatcagggcattgtatctcaaggcaatacttagacaggacattgccttttttgacaaggaaatgagcactggacaagtggttgagaggatgtcaggggacacattcctcattcaagatgccattggagaaaaggtagtttgttttatctagtgtaaagagtgtgctttggattgagagaacacaaatacaactccctttctgcaatgcattgctagatacttaccagtaagtgcatcattagatgcaacagatctctatggttcatatggaaaatcttgctccaaatgattcttttgttgcacccacccacccacctgaacacaaactcaaagccagctctaaaaaataagaggtaactgaaaaaagaggacatgggggttcaaactcacagaaaaacaatttactttatttaaatttatctaattcattgcatacatggtttgaggtaataactcagtttagtagtcaatgttagctacatgaatacacccatacatcataccccacagtacagaaatatgagtttgagctccattctaatgtatgatatatttaattatttaatccttggctgtatgcaagtttgacagttattgagtcacactgtattcacatggatcaatatcaataatgtatgtaccatatttcttgtgaaataccttttcattgaagttagcagatcataaatggagattgattcaatcaatacgaattgtggatctataacatggactcatcctcagattttgcaaaatataatgaactatcgattttaaataataaataaatatgtactcctttttgtatagtataagcatctagcaaaatctaactagcactacatattcgtttaacacatcctttttacttagagtggcaagtgtatacaactcctttctaccttctttggaggcttcattattgcatttgtgagaggatggctcttggcacttgtgctgctctcatgcattcctccaattgcggtggccggtgcttttgtgtcaaggttgatgacaagaatctcaacccgcatgcaagaaaagtatggtgatgctggaaacattgctgaacagactattggggccattagaaccgtgagtgctagcagtacagtagataattaatatctgagtcagctatttcctgttcctaccaagttaatcagtttgttttttcttaattggcacattctatgaaggttgcttcattcaatggcgagaagcaagctataaacacatataacaaattcataagaaaagcttatgaatctactctacaagaaggtgttgttaatggccttggattaggtaccgtaatggcaatcttgttttgcagttatggtttggcagtttggtatggatcgaaactgatagtcaaccgtggatacaatggtggcatagttataaatgttctaatgtctgtcatgatgggtgcaatgtaagtttcatatattaaccctgctcccatgaatagttaagataagattaaaacttgttacagaatttacttgttagtgtagattatgggaaggtgggtacatgtcaggtggttattacgagcattgtaggcttgcatttacattttgtaaggagtttacaggtagatggaccattttgtttcttgagtttacataacactatacatgctaaaatatacaccggaaaagaacagaacatctgataaaacttaaaggttaatgaataattagccatatttctctgtcaatgtacctctctgtgtatcccatttgttgaaatgcaaaatatgttctttactactcccaggacaacatgggccatgacttactgagttattacagcaatcagagtttccaatagcagtgaaactagtcatattaacatgtgaaataaattatttccatgtcactgtcatttttcaggtcatctggttcctgatttggcttatatgtcttctgtaggtccttaggtcaggcaacaccatcaataacagcttttgcagaaggtcaaggagcagcatatagaatgtttaagacaatcaaaagacagccagatattgatgtatgtgataccaaaggtatcatattggaagacatcacgggtgatgttgaactgaaggatgtgtacttcagctatcctaccaggccggaatatttggtattcaatggattctccttgcaaataccaagtggcagaacaatggccctagttggagagagtggcagtggaaagtcaactgtgatcagcttggtggagagattttatgatccacagtctggggaagtcttgattgatggaattgacattagaagaatgaatctgggatggatacgaggaaaaatcagtcttgttagccaagaaccagtgttgttctcaagtacaatcagggaaaacatcgcctatgggaaggaggatcaaactcttgaagagatcaagagagcag

SEQ ID NO: 87097 - DNA, 1148 bp, Oryza sativa
atatcttcttgttctttaatgtattcttgggaagcattattgcaggatctgctttagagcagctcaaaacatttcttcaccaatcagcaaatgagtatgtcctctttgtctaccccacaagctgcaccttcaatccattatcctgtatgcttgcaatttatatatgtcctgataccacaatttaatttaattttacaagccatcctatctctctgattgagctcaactaaaccatagaacatcaccaaccatagatagaagtgtacaataaattatgtcaatgtgttgatatttttttcctttgttttgttcatagaggtagttgacaaaacaaaaaaatattgactatgccaaactgatagttgcattcttttgctagttacaatatagatgtgtctcaagccttaaaagttttgcacgacatgagacagcaggcaattctattggctgttacctatgacatagatggcagttgcaatttatttacatgagccagctgtagttaaagaagagagtgagggagggagtagcaccaaccattctagagcgcatatacatgggtgttttttgttcattcagaactaaacatgaaccgtgaaaaaagtggcacgaaggtgcacattcatcatatcatttactaataaggaaacttgctttgtcactgacgtttgcctattgtttttacattgctctgctgccctgcctttcatgctcttcatttgtgctacaatttcctattgtatttcctttctttttcgaagaaactcttatactccttttcaactgtacttatttgcctctttgcagaataccaaggacaattggtgaagcaattccaatgaaagcaaccttttttataacatatgtaatggttgatggttgggctggggtagctggtgaaattttaagattgaaaccattgataatcttccacttgaaaaactttttcttggtcaagactgagaaagacagagaagaagcaatggaccctggaagcattggttttgactcaaatgagcctcaaatacagctctatttcttgctcggacttgtctatgctgtggtgacaccatttttgcttcctttcatattaatattctttgggttagcatatgtggtataccgtcaccaggtaataaccctttgga

SEQ ID NO: 87098 - DNA, 3288 bp, Oryza sativa
tcctgcaccccctgggttggtgatggtgagctcgctctcctgcgatggcatcacgatgcctgcacagctgcctcgcgaccttccactcgccttccgctgctgcggtgctatctggaagcaaaccactagcccgctacactccacccgctgtctgaggccgtgctcgccttccgcccgctgccttgccgccacgctcgcccgtcgccgctctgctgctgccccctacctgcttcgccttccgctcgcttccgatgaaagggaggagcacgacgaggacagggttgctctgcccgccgccgtgctcagccgccgccgctccgcccgccgccgcgaagtggtaggcaatgtgggtggcagcaacgcgcgagtcggcggggggcacgacgtcgaactcgtccgccacgctcgcccgcccgctccgctcgccgcctggtgccgctccaccccccaccgccgcgcggaccttgccgccgcgctcacccgccgcccgcccatcgtcgctccgcccaccggccgccggcctccctcactgaagaagagaagagagaaaagagaagagaaggagaagaaaagagaagaaaaaaagtgcagctgacatatgggctccacgtactttttttaatttcttttgctgactaggatgccacgtcagcgaaactacctatatatactgcaatatgaccttgagtgcatggtttgtatgagtttaatggtacacatttgtttcgtggttaagggatttaaaaaaatctcgttgttaagttgagagacctcggtgaacttattccatccaattaaccccatgaaatatggccagagctatagctagcgaaatgggccgtgctctgtcaggacggcccatgcacgatgtcgttacagcccaggcacgatgctacggcgaaagtgctaatgggcggtcagtcgcgcgcgggagggtgcgcgcgactgaacacgtgtcgcgtgcggagagggggcgcggacggcacgcgcgtggagactggagacgattttttggggttttgttctgtttctgtttggttttttttccggttttcttttggtttctctttcttttcttttttttaaaagatgtacgtttgcaaagtttgtattcgtatgtataccaaattttgtattcgcacgtatacaaagtttgtattcgtgattttttctctcagattttaatatgtacatatacaaagtttatatacacgtacgtaaagtttgtatacgcgtatacaaactttgcatacgtgtatacaaagtttatatatgtgtacgtacgggatgcaagatttgtatacgcgtatacaaagtttgtatttgtacctacgtataaaaacctaaaaaaatacatgtatataaattttgtaaatgtgtagataaactttatatacgtgtatacaaaattggtatacgtaggtataaaaacctaaaaattatatgtgtatacaaactttgtatacatgtatacaaaattggtatacgtacgtataaaaacctaaaaatacacgtattcaaaatttgtatttgtacgtatataaagtttgcatacataagtattaaaaaaagaaaaagatatggaaagaaaaaaatagaaaaaaaacaaaacggaaggtacggaagaaaaactaaaaaaaagagagagagaaacccaaaaaaaaacaaaaaagaaacgaaaaacgcgggcgcccaagagaaacgagaaaaacagaaaacacgggtgctcaagcgacacgttgtccgccgcactagtagttgagagaagagactagagaggttagaactaattgtgcggggcgcaaggagcgcgactgatctcccattagggctcgccatgctacggtacgcagctcggcaaggcacgtttcctgggccgaggccactgcctgtgggctgacacgacaccacacgggtactatagcgggctggcatggcccgacacgacaacggaggggcccggtatggcacgacaagtccatatgctgccgcccgtcatcgccaaacctcgcgcgcctgtcgcctgcgcgattcctttttcttccttttctttttctttttaactttctcgatcaagccgtcgtccacgcgattcaatttttcgctgaagagaactgcggccgcggccgccgcttcaacgcgacggctgccctcccggacgacgtgcgccttcgagcgtcgagggagctccacgtgccaatgacgggccgtgccttggggttggcacgacacggcccgctacgaaaaccgtgctgctggtgggcctgtgccatcctgggccgagctgcccgttcggccaactatagccagagcacagtgcatattaattgcataattaactgttgtagaaagaaaaaaaagtgaaccatggggtatatgatatttgaagggatgaaaatactctcgaaatcggtaacatctcttcgaaaacaatgctagatctgttaaaattgaccatatttatcaatgtaactattaaggcagtgttcgagaggagtggttgggaacccctcctcccgacatataaaacgaagcacatattattgtaggattaattaagtattgattattttttaaaaaaagaattaacataatttttttaaaacaacttccatatagatttttttagcaaaaaacacactgtttagctgtttgaaaagtgtgcacgcgaaaaacgagagaggtgagttggaaaaactaggagaagaacacagcctaagtgccaatatcttactatgctaaaaatttttgaaagatcaaattttataatgcctaaaaattgaaactgaaccacgtatacagaacgaagctcggtttgtctggaattttcgtgaccatatatatcttcattcttagatgagtaaatttcacaacagtacatataatttgttcaaagtatctgtattttttttaaaaaaatttactcgatatttctttgcccgatgtataagtatctacatggtatgtataggtattcaaaataatacatgacggtaaatactacttcctctgtttcataatgtaagtcattctagtatttcccacattcatattaatgttaatgaatcttcatcaatatgaatgtggaaaatgatagaatgacttacattgtgaaacggagggagtagtataccaataatatgatagtggagttgtcggtgacatgggatcaggagtatcatgactagaggtttgaggcagacacaatcgcacacgtggcctggtacccccgagggacgtcgggcccgagggtgatgcgttcgccctcctcttagtccccccgagggg

SEQ ID NO: 87099 - DNA, 3696 bp, Oryza sativa
caattataaaaaatcctaggatcttgttacttgatgaagcaactagtgcattggatatggaatctgagagggtagttcaagatgctttgaatagggtaatgcttgaaaggactacaattattgttgcacatcgcctaagtacagtgaagaatgctgacgtgatttctgttctacagcagggaaagatggttgaacaaggtatggcatttaaaaactttcgaaagagattatcttaaatttcatatcgattagtaacatgttgttcctgcagacagtatgagtacaaacctaatacccactgtgtagtgctcatgatacagggtacttttaaattctcaagttttctacacattttaattggctaattaacacatcttaactagataaatcaaagctgcttctgactactaatcaacagatagacaacaacctatttactttgggtatgtgggttttaaccgtcatactcccttaaagttataggccctctcttttttattcgacatgattcagcacgctacttgatctacaggtttaattttgacttgctggttgtttgtgttattcaattccgagtaggttctcatgtagaactgatgaagaaacctgaaggtgcttatgctcagctgatccagctccaaggggcacagcaggatgctgaaatccataatgacgacactgacatgataataagaagcgattcaggctctaggtctataaatgtaaaaccaagaagccaaagcacctcatttaggagatcaattactaaaggctcctcttttgggcatagtggcaggcatcctatccctgctccccttgactttccagatcccatggaattcaaggatgatctgggcatggaggagactacagacaaagtgcctcgtggccagaagaaagcttcaatcagtcgactgttctatctgaacaaaccagaagcttttgttcttgtacttggttctgtaaccgcggcaatgcatggactcatgtttccaatatttggcatactgatctcaagtgcaataaagatgttttatgagccaccatcagaactcctgaaggactccaggttctgggcaagcatgtttgttgtggtgggagcttctgcatttgttctgattccaaccgagtacttcctgtttggattagcaggtggaaagcttgtggagcgtatacgttcactgacattccgaagtgtcatgcaccaggaaatcaactggtttgacaaacctgaacactctaggtgtgtacacagtctttctctcatcatattattctgccttttgtcctatgatttattctatcaaaattccatgttccagtacttacaccaatgtcatggtgaatactctctagtctactcaaaacaactgaatagcaaagaatttaaaaatattgaacaaaagttttggcatgtaatataatccctactaatctttcacagtcctttgtttctcatcttcccatttgaaaagttcaacacctatgaaatcataatttatgactttccctgaaacaacgttaattttccactggttatgtggtgcaaaaagagtgtttcataaacaaaggcacattggaaaaaagagacaagtgcattttgatgaacagtatatactaggtagcattatccccccaaaatgaccagtactatattaattcaggtggatatttagaatggttttcatgcatgcacacacaggtgcatcatcacattcaccaaatgtgcctccagattgatgcaaacattcagatttcatactaaccatcccatcttctattccttggaataatatccttgcataaatctcaaagtgctttggatggttaagatagtacacgtactatacatatggttttagattttccagatctatacattaaaaagttaagaattgtgctcatcagctagcactatttttctactgttgtccttacgccataagtctcaacatttgttgtagtggatcgattggtgcaaggctgtctgttgatgctctgaatgtgaagcgccttgttggagacaatttggcacttaatgtccagactgtatcaactgtcatatcaggttttacaatagcaatggtggcaaactggaagctggcattgattataacagtggtagttcctttggttggtttccaagcctatgctcaaatgaagtttttgaaaggtttcaacaaaaacgcaaaggtacatacaatggattaatcatgagcattgtgctacccttacagatgctttctcatgcaacacgttgtttgatgttattctttgttgtaatgcagctgaagtatgaagaagcaagtcaagtagcaactgatgcagttggaggcatcagaactgtggcatcattttgtgctgagcagaaagtgatagaagcatatgagaaaaaatgtgaatctccagtaaggcaaggaataagggaaggtgtagttggtggcttgggttttggcttctccttccttgtgttctactttacttatgctctctgcttctatgttggagcaaagtttgttcaccaaggagtggcaacgtttcctgaagtgtttagggtgcgtaaattttcttatccattttacatagcattgacattttgatattttagtcaacttatccagtggctgtcaggtcttctttgttttagttttggctaccagtggaatctcacgaacaagtgcaataggcgcagacagcaccaaggctaatgaatcagctgtttctatcttcgaaatccttgaccggaaatccaagattgattccagcagcgaggagggtgtggtcattgcaagtgtgaggggtgacattgagttccataatgtgtgcttcaattaccccctacgcccaaatattcaaatatttaaagatctctccttgtgcattccctctggaaaggttgctttctatctgaactaagtgaacatatttagtatcattaacacattgctagcttgtgttgatcttaattacattacattatggtttcagactgttgcactggttggagagagcggaagcgggaagtccacggcgattgcgctgcttgaaaggttctacgacccggataccggcaagatccttcttgatggggtggatctcaagacattcaaggtcagctggcttcgtattcagatcgggctcgtggcacaagaaccggtattgttcaatgacaccatccacgccaacatagcttatgggaagcaagaacaggcatctcaggaggagatcatggccgctgccgaagcagcaaacgcgcaccagttcatctcggctctgcctgacgggtacagcaccgtcgtcggcgagagagggatccaactgtcaggcgggcagaagcagcgcgtcgccatcgcgagggccatcatgaaggaccccaaggtgctcctgctcgacgaggcgacgagcgcgctggacgcagagtcggagcgcgtggtgcaggaggcgctggaccgggtgatggtggggaggacgaccgtggtggtggcgcatcggctgtcgacgataaaaggcgcggacatcatcggcgtcctcaagaacggggcgatagtggaaaaaggggggcatgatgaactgatgcggataaaggatggaacctatgcttcgcttgtcgagcttagttcaagttcaaggtaaatcttctgaaagcctgaacattatcacctctaatagtatgaaaatactgacttgtcctgaata

SEQ ID NO: 87100 - DNA, 1267 bp, Oryza sativa
cagttagagcccgtcacaggtgagtttgcctacagcaattttattttattttatttcacttagttcttttattttccttaacatatttccacatacactatatatttttgttatacttaattattttatttcactaacagtagtaattgcacttcattattttactaattctattattttatttccaatggttatactaatttaattattttatttcacttctagtgggtgcttaacttaattattttatttaactatttcatcagcaatatactattgattatttcgaacatattagagtcatacagataacagacatgtagacataaactacgtacataaattacaaaaataatccttcctcatggtcgacgcgtgcatattgaacgtcatcttcttcttcctcctcttctagaggtatttcttgacctatgccatggacgtgctggttgtaatcatcctcgtctataatattgtctaatccaacaattctccttttctcttcacgaacaacatgtagtttcttgttacacgagtcaactatgtagaacacttgaacaacttgtttggagagaacgaacggttcatccttgtacgcgttgttagccaagttaacagtggtgaaacctttcttgtcaacttttacattgcgaagatctacccatcgataacgaaacaacgggactttgaacttcaagtaatctagctccaatatttgctcaactctaccatagtattgatcacgacgaccaccgtcactagcagcctcgatgcgtaacccactgttctgcactatatatttgctgtcttgctttaccgtgtgaaaggtgtatccatttatgtcatatccttgccaggtggtggcactccattcaggaccctgtgacaaccactgaagtgtttcactagacaagttctgcaacctagcaattcggttcttcagccactcgttgaaagaagacatgtgcttatttctgacccaactctctgattggcctgggttctcctgtcggagaactgcaaggtgttcgtcaacgtacggcaccacctcagtcatatgctacagtaccatgaaatgagctttatcgtacaccttccgatccaacctaacagtctttcttccaatagtaccaacaccatcaagcctcccttcgtgatgagatagtggtaatccaattgaagatatttctgacatgtagtccacacaaaaatcgatgacctcttcggtggtgtaactctcgatgatactcccctcgggatgtgaacg

SEQ ID NO: 87101 - DNA, 1520 bp, Oryza sativa
atcccatcttgattattcatatcccactacatgtttcatagcatacccgagaactacttttataactacccaattatggagtagcgtttagcagtccctaagtaagctactacacatgttgagaaccatgataatctcaggtctaaggattcaatagcaacactcaatgagatcactgatgacacaacacatatggctcttgcagtgtctcatgttgggtctatctaacaacatgttcaccaacatgtgtccacattattaatttggtatctctataccatgatcaattaatacatgtgctgatcatataaacatatttgttccacatatgatatttgatcagggatcctttagaaatagtaacaaacaacataaagagtctcatgaaagaatcacatattcattaaccaataaggagttatctatttcaaggaacaatgtcggataaatatgtaaacatagtatgtgatacaatcatctctatgattgcctctagggcatatcactaacagtctcccacttgcactagagtcaatcatgaatgtatattacacccattgccctagtttgtgcctcatgcttaggctgagggagtggctttgtcaacggatctgcaacattcaaatccgtatgtattttgtgtatcttcacatctcctctacccactatctcgcgaatgaggtgataccgccgtaaaatgtgtttggacttttgatgcgatctaggcccttggcttgcgcaatggcaccactattatcgcaatagaggtccatagggctagaagcactagtcatcacacctagttgagaaacgaatttctttatccaaacaacctcctttgctgcttcagaagcggcaatgtattcggcttctgttgtagaatcagccactgtatcttgcttggaactcttccaactcacagcgcctctattcaggcagaacacaaatccagactgcgatctaaaatcatctttgtcggtttggaagcttgcgtcagtgtaaccatttacaacgagctcttcctatcctccatagactaggaacatatccttagttcttctcaaatacttcaggatattttttacagttatctagtgactctcacctggatctgattggtatcggcttgttgcactaagtgcatatgaaacatttggacgtgtacatagcatagcatacataatggatccgattgccgaggcatatgggatcacactcatcttgtttcactcatcagtcgtctgaggacactgattcttgccaagattaatgccatgtgacatcggtaagaaacctttcttagaatcttgcatgttgaacctcttcaacaccttgtcaatgtatgtactctggcttaatccaattagcctctttgatttatctctatagatccttatgcccagaatatatactacttcccctaagtccttcattgaaaaactatttttcaacgatgtcttaacggattcaagcataggaatatcattcccaatcaataatatgtcatctacatataggat

SEQ ID NO: 87102 - DNA, 2862 bp, Oryza sativa
gttgtgcctcggggtatattcatgtcggcgaggaccttgttaacactttcttccacctagcgttcatgctagcttctagttcttgaatgacctcaaccttaagttcggccttcaaacgagcgtccctctcttccttggggactttccgtttcctgtattgggagctgtaccgtgggagtccatgcttccagggcacatcgctaccaattcccctagtccggccaggatgttctttggttccgagtgccttggtgaggatgtcatcttcgcgcctcttcggcgcggactcaacctcgctttgtgaagcttgttcagcaaccaagcccaactagaaaaaaaacagttatttatacgaacttctactttatacgaatggaaattagttaggttaagtagtgaactcaccagttcctgatagacgacggcatcacttttgttctcaaatgtgacagagccgtccgggttgaccttacccctagcccgcgcccagttgcgagttctttgttcagggatgtctgaaaacgggacagggacattcgctgctgcagcggctgcatcttcttggacccatattgcctccttgccaatgtaccctgtggtgcccagccgatgtgggtgctcattccgctgttgcagtaggcgatgtgcctcgcttgattccctaaactcttgggtgttcttgagagaaaagaattcctcccacaccgcttcggttatttgagggtattcatcgaatggcatatgattgccgggcgggttgacaaactcggtgaagagcttcgacttccaattcttccaagctttgcccatcttctggaatgtcttccgcttgagcctatcctttgcttcagccggaaatgtgaaccatttctccattgccgtccaagctcgctctttctcggcttctgtgaccttgccgatatctttatggaggatcccgaagttctcacgtgccaccagcccgcagtagttagaccatcttccaatgacagtcctgggcaccgtgggcctaccactagcgtcaacctctcttataacttgcactgtggtcggccatatattttgtgaccggggatttctactcgacctacttgcacttgtcccgcccgacatcgatgtatgttgttcctgcggcaattttgcagcacaaacagaaggcaacatatgctaaggggtgctagctaaaatttatgtggtcatgtgatgaaaatttatcctataaattaccatgaatttcgggttgttcgaccaccgttgtcgagggatgaccttcggcaactgcctccgcggctgggtttgcttcttcctgtatcctcacaggtgttggggagggcgggtttgtgccgggcgttgtcatggtctaattttcgcgaaaaagcttataaatttcctactattatactaaatagcattagatccaatgtaatacggggtatactatgaaatatatggccttagttttgcttagaaattatgcatcaattaccatcatttgcatgaagggaaaaaaagaggaaatcataacatcaaaatctgttcttatgcataaaaaaaacaagtgtatatagtctcctcttatcaatctagaaaaaagaacaagtgtagaaaatctgttcttatgcataaaaaaagaacaattgtagatactttgttcttatctataaagaacaagtgtagaggtatataaccactgaatcaatcatgcaaatttaaaaaatagcagcagcaagggtacagatagaatgttattgacataaaacagtagcagcaggagtatatatgccacaggggcagcaacagcagggggaaattcacataaaacagcagggtgaacaagtagccacagtaagaccagtagcagggcaaagatagtccacaagggcagcaacaacaggggcaaattaactaaaacaacatgtctagatagtctcctcttatcaatccagaaaaaagaagaagtatagataaaaaaataaacaagtgtagttaatctattcttattgagcaattcatcactggccatttaacaaggaacacattgggcagcagcagcaggagcaaagatagtccacaggggtagcaacaacaggggcaaattaactaaaacaacatgtctagatagtctcctcatatcaatccagaaaaaagaacaagtatagataaaaaaaatgaacaagtgtagataatctgttcttattgagcaattcatcactggccatttaacaaggaacacagcagcaacagtagcaattgcagattaaaaaaaatgaacaagtagcccacaataacagcagtagcaggggtgtattaactggccatttatctagttaaaatcatgcaaaattcaaccaatgcaggaaaattaatcctaaaatcatctaatacaaaaagactaattcctctaatattgcatatatttcatccacaaatagtccaaattcatcatctcatatatttcacatctcaaatatgcatatatttcatcaaaaaaaagagacagtactactaacttcatctaaacagcaattcatccattcaattctagcaagtcatccatccaaactgcaattcatcaattcatcatctcactaggaggagggggcgtcgcacctggtcggcggtcgaggagaagaggtcggggaggcggcgtcttggcggccaatgttcgggtcgtggatcccggcgtcggggaggtcggggttggcggtggtcggcggtacagttgccggcgtcgtggatcccgacgtcgtcttgggaggtcggggacacggcgaggacgacggccttgatggtcggcggtgcaggccggtgtcgtggatcccggcgtcgggaaggtcggggtcggggtcggcggagagggcg

SEQ ID NO: 87103 - DNA, 2595 bp, Oryza sativa
cccaaccgggagtaaagatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctccccactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcattccactgtcatcaatcattacgcctccaccagtcaacctaacccattggcaccggaacagaggaaccttgagaggaccatagtcaagttcccatatgtcctcgatggcaccgtaatacgtggcagttgttccatcatgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcgggaaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctcgacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtacttattattcgcttaatattcgtggagtatccagatggtacctttatgctctccaagcattcaaacatactttccttctctgccttgctaagagtgtagctggctggactcaagtaatggcttcctttctcctttggtttcgggtgaagatcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaa

SEQ ID NO: 87104 - DNA, 2340 bp, Oryza sativa
agcagcagtcgtcgcctctccgccaccaacatatcgctggcggcggagcagcagcagctcattttcgccaagaagcaggaggtgaagcacctcaagcaaacctccctctggtcctccaccttcgacgccgtcgtctcctcgctcgcgcgggccgcgttcaccatcctcgcgcgcatcaagctcgtcttcggcgccgcccacgatcaccgcccgacgacgacaccgctgcaccggagcctcaccctctcctccgccgtccacccgtcctccgtcgacgtgcaagtgcaaccgccggtgtcgcgcaagtccatgtccatggatatgggcatgggggaggcgctgtacttggagaggcagaggcagagcgggctgttggagcgcagcgcggcggcgctggtgccgccgccggggacgctgggcgcggccgcgttggcgccgcgctacgcctgggtgataatctcgatcgagaggatggcgcggtcgccgcggctggtgggggcggaggagcgggacgagctgtacggcatgctgacggcgagcgtgcgcgcgcagcttcaagcgaggctgagtgggacggtggcggcggcggagccggggctggcggggcaatggcgggcggcggtgggagggatcctggagtggctggccccgatggcgcacgcgacggtgcggtggcaggcggagcgaagcttggagcagcagaggaagacgacgagggagatggagactcagacgctggtggtgcagacgctgcaaatggcggagcgcgggaaggtggaggcggcggtggcggacctgctggtgggcctcaactacctctgccgctttcacaaggagatcaccacctgccgtacccgtacgtgccaccacgacgatgcaccatgacaacgtgcatgctgcttcaagacgacgatgtacgattgccaatggaacagtatgcatccatccatccacaccgatcgtctgatccatgctctcatcttctcttctttagtttttcttttgtttttttgggatggatcccaattcccaagtacccaattggctaatggagtaggagatgcatgggctggcatctgggtgatctccagtactagttaagtcgattgatgagaatggagttttctgataattggagcaggatggaatcttgcttcattatattcatgtacagatagcaaaccaccagcggtgagtgattacattaattaaccccctctctagttataccactatggaatatacacatctctcgagcaaaaagcaagtacacacccttatatattcactagcaaaatacccgtgcttcgttacggtgtattaaaactaaaaatatttgtttttaaccgaatttttttacactgctttggtacttttgctcgctagaaaaagtctcaaatgatagagggaagtatagctcataataaattattattcaatagtgcgttgctacggagtaatttcaattaaaatcacaataaatatttttaggatttaatttgtgatatgagtccttttagagtaaggcattcttgatataaatttgccaataaacaacatgttgaaaacaatatatttcaacatcaactaatgttttatcgcaattaaaaaaagactaacttcctcttgttgggtaattgtattttgtcaggtaatttttatttttagtttttctatgaaaattagattggagatatatttgagagagacaaagtggacttgttgctttaaaaaagactaaccataccaaatgtggcccaacaactcaatcgcacgctgttagtgcttcatgtgctgcgtgcggcccagtaatgctacaacgcagagatggaggccagctcgatgcgggattgatccgagccactcgttttgatggacggttcggatcggttcagaatccattaaaacggccggtaccaaaaccctaaccctatttcagtttttcctctcctaactcccgatcctctcaggctgaaatggtgatgacgcaccacgatggatgaaatctaattgttacgtttaaggcccccttctaaactccaactctaaacttcaacttttttgtttttcgttaacacgtttccaaactactaaacggtgttttttttttgaaaaataatatatataagttttttaaaaaattcaaaggaacccatttttcaaatttataataattaataattaattaatcatgtattaattgtttgctctgccttttttttaaaaaaaaatgcccatatgagcatgacggtggacacgagcggagagcgagagagcggcgcgcctcgttacttccgcacgcctcttttttctcttctccgcccgcctctatctcctcat

SEQ ID NO: 87105 - DNA, 569 bp, Oryza sativa
attcgctgtgaaataactatccctctaggagatcttgcaatttcaatacccagaaaatatctcaactggcctaggtccttgacctcaaattctttgcttagattccgtttcaacctagttatctccaagcaatcatttccagtgataatcatatcatcaacatagacagcaagaatggttatatgatctccactatgatgatagaaaactgtatgatctccattacattgcttatagtccatagcacacattgcacgcctaaaccgatcaaaccatgctcttggtgactgtttaagaccatacaaagatttcttcaatctcaacacctttcctttagtttgtgaagtggcaaatccaggtgggacatccatatacacctcttcttgaagatctctatgtaagaatgcattcttgacatctaactgatgcaatggccaatcaaaattagctgcacaagatataagagttcttaccgtgctcatctttgctactggtgcaaaagtttcatcataatcaattccatatgtttgactatatcccttagccaccaaccttgctttgtatctttc

SEQ ID NO: 87106 - DNA, 621 bp, Oryza sativa
gctcatgaccaatttctagcggacctgcgagcattctaccgagtaacaccacaccgctcattgtcagtgatgctggctttaaagtgccatggtataaatccgttgagaagctgggttggtactggttaagtcgagtaagaggaaaagtgccatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttggg

SEQ ID NO: 87107 - DNA, 712 bp, Oryza sativa
ctaattttcaagatttctattcggactcctcaacacatatctttactcgtgcaatgagtactcgatgacaagaagctacagttctcgactctatgttcagttgccttctaactaaccaaagagtcgggggctacacaaatacaagactctcaaaattcaacaagctgaagaaatcaattaatcagccaacgagtcaactccaggagtcgttatcttcatctttgcttcgaagcagatattctacttcagcaactccaattatttcactagcaattttggtttctggacgctgccataatctactccaaatttctcaaagtatcaagttcaagatttaatctacatgttcgagagtttggagttatcagccaatcagcttggtttagacgagttggacaacagcatctactttcctccaagtgaagcatttacaacagctataacactaagttctgcagtcatcttcgtacatcaagaagcgttgcatcagtcttctttatgcacacgctctcgtcaaggaaactacttgagctttgatatcttctgaacagtttgatggattattgtcgctgacatcatcactagcacctctgcttcattagccctgacatctccgctgttgctaatggatgactatgtcttcgccgacttattatttcaccttcacggttgacctacaatgcaaacgctgatgagcgtcttcgtcattatc

SEQ ID NO: 87108 - DNA, 670 bp, Oryza sativa
atgcgcatgctggtacttaatgcagcgagtttagctgaagcgggtcaaccatttcatcgtgaagcttaccttgcaagacttttgtgcgctgaaaaatctatgaaaatcggtacggatggtgtacagatcctaggtggtcatggttttaccaaagaacaccctgttgaacgttggtatcgtgatttgcgtgctactgcaatcttacattctggcttacatgcttaattgatcattcgaggatattacaatgaatttacaaaatcctaaaaaattcaaaatgatggtcgatcaggcacatgaagttgctttgaatgtgttgcgcccaatttcaagaaagtatgacaaagccgaacatgcctatccaaaagaattggacatgttggcatcattaattgatggcatgaatgaaggtggtgaaggaataaatgcaggtgctgctgttggcaaacgtggagaaactgagtcaggtaacaaaaacggcaataatatgtcgactgcactcggtattatcgaaatgtgctatggcgatacgggtttattgttaagtatgccccgccaaggcttgggtaactctgctattgcggcagtagcaaatgacgagcaacttgaacgttttaaagggacatgggctgccatggcaattactgaaccaggttgtggttcggactca

SEQ ID NO: 87109 - DNA, 717 bp, Oryza sativa
tgtccatgccccgttttcagacatccctgaacaaagagctcgcaactgggcgcgggcaaggggtaaggtcaacccggatggctctgtcacatttgagaacaaaagagatgccgtcgtctatcaggaactggtgagttcactacttaacctaactaatttccgttcgtataaagtagaagttcgtataaatgactcttttttttctagttgggcttggttgctgaacaagcttcacaaagcaaggttgagtccgcgccgaagaggcgcgaagatgacatcctcacaaaggcgctcggaaccaaagaacatcctggccggactaggggaattggtagcgatgtgccctggaagcatggactcccgcagtacagttcccaatacaagaaacggaaagtctccaaggaagagagggacgctcgtttgaaggccgaacttaaggttgaggtcattcaagaactagaagctagcatgaacgctagggtggaagaaagggttaacaaggtcctcgccgacatgaatataccccgaggcacaacacctgctgtgcatccaactcctcgtgcacaacacgacgcgagtccgtcacagcataggagtagttgtgcatccacagaggtgctggcccctggtctccccgtcgcaccactagctgcagtggaccacatagaggtaattgatgttatctgatccatatctaataaaaaagcgggctgcagg

SEQ ID NO: 87110 - DNA, 516 bp, Oryza sativa
caacatcagctaatgcagttgaaccacatgccatcgttttgtcttctactcaatctatgccaccttctacgccgtttgtgcttccagatacaaaggtataatctaattgtgttgtcttataaggatatgtgacctgttacatctaagttaccataatttcttagattatatcctttttgtataggacacaagggacagccatggtgatcagcatgaggcaacaccacctactccacaggctagcaatatattttatactcacatcaattatatgcatatgtctttgtcagaccttcctaaccattaatactttatcaggtcatagctatagcacatctagataaaaaacgtaaatcttctatggctgatgagaatcttggccatggagggttagtgccaatggaaaatttcatgttttactttgatttcttctctttttcctcatgactcaaacaacttccatttgtagctcatctctgatgaacatgatcgtcgcaagccttctgttgtgcacac

SEQ ID NO: 87111 - DNA, 557 bp, Oryza sativa
ctcattgaagagatacgggcgatgtggttctctggctggcgcacggaacgtgtttgaccaggtgcaggagcgcgatgtgggtgtctggagctctattgtatcagcatatgcattccatggccacgcagatgttgcaatgtcgcttttcaggcatatggagctggacaatgtccggcctgatggcataatgttccttggcgtattaaaggcttgcggccatgctggtcacgcagatgatgcattgaagtatttcgatgttctaaccaaaatatttggggtcgaggcctgtggagatcactattcatgcttggttgatgtcttgggccgggcaggaagactacgccaagcttatgatgttatacagacaatgccagttaaagttactgcgaaagcctggggtgctcttcttgctgattgcaggacatatggggaggtggggttggcataggttgcagggagagcattgtttgacattgaaccggacaatgcaggtaactttgtttcactcgcgaacatctattcaagcatgggtatgcatgacaaggcataacaggtga

SEQ ID NO: 87112 - DNA, 674 bp, Oryza sativa
ccccccgccgcgacatgccccctccacgccgaccaaattcgctgctggtgtctgcgctttggctaacgatctgctgcttcaattccgccgcccgcctccccgtgcggccgtgctgtgtgctctcgcagactacgcgttcaacgccgtgaagctggccgggatcacctccgtcggcgtgcgcggcgagcggactccgtctacgtcctcacccatcgggagggaggtgagcacgtcgcgagagcggaaatccccttgtcccctcatttgtgattcattctgcggccgtttgatttgcttcgttcccctgatcaggacaagttgcacgacccgacgaccatcacgaacctgttcgcgatcaccgaccggattgggctgctcgccaccgggatgccaggtgagccacaactttgctctctcagattctcagttctaagtgctgcgtggaacatgcggtgcgcgcgtttggatcccgctggcacaatatcatttacgagttacgaattgcgaattggaggatcactcgactttatcctgccgtagaacgtctcagcgaaaccggttccaataattaatctctgcaactcttggtgttcatgagagcattgcgatgtgataaggatgttttacataccgatgatgcgcttgttcgactggatgctaattttgctgactcc

SEQ ID NO: 87113 - DNA, 681 bp, Oryza sativa
atacacatggtgataaaccatgtttggaggaagcttttgatcttctttgtgaaatgaaaatcagaggcgtgaagccgactgcggcaacctacggaacctacctttatggactttgccgtgccaaacaagtcgaatctgcatgggactttcttcaagtgcttcggcagagaggctacccttgcaacagctattgttttaatgcagtgattcatggtttctgtaacgataatcaggttcacaaagccatggaggtatttgatgagatgaagaaaggtggggttgtcccagatgtccatagctacagcatattagttgatgcgctttgcaaacaaggtgctctatcattaggctctaatttgcttgatgaaatggaaagaaacagagtcagtcctactcttgtcatttacagttcacttctgcatggtctttgcaaagctggaaaagttgaggaggcccttgaacttttcgaacgtctcaaatatcaaggtttcaagcatgaccaaattacttacagcattgttcttcatggttgttgccgacatatggatatagaggttgcctatggtctttggattgacatggttaaccataattttgttccagatgtttacaattacactagtcttatatatgcattttgtagacatagataccttaaagaagcattggggttatttgaaa

SEQ ID NO: 87114 - DNA, 641 bp, Oryza sativa
gaagtcctcttcagtaggtccagaacagttaattttgagggaattcttgcactgacatttgaaagcaccattcagaaattagtttccttgctcaacaacaataccaggtaggcaacaggtaaaatgaacatttggaacatacaaataatttaaaaggttaccaaccttttcattctccagtaatattactaggattggtccactgtggtcacatcgttttgaatacgaaaaaggacagtcatcagactgagaagaacaactgcatattgcccttggtggagctccatgtgtaagagaggaagggtgatctatgtgcagagtttcgcactgccatgtaacaacccatctaacccattccaccatttcaggaacagatgaacaacaatttcgaacagcttccttgtatctccaatgtgcagcaattccaaattctgcctgtaaatgcatgtccctcgtacgaatttggatctccaatggcagtgtttcttcactgagaacaaccgtgtgcagggattgatacctacaagttagcaagcatacagttatcacggtgacttactcttttttttgcataatagtattagttttcagagtcttacccattgggtttggggctgttgatgtagtctttgaatttgcca

SEQ ID NO: 87115 - DNA, 1256 bp, Oryza sativa
ttaacacaattgcacaaaagaatgtttaatggatttctgtggacaatcatatattcattgatttccattgttgtttggattgacagtctacacaatcctttcctttgtatattgctattttaagaactatatgataccccttgcattgctgcagtacgaatgaatgaaaataagctgcagaactgtgatgaaacaataagatggagaaataatattaactgtaaacaaaatagttgtagaactactaaattattattagagtccataaagtggacattgtccgctcaaagggatgggccaaagagggggaaaagtgagatgtggagtctaactgggccaatccactgtatggccctaaagcggtccttgtagaacagaacatcgatctaatttaatggttaatactatgatccaatggctgaaataattttgatggtatgattaacaacagaggcacctttttgttgtataagtatataaaagaaacattacaaagtacgatagtttccaaagtcctgccgttattattcctcagagaaatacagctaaaacaggacagttaccgaaaaagggaacacaggtgctacagttactattagagatcgcaatagcttgcaaaccaaataaccaggagacagggacatgatatacttcattatcaacgagcacctgtcgcagtgcaattggaatacatggaagcaccgaaatgcgtaatatctcaaccatacggtggagaaatgatatgatctgtatttcagcattgcataagttacaaattggttaatcatccaagcagtaaattgcaaaagatgttgataacagttacttaccttagatcgcaggggcttcacattaggaaatgagatgaggacttgcaaaactacatcaagggtctgagaacaatacgaaaaaaaaatcacatacgaaaaatggaaattatgcacatatatgataattaaaaagcatatatatacgtggaatggagaatgacagaatgtaccttcttgaacataacgccaagtgtcggcctgcttcccatcacaagccgttcattaaatccctaaaaaaggacagcatccagacacagtaagatcaagcattaatacttgaggcacttgccatatacagaaccaaagatttggcatatgagcgaatcagaacgtttttttagaaataaaatgatatactacgttcacggaatgtgatattgccaactcctcgtgatgtgtgaggatgaacagcataccttgctgatc

SEQ ID NO: 87116 - DNA, 2380 bp, Oryza sativa
ataagatataaatagtattttatgtatgactaattttttcaaaaagaaatatatataatttttttaaataagatggacggtcaaacattagacacgaaaactcacaactggatttaaaatgggacgtagcaacaaggcagaggctgtactggccgagagtagccattgtttagttcatagtgggtgagtaaataaaaaaatgtaagtcgcaactgcaagttttaagatcattaagtcataaattaatatacattgttttccctcattaagactgagacaggaaaaaatcgatatataaccacatgttggccaatttggatggactctgattggccgtactagcgaactcactagttcctttgtggggaaatacgttatttgtcaatatctttttttccacgtcttgcgaattgcgatgtaggttcatgcatggcactacccaaatgaaaggagtagctgaccaggatgaaatacactcccaatggccaatgggcgttcgagtcaattgaccactcgattctatcgatttgttttgtccgagtaacaggaacagaacagcttgatctatcttatcgcccccatcatcccataaatggcttgattcctcaaaaccaaataacccacaaatgtctctaaaccagcaccagaacgtttggactttggagaggtccaaacctgaaacctgatggctttttcatgggtaaattgtacaaccaacgaccgacctgatcacctgaccaagtgaccatccttgatcaagctgtacagtatggagatgcacgggcttttttttcttcttcgcaaactctatctatgtacactcgaatactctcctctctccccaaattacaaacacaaaaccagacggctacgagtcggaccctgaacacagctcggcgcagcactcgtagcagccgaggcaggcgaacgccgcgcagacctgcgtcatcacgatggcgcactggtcgttcatcttgttgcaggccttgatgcagcacatgcagcagaggcagtcggcgaggcggctgcagcagccggcggccttgttgaggatctcgaacgtctccagcggcttcacgtcgccgaaacccgtgacgaggttctccctggtggcggcccggtcgccgaacccgagcttgaggcattggagcgggatccgtcgaggttcgtcggggcccttgtgacctttcagtttctgcttgacctgttcgagtaaacaggcaagttagttgggagttctgagctagcgtggttgtcacaagatccatttctcgtaaaccagtttataagcagggaccattggtattattataaaaacagtgggacttaccttttgtgctgcatctaccttctccaatgtttgaagtaggaccatgctcgtgtactctgaaggaatgctattttgaatgcttagtttcaccaccttcaaaaatcaaacgaaatggagttactgaaacccatatactgctaactgaatggaactcaaactactaaagaaagtaacatatttcaggggcaactgcaattcacaagagaatgtgacctataaagatttcaaactagttcagggaataaatgaaatggaaagcgaacatcaaaataatattcagcaccaacaaccacactagggctgagtttagttccaaactttttcttcaaacttccaacttttccatcacatgaaaacattcctacacacacaaacttccaacttttccatcacatcaaaacattcctacacacacaaacttctaacttttccatcacatcattccaatttcaaccaaacttataattttggcgtgaactaaacacaccctaaggctgtgttcggatatggggagttgggaactaaactccccgcacggaaaacggatcggtccattagcgcgtgattaagtatttactttttttttttcaaaaatggatcaatatgcttttttaaagcaacttttgtacagaaactttttgcaaaaaaacacatcgtttagtagtttgaaaaacatgcgcgcagaaaaagagaggggtgagctgggaactctgtgttcggcacaccaagttcccatctcctctccatcgtgtttcgtgcgcacgtttttcaaaccgctaaacggtgtgtgttttgcaaaaagtttctatacgaaagttgcttaaaaaaatcatattgacccatttttgaaaaaaaaagctaatacttaattaatcacgtgctaatggatcgctccgttttacgtgcgtaggagattggttcccataaagcccaagcgaactcaagcatttttcaatgtattgcccattaaatgcttaaatgcttcagacaagcaatgtgagaactttcaaacattaccgattatcttcactatatctcatgactccaaaa

SEQ ID NO: 87117 - DNA, 1508 bp, Oryza sativa
tcagcttggatttatgaagaaaggggatccaactgtaactctgcacccagtgaaattcaagcgcgcgcggaggtgaaggacgcgagcaaaacaaagtgctcgatatacgacgatcacagtctttcaaatattttacagcttggaagttatgcaaaaccattaccgctaactgattactgtacgctatagctatatgtatgactgcgctcaagctgtgtcaagtgtcaattatgagttgcccccggatttacgataccaactgatgatcacacatcaacacttcaaactgtaactgtctacgaaggaactgcatcctcctgctcccgtgtaaccttagccagggataattttcctatgaagttggtcgcaaggctgccgaggaagagatctccgttgaactctgtcaccgaagtgaccatgttgatcacattcccttcagagtcaccaagaaccctcacgatctcgccgttcaacgacacctgagccaccactgctcccttgagcgtcgccttggtcctctcgacgagcgccgggaacgacgcgatgaccctcctcgtcaagctccagcgagagatcaggtccagccatggagacctcacctgcagtttgagcacagaaaattgtaagtttgagcactgaaaatgttgtgtagatgcttatggcagcagaaaggttagagagcagagacctggagaagggcaatccagaagtgaccatctgaacccagccgaatgttgtctggattccccggcaggttgtccacgaagatctctgcctccagccttctcccctttcagccacactctcaagcatctgaacctgcacttgacaatatcacttcatggtcacttgacgatagagtgaacagactcttttttttatgagcaattttaccgttcttaaggagatacatgagatactattttttttctattttaatttgatatctctttatatctagatactataagataccaaattttatactaattttttttacctcatggtacatccttatgaaccgtaaaattactcgttttttattattattttagataagggtattttctatccagattctacatccaatcagatatatgcagccatttaaattaggaacttagccccacaaacaatccaatctgaaattcgttcctaagaagatttgcactcgtaaccttaaaatgttactcaggtcactgcacgtgtcatttcacagatgagaagttgagcttgttactacctcatcgtctcgcagacgacgacgaaggcctcgtcgggcggcagggcgacgccgttggcgaagccgaggccgtcgagcacgacggaggcctcgccggtgcgggggtcgtacttgagcaggcggccggtgaagcggtactcgaagaagtcgaggaaccagttgtcgaagctgaacctggtgctggcgtcgctgaagtacaccgtgccatcggaggcctcgatcgccgcgtccgcgaacctgaagacgacgaacggagaagaacagt

SEQ ID NO: 87118 - DNA, 1624 bp, Oryza sativa
tatatattgcaaatatacacaaggttctactccctctttttcataatatggtatggtcaaacttggcatgtacggtctacaaaactaattttttatttataatttctaatatactataaagtttgtagtaacaaaattataaccatatgaaagtatattgaaatatcaatccaataatattatttctatcaaataaaattcaatttatattatacaaatcgttagtcaaatgttttgaaagttgaatcttgaaatgagtgtgcaacctacattatagaatggagagagagtattgctttaggaatttgccatggaattgaaaaggacattttaatgattttgtgctttgttccccatggaattcccatcgaatcatcccgtcactatcttgagtgagctagccctcccgatccgatcccttcagtgttgtgttggcgaattagagtgtggtgccatcgatggggacatggtatgttgcagaatccaagcccaagccgacatatcatggcagctggctgatcgaggcgtgtgatcgtggactcacagcggcaagtgatggcgtggattgctcgcggtgtggctaactgtggtgctggtggcacgactacctgcagggtgcgtggactcatggcggttgtcggtgcctcgttgtggtggtgaacttgttaaaaattatttggaggagcgtatccttctccaaatcacttttttttttgtggtggtgaaggatgatggggaattaatgcggcaaactgggggctcgcgagtgagggaaaatgctcaacaactcactgccccctgcccccccccccccaaacaatagtatggaaagacaatttacctctgttagttttatactgcaatgtatttaagtgggaaatcaaatcaatctaaaccatttgatcgtttaatactgaccaaatgacgctgcagtagtaccaggaatatcagtgaccaacctgtggacaaacaaattaagatgatcaacccatcatgcagtcaagatgtggttatgtatgtaaatcagctagcagtgattattttgatcattgcatgaaaacaagtgcgctagcttaacattagtgtgcttaccaatgtagatactccctaaggttagggtcacttgggcttggtgcatctgggtctaccatcaccttcaggtacacaccacaaaaaaccatgacaaacatcaaattaatgcattttaaagtcatcttgggttaagtaccaaacaaatttttctataatataataatgaaagaaagtataacttctggtctctgcaccaactacgacacatggtagagctcacatacaagggtgtagaatgtcctcatgtcattgccgccgacctcgaccctaggctggtgggtgaccatggacggcttgagctcgcagccattggacacggtcttggagccataggtgaccttgaggttggtgctccggacgaacgcgtccagcacatcacccacaaccctaccaaccacaagagggtccctgtccctgccacttccggccatcgatcttgcaaaaaaccctgaaggtttatagttttgcttactagctgcagctgctagctattgcagcagcagcaagttgcagggagcaaatatactgtgat

SEQ ID NO: 87119 - DNA, 690 bp, Oryza sativa
  unsure (1)..(690): unsure at all n locations
cccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaacctcgtctcacctggacgtgagcgtaacgacgctgcaataaacatgatcggaattagacatgttatgtgaagaaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtcaccactggtcgacctatggcaaacctctcggnctgcccaaagctgaagcaacatagggcagccagcgatgatcgctcccgcgtcagtcttcgtgcacgcctcacagagggcacggtacgtggctg

SEQ ID NO: 87120 - DNA, 738 bp, Oryza sativa
ctcatgatgtgcttccacaaatctttcttatgactgatggatcagttgatgatgaacataatatatgccaaactgtgaaaacggagctcatcagcagaggatctaaatctcctcggatttctacttttggactaggtaatgttaaggagagcgtcaaatatacaattatctcattattcaaaactcttgacttatctcctggatcacatgaaaattctcctccctactttttgcaccaacgctcatgtatttctctatctccaaatatcctttcttgtgtaagagaaaaatgcttacaccataagtcaacagaccagtcagtgtggtgatatatgctgccagcttgtgatgagacgaaccatattttaattactctgctgttttagttttgtactacttcgttactgattgcttacagtttacctgatatattctttttgctcttttcattttatcactggaataacaggtttgtattgcaaccactatttcttgcgcatgctggcatcaataggcagggggcattatgatgctgcatttgagacaggtaccaagcccctaaacccttttgttctcatcatagcaaacagtatgctcttacctttatgttggtctttaaacttgaaggttagaaaatgatctacacagtctaccctttctccatggatttcttagcttttcctgagacacacgatatatactgttatctcaaccacattataatagaaaaaccaaact

SEQ ID NO: 87121 - DNA, 1773 bp, Oryza sativa
ttttgcggcatgtatatgtgcctctcgatttgcagttttgattctccattgagccgttagttctattgttttcttcacagggatgctttgtgggttttgtaccttattgtggactgtgctgttggaatggttggtggcaacattattcaggtgtttgcttaacccagtgtttgtccaagtggaatatgttctcttttttttttttgttcatatggttcgtttgattgagttgtcttgaggtggttgaccgcaattcatggcgtgctctgcactaaattctgtactttctttataactagtttatgaattccagctgactaaatggatgcctttggttatattacaagagcaattttcagtaaaagtggcattaagcaagtgaaagtaattccttgctttgtcctatggaaatcaaacacaagaaggaatgtgctggtttagcagagtggtaacctggcttgtgtatcaaaaatgaggcagctaggaagaagaaatatgttgatgtgtactgaaatatgttgcttcgtgtcatttggaaacatattgtatagcttgttctttacttcagcatctagaagtacacatgatgctccattgctccttttatgtctggttgtagaatataatggcttgcagaatggagataattcggtggtgaagttatttgtcttggatgactatagcatattattcattggtgttgggtggttgttatcttgcctagcgaagttgattaacaacaacttggaaatttgtaataaataactcacatacactaatatttgatattttgaaacatctgattctactttccatccgtaggaaacatcaccattaaatgaacattaggcatctactagtatattatgtttaattatgttatatgagttgcattaatttccatgtttgtcttgttctcaacctatgaacggtttggctaatagggttcaattctaggagccgaggttaccgttggaagaagatcatataatactcaagtaattgaagtagaagatcacactacagagaatgctccaaaagctgatagtggcggactcttgaaaccccaattattttatttgacaatatcacaggtacatgctaaatgcagaactgtcttttgttctcttctttgaacttttggaattggagtcttactttgaagattcattgccatcttgccgataaagattgagggtggggcggatatttctgccacaatcagatggtctcagaagctacactatgacaatggacgattctcagtggacataccgttccgttttccatattatgttaacccattgccaaaagtattcatgaaaagggagaaaattcagttgactgtgaatagtggtttcagtaaagaggttttactgcagggaacaagccacccattgaaggtaatcatttttttttgctagaactcttttgatttccgggcaattggcatcagtgcttttacaacatttaatcttcaaaagagtttcccttactatttcaggaaaaaggtaggcagggtgagaagttgtctttccggcatgaagcaactgttgagaattggtcaagcaaagatttcaatttttcatacagtgtgagtttcccttttgtgatctctttattagctgtaatcggtagtcacttctttaagtagttatgagctcactagttcctgtgataatctgactttccaagacttctcaaatttttctttttttgtgagcatatgttagttgcagatgtaactgaaatctggctcgagaactgtttact

SEQ ID NO: 87122 - DNA, 636 bp, Oryza sativa
catggaattttgcaggcggcccccttgccgccctgggggagggcgattttgtactgtgctctatatttttgtataaatatcaatagttatcaaatctttttatattgaaaactatacaagattaaaatctccaagactgataaaatacaattttatattttttagggcatatttggattgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggactgtgcgcgctactggatctgacactacc

SEQ ID NO: 87123 - DNA, 502 bp, Oryza sativa
caatgaaacgccaactaaaacccgtacttgcgtgatcagtcaaaatccttctgggatggaatttcttctcatgtgtcatgactcgatgattccgcaccttgcaggaagctgtcaaactcgtcgctgaagggatttatcgcgcctgaacttggacagctgagcttcttgcaagagctgtatgttctgttttattgttttttcaactggttatgatgaattagcttcaaggtttctgaaggtctcctttttgggcaggtatttggatcgcaacatgctttttgggacaattccgaaacagctaggttcactgaggaaccttagggtcttggatttgggtgttaataggcttactggtcctatacctcctgagctggctggattgagcagcgtaagcgtaatgtaagatgccaattgatttgcttatatattcagggttttcctgtctctggtgcttctttgctattgaaactaaggctgctttcattcatctgctgtagaaact

SEQ ID NO: 87124 - DNA, 527 bp, Oryza sativa
tgcagccggcaactcagaggtacaataaagaacagtaccattggctacctttacttgaattggagtaagtaaagatttcacaccagtgagatgaggtaaaaccactgaactaagaaaactgcaagagctgcctgaatccaccaaaattaacacatcaaagccttgaatggacccttgtaatcgcaaagtatgtgcagaaaccgtgccttgaatggcctgtaaagaaatagccatcagactagaggtagaatcagcatcctgttcaccatcagaaacatcagctgccaaaacactgaaaagttcttgaacagcatgtaactgtactggtcctgaacacttgtgagtaggagaccacttttcagcacaaacataacaaagaccttgagctcgtcgataggccttgagagcaaccaatttgtcagaagaactggccactttaggaacttcagctgctcttttatcatctcccttgccagcatgcacaaatttgggtggtggtaaaggtaaagggtaagcgcctttaattc

SEQ ID NO: 87125 - DNA, 2212 bp, Oryza sativa
tttaaggcctctgaggatttccgcattggcgcgctccacttggccgttgcttctggggtgggcaggtgaggcgaagcagagcttgatgcccatgtcttcgcagtaatcgccgaaaagttcactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatatcgagcccccagacagcaaatggccatgaaagtggtatgatctgcagggcctgggccgactgatggatttgcttggcgtggaattgacacgctctgcatcgccggaccaggtcgaccgcatcattgagagctgtcggccaatagaaaccttgtcgaaaggctttgccaaccaaggtgcgcgaggcggagtgggctccgcattcgccttcatggatatcggcaagaagctcgacgccttgttcccgaggaatgcacttcaggaggattccgttagccgcgcgccgatagagggtcccttctaccagcacgtagcgtttggagatgcgctggacgcgttcactcccttcgcggtcctcgggtagagtcttatctgtgaggtatgcttggatctcagcgatccaagcaatcaatctaagggagctgggagcgctcccctcgggtcccgaggcctggactccgacgggcctcgggggcctgtcaggcgcatccgtctcccctaaggggtcgggtcgcgccgacggctgggcaagcctttcttcaaaggcgcccggtggggtctgggctcgcgaggaagcgagccgtgagagttcgtcggcaatcgtgttatcccgtctgggcacgtgccgaagctctatcccgtcaaaatggcgctccatacgccgtacttggcgcacgtaagcgtccatctgcgggtcagagcaccggtactccttacatacctggttaacgaccagctgggagtcgcctaacaccaggaggcggcggattcccagtccagctgccaccctgagtcccgcaaggagtccctcgtactctgccatattattggtcgcccgaaagtcaaggcgaaccaaatatctgaggacgtctccgctcggcgaggtcaacgtgacccccgcaccggcgccttgaagagacagggagccgtcgaactgcatcacccagtgggcggtgtgaggcagctgcgaggggcccgagctggcctcggggactgagacgggctcgggtgctggggtccactctgccacaaaatcggcgagggcctggctcttgatagcgtggcgtggttcaaagtgcaaatcaaactcagaaagttcgattgccatttcaccacccgtccagtaccctctcgattatgcaagatttggccgagggggtaagacgtaaccaccgtgacccgatgcgcctggaaataatggcgcagtttcctcgaagccatcagaatagcgtaaagcatcttctgggcctgagggtatcgggtcttggcgtcctggagggcctcactaacaaagtagacgggccgctgcacctttcggtggggccgatcctcttcgctaggggccacatccctggggcgctctttgtccaagcggccttgcggggtgcactcgtcttctgtgccgacgacctcggggtcggaggacggcaggggcggccttcccacagtggcctcggggccgtcctgggggtcgggggctcctggcgtcgttggacaagcgggcaaagggccaactccggccgtcaggggccttaggccaccgttcggctcgggggcctcttctccctgctgtctcccgggtcgagtcggcacagggttagcctcggggtcagagggcgataggtgcggccttcccgcagtggccctcgggccatcctgggggtcgggggcacctggcaccgtctgacaagcgggcagagggcctgctccggtcgtcgggggcctctcctccctgctctctcccgggccaaaccagcacagggtgggggtgcgcggaatgaggattgtcctcatcgcgctccacaaccaacgccgcactaaccacttgcggggtcgccgctaagtagagtagcaagggttcatttggctccggggcgaccagaactgggggagag

SEQ ID NO: 87126 - DNA, 2024 bp, Oryza sativa
cacccatggacagaagctgcacgcctgcaccagcaccacatattgctcaaatttcggctaatgacagatggcgaaaatgtgcatttttgtggcactatcatctcatcaaactccaacataccaactcttctatgagcatgaatacagatttctgcctctgttaactcttcagaaactgaaagcatgtgaaaattcacctaaacatttccactcgatgcgtatgaccagtactccttgacgagctctcggaaaagagaaccttctgtttccatgagcttcgtaggtttgtcatactccaccactttacctggaggtgaatacagtttagtatagaacaattagccgaaaaaataggcattgtaagtcttttttttccttttgttgttggtcagtgttcactgtacgacgttaatacagaaagttagaagggatacattgttgggaaaatgcaaaaaagttaaaagcatcacacatcagtgaaaattggggaagcagaattatccacgcagtttcaactttcaagtataatccatatattccagaataagtagtgctgatccattagacaatgatcacaggataaatatatttctaataagttggcggtaagaaagacgtaccatcgctcattgcaaggaccattgtgcagtccataactgttggtatacggtgtgcaacagtaataacagtgcaatctttgaactctgttctgattgttttctgaaggatagcatcagttgcattgtctatagaggctgtcgcctcatcaagaactaagatacggcatcgtctcaaaagtgctcgtcctaaacagaagagctgcctttgacccatgctccaattcgacccatcttccacaactatatggcaatatcacagttagcatatgaataatgtagcttcattatatcatgctagaatatgagtatggcaaaagatatctacgaaaagaatggtatatgcagcccccaaagtatttctagctacaatttttgtgatgtaaatgaaaagacatattttgaaaaatacattggaaacagaggaagaggttctttaggcaactcgaatctcatttacaaagtcattttccgtgacgattcggcaatagtgctaaaagagtggaatttctaattggttttttaaagttcccttcatgaactccaatatatatcacaagtgtgttttcagcatttttagtattgactgcgaggatgtgctcagtgctatggatgtttttgaaaaagagtctgggactaatattggttccagattttagtgacatgtatttttccctcatgtggccaagctgttaaggaaggacacagaatgaattcaagaaatcaaagtacatatgaagcaatgtcccctaccaagtgaatccaatccctgttccttctcctggacagtctcaagaagttgacatttgtcaagaacctgcaagagacaatagcaaacataaggaatgattcctataaaggcgtccatatgcaaaaaaaggactaactaaatctgatgtagacttccaaagcctttggttatttaatcacataaactgaataaatcgccattgtcaagaaaagtaaacgacttccatgatttcaacaatacatcatggtaagcttatctaatcattgattacaattaaaaaaagtgaataattgtgtagggtacacatcttacctcccatatctgttgatctgagaattgcccaagggggtctagattgtatcttaaagtaccctggaaaagtgttggatcttgtggaatgatgcccaaccgtgatcgcaggtcatgtaagcctattgtggtgatgtccacagaatctatgattattttcctccagcaggttcaacaagacgaaacaaaccaccaatcaaagttgtcttgccacttcctgtccgaccaactataccaatcttatgtccaccttcaaatgtgcaagtaattccatgcagtacaaggggagcatcttgcctgtacttaatctgttgaatgaaagtcagtagcataaaaacttgttagga

SEQ ID NO: 87127 - DNA, 590 bp, Oryza sativa
gcttctgtcaaacttcccagcaatctctgtgatattaggtcttttgattattggaaagacaatgttggttacatttattggtagagtatttggaatttccaccatagctgctgttcgggttggtctgttgcttgcacctgggggagtttgcttttgttgccttcggagaagctgtcaatcaggtttggccctggttctttctgtttttttgtattgttttaggtgataagatgtatatgtcacacacatctgagttaagacaaactcatggacaatatttttgcagggtcttctatctcctcaattatcgtcattattatttctagtggttggcatttcaatggctcttacaccatggttagctgctggtggccagtttttggcatcaaaatttgagcagcatgatgtgagaagtttattacctgtggaaagtgaggtatcttcttttcactctcatagaccaacccatgttttaccttctgtttcgatgacctttttttttttgctgcaatagatgacatttgcaaaaacttagtatttttcccagtttagtttgtaatgaactgtcaagttcacagattttaacaaga

SEQ ID NO: 87128 - DNA, 821 bp, Oryza sativa
agaaaatattcgtattcgtatccgaactatctgggaattatccgatctgaaaggtatccatattcgttcttattcagagcatacagaaactatccgctccgtttttatcccactgtaaagtatggggtcgcgtcaacgagatactacttggctctaaagaagcaatagagttacagtcatttgaaagagctaccgagggacaggcgaataatttgaaagagaatatacatatttcaactttgaataccaacgatacaacatgtagtatatgtaagaaataccatggcctgctcacaagacctagtctaagtcaacactatactatgcatagaggtcaccccatcattatctatcagtatgtgatgtaaagtactaatcagatatactcccattgtttcatgttgtaagatgttttttttatcaaatatagtaatatttatattaccaaattagttttatttaattaatagttaaatatatttttataataaacttaccatgattcgaaaatattactatttttcctataaacttgaaacagtttgtctttaactaaagtcaaaacatcttataacctgaaacggagggagtatattactatctccatatcattttaagtgtagttgtaggttttggtgtccaacgtttaaccgtccatcttatttcaaaaatttatgaaaaaataaaaaaaatagtcatgtactattcatgttttatcatatagtaataacaataaaaatactaatcataaatttctcaaataaacctgtagttttcaaataaaacggatgatgaaacgttagatataaacctgtaaaact

SEQ ID NO: 87129 - DNA, 1841 bp, Oryza sativa
tgggaaacttaggtagattcttccatcaagtttagatcaagccaccaagtggcctgaagtgaatggtgctagacgattgaacgccttttgtggccacctcctgactgtgcaaaatgatcctttgaacaagcttgagaagcattggacccaccagtacatttcttggagatggcatgaggctcaaagccaggtggaccagcccaagctgttggctgtgactcagaacaattggcaactttgttcgacgcagaagagcaatctttctcagcaaccaaatcgactgatttagatccaggcaacctttccttctgagatgtttgagcagcagaagcatcggttgcagatgtagtggtgacttggcccaggttctcagctgttgtattgtatgcggattcatcgtaatagtgcggccaataggacgtaggtattccgacagccgcctttgcgggatcatgcattgtgaagtgggagtagaaatgcgccatgtaactgctcatagcatctggatgaacaccagctatcctaacctccaacacatgcccatccagagggtaaccattcatgtgagtgagagccacagcagcagagtaagcatcagcaaacttgacaaatccaaatcctttgctcacaccagtgtatctctcaacaactacttttgcttgagtgatttggccacatggtaggaagaggtcgataagtctttcgttgttaacatagctcgggagatggctcacataaaggtagtcatgtcgatttgtccctgctcattagaagacatctgtgatgtcagagcacccttggctgcattggattctgctggaagccccgcgactctcacagccagtatgcttacaccaatctggtagccatccaaatgatcaattgctgcagcagcacatgaaggattatcaaacctaaccatgccatacctctgaaatcgaaacattctagcttgaacaactcgtccaaatgggcggaagagatcgatgaattgatcttcagttaaacttgatggaaccctgccaacatagagattggccatgtcgatttccttgattggcttgccacctgcttgtgaagcgttggttgtacataactctgatctcttgaccactaacctctttccttcaaccatgtatccatccatgtgttggacagctttggtagctgagggtgcatctgcataccacactagactatactccagattcatcaggactttagtgatctgaccaaagggcgcgaaaagattaaccatcttatcggcagtcatcgaccgtggaagattagtgatgtatagtctagacttgttgatgtcttgagtggtctgtacagctgagatggatgctgatggggaaaggcctgcaactctgacaattatcatttctcctccaaccaatgctccattcattgctgcaatagctttggtagcagattcagaatcagtaaacttgatgaaaccatatcctttggctgaaaaggtgtcaggatctgccaccactcttgcatgggtgatcttaccaaatggaaggaaaagctcaaccaacttcttggtgtcaattgacgatggcatgttacagacatacagattagacatgtcaatttccttgacggttctggtggtgctgggtgattcaacagctgaatttctggtggtgctgggtgattcaacagctgaatttggcagtgttgaaggtatgccagatactcgaacctctatctttcttcaatcgacaagacgtccattcaaatggatgacagcctcagctgatggtgaggactagagtactgcacaaagccatatcctttacttaagcctgttgtgtgatctttggccacct

SEQ ID NO: 87130 - DNA, 567 bp, Oryza sativa
aacattggctttgaaccaaaatcaattattaggcacatcgagaacaaattcaagtacaccataagctatgcaaaggcctggagagccaaacaaaagattattgagatgaggtatggcacatttgaagcttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcaggctattgactacttgcagaacggttgggatgagaagggacttcca

SEQ ID NO: 87131 - DNA, 666 bp, Oryza sativa
gtcgactctagaggatccccctacttgtgtttgtctcgtctacatagttcttttcattcatatggtgctagaacaacttatgctcacgacaacacactttcggcgcttcacggtagtgtcagatcactcctaattgcagctcatgattttctagaaaaaaaatatctaagcgaattcccacaggggatttcaccctagccaaaccgtataacaataataaaaaaattataatagcattcacccgttacaacacacgggcatcttttcaagttataaatatatatattattcggtcgtagatttaatgaaagtaatctggtgttctatatgttaatatatttttttttgaaaatctttggtttaataacttgaataaatttggcttgggataggaacgaagggagtatataattattttttctagttgcacacatacaactattatcttctttttttccgtttacatcaaatgcgtactcaagtgcttctcctaatacacgttcagggaaccggagatgaacaacaaatcccaacaaactgaattttattcaaatccacagcgattacaatggtaaaaccaagttacaacacaataattactgtattccagccagagaaaattgtccgacaaatcaattgcagcacggtacatctctgctagctctt

SEQ ID NO: 87132 - DNA, 1116 bp, Oryza sativa
cggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttgaacagcgccggtgtgtcgtacgccatacctgcatcaaatagattgatcagaaacatataactaattagttcaacataagtaataaatgttcataagcgaattactaacacatattaaacaagagtacaaacaaacaaaagtgtcaccatacggaatatttctaattacaacaataactgcagttacacgatatgagtacttagtccgaacactcatcacgataacattatgatacaacaccgaatagttcgcaatactactagtacaacaatagtcggaggtactcattacaacaacattcaattgaaattacacgatagaagtatttagtccgaacactcatcacatcacaacagcattttatttcctaaatcgatagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcaaccctttttcacccttaacttagatggatctggaatataaaaaacttgggcactcagcgttgtgtaagatcctgagatcccgaacccatatatctcctcactccatgtatgaaagattgcttctttcctaaaataatttgagacgtacacattgggagatatgccacaatcaccggcagca

SEQ ID NO: 87133 - DNA, 1232 bp, Oryza sativa
cctcttctgtgtacggctcccagatgacgtcgctcggctggagacggtcaaactcgaacacgaagtccgggtaacctcgtctcacctggacgtgagcgtaacgacgctgcaataaacatgatcggattagacatgttatgtgaagaaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacggaggaagggtgttggccggtcctaggtgtggagggcgcatcacctgttcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcagggtcgtccgccgccgcctcaacaagcctacaaagtggtagaaggcctcccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctgggtaccgagctcgaattcgcc

SEQ ID NO: 87134 - DNA, 1484 bp, Oryza sativa
caagtagtactgcagtagtaatagcaaaagtagtactgtttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagaggaagaggccccagtaccgaagatcccggctgcaaatcctgctggacaaggaccatcagtttcatacaggtatttaatagtattaataaaaagtaaagtaccgtgtgggcgagggatcgacgctccgtgagaggaagagctggcgaacacgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaacaaaaatgaactaatctctgggctgaactgtaccgtgcgaaaccggtgctgtaggtcgcactgctccgaaggtaggggcgctcgaaggcaaacgaggtcctgcgaggatggaacatcaagttacgacggggtgatgttttcgtacaaaaacagaaacaaaacttaagaaacctctgggctgaactgtaccgtgcgaaacaggtgccgtaggtcgaggtcctgctccgacggtaggcgcgcgaggccgtggttgtaccggaccagctggaggtacgacgtccacggcgctgcgacaggagaagacgcgcatgaccgcatgcatcttctcctgcatccggtcgaaggtcaccctctgctcaacgtcagtcaagtgcaaacctctgttcaacctcacttggactgcggtgatatcggcactgatatcccatgcggcatcagcctatgcaagatggaaataaaaaattcagtaattgtcctatattatgcaagataaaggaaataattgtaagaactaatacaaattcgacgtacccccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgcaaactgtccccgtcgagtcaacctgtgaagaaaggtaaattatatggctcgatgaggtaattatcataaaaatttagaaa

SEQ ID NO: 87135 - DNA, 1383 bp, Oryza sativa
ttttgtccacaaaagcttttttttttctttcgcacagacgtacagttgaaaataaattagtgaaacattattattatttttattatttagttaggttgcattcttgcattattgagatacgacgcagatggagatggcattacgagttcacaacctacacggctataccaactccatgaaatgataatgtggccagttcatacaccacattttatgggatgtagcgtacatgagtttttgagtttggctggagagaacgtgcacgcaagcaccagaacatcgcattataacgtaaaaagaagcaatgaaataattggcaaaagactagaataatggatgagggagtctacaacttagaagaatctcgaagtaatgttccagtcttacgatcaactccaaactgccaccactgaatcaagagtcaatatatcctcttccattgaccacgtcttacaacatggagcattaagtaaaaccatgagaaatccatgaatcgacaagaaaatggggaatttgatgataaccgcagaatttaggccgtcatcgttcatgaactaactcttcttacaaaagggactaaaaacatttaagatggaaaaaaatcccacattaaacaacatacataagcataagaatggcatagcagctacccaggaacttgatcacaaagtacatttctactcttagaacaacaccttcagctttgaaccagggaggatttttcaggtgaggcaattatttacaactagtgatcactgtcggcgaccttttgtggcgcaggaggaaaaaactccatatgaatagaatcaatccaaggctgaaatagaacaccagctactggtaatcagggttgaacgcaaggccttcttggtagattagatccttcatttgttcctcggacaatgcatgctgctcgaagtcaaagctgaagggtgatgagcagactggctcatcacttatgtcatgcagtgatgccaggtaaggatgtgcaagggcaccttcaactggataagaagaaataggagaaaagataagggggcattcagtaatatgaaacatgcagagaaaatcaggtcaaaagttttgacacagggaacaatgcattttcaacattagaaaacaccacaaggcaatgactctttcaacattcccacctatgagttaagaatgatgctcaattcacgcattaagaataaagtgatgacacacctataccacctggattaggttagggtggatcaagaggtaaaaaggatcgacatagtttttttttttaaaaaaaatatttaggtttgcatgtgatttagtaatatagaagtcatgcacagatgctctacaaatatatttaagtatccactgcagttgttactttctatcttaaaa

SEQ ID NO: 87136 - DNA, 533 bp, Oryza sativa
gcccgatcagctgctccacccccttcccgatcccgtgcacgatggtgccgttctggcccgtcgcctgcttcggcgtgtacccgccgaacagctgcgcgttgtagtcgttgcccccgaactcgccgagcacgaacagcgacttggacaggtacgtcttgcaagctgcacgcaccagcagatcagaatgagatgatcggagttcatggcggctcgccggcggctaggttttgtggggggggggggggattacatgacccccagatggggggcatgagctgctggaaccactggatatgggtgttgagggggccattgttccagatcttgtcgccgatgccgagcgactgaaagaagccggagtccatggtggtggcgccgatgatcgccatgttcgcgcctcgccggaagtcggagccgcccctcttcgacggcggcagcaacggcagcccgaacttctccgctgcaaacgcacgccaaaacagcagtgagcaaagcagagtttgctctgcttttttttggagggaaaatttgaa

SEQ ID NO: 87137 - DNA, 628 bp, Oryza sativa
atgaagataaaaaaaaagaaatattaagaaacaaatcaatatttaagcactttgacactaaaaggagattcatatcaatactcagaagtagatcctaggaacacaaagaagttaacataacctaaaaaaattcaaaaatatttttcaggtctctgctaagagtctctgactactgatctaaaactttatcttctggacagtagatattatgaaggcaatggagaatggctagcttggattttctatagatgaaaaacatggatccgcattctattacaaatggttgcagtgtatagcctttcaaacaaaggcttctgcgaatgagagaatgagagaattagggccaattgctaccagataaaagatacataacgttttaaaaaaaataaaaaaggaaataacaggatctagttaccacatgatgcctcttaacaccaaaatggaaattatattagttcattttaactttgaagtatactaggacaataaaagagacaaatgaaatgtacctccacatactgatgccattgatgttgaaccatcagaagccatgacttctgaatttacccgaactgtatatggaaattcacgcttctgggggaagcacagcgagcaatgctttctccgc

SEQ ID NO: 87138 - DNA, 2424 bp, Oryza sativa
tatattttactctttttagtatgctggccaaacttgtgatgccttcaacttaatttgttctattacagatggaaatggtttcaagacaagtacaatgagacttggtgctgatgttttagttttctcccgtagtggtggaaaaggtggcaaaaggttaagttacacttcatcttgacaaacatttaaaaaaaatcattttagaagatgctgctaacatgatatgtttacaattccctaacaaccaaaatttctttggacagatgagctaccagaaagcctgtgtagttcatcaaacttgaaagcaccaaatgatatttgttcaatttagttagcaggtcaaattaatttccctggtgtaatgcatggtcaagaatttgatttaaatctatattgcatgaccattgtgttctgaaaagcaaatccttttacactgtagggaatgtataatcatgaactctctgcgtttccagataaatcctttttagttagtgtatagtttatatttttctcccatatgaccaacacttagatattaagttaaccagatttgctatatggaaatgacaccattagttcaatcatcaaaagtgctattatgcattatactgaatttatagttttatcaacacaatgtgataagaattgataattggtgatcaaaattttagtaaaatactttagtttcttaacagttgaaacttgttcctttaccattgcacaactacatgtggcatttctttcattatttgttgtgtagttttgtagtacgtgcatacaattttagttattttcctttatcaagaaattgagacctttacttttcctttatcaagaaattgagacatttacttttgtttggcatgaaggcttacccaaagtgttggcatgctatcctacacctttctgaggagcaccaacaaagaggatattgttgttccaatggtaggattccttctttggtgcttttcattagtttcaaatttttaattttctctagacctttttttgccctcatataaatttttttaccacccacctgaagcatccatcctcattttttttgaatatttatgggaggatactaaagatatttcctgtcatacctttctcaattttgtcaactcatatcattatgcaagttaaaataaacactatagtactgaatggaggggatactcttggaaaaatatttatctggaaattagttatgtcgtgtgtaatgtctttaccttctgaattttcctatgtttatgtgacaaattcagattgattatgaaaatcaacaaggttggaaaagaaagccacggactacatttgctgattggaacacaagcttacagactattattacatggtcgccatattcaactgaagcagaactacttgagcaggtataatttatgcaagatcactaaacaaatatgtatttctactgtaattatcaacatgattattggttcagttgcttgaagtttctttgtcatgacctttcctttcaaaagaaaagggcatctgtgcatactcgacaatggaagatgtttcctggagctgtctatattttagtttcccatttttagaaacaaaaacatattattgcgaacctcagcacgttccaaatggctgtttattttgcagtttagttctataaaggaacaagggactcgtattatcatttacaatctttgggaggacgatgaaggacatttggagcttgattttgatgaggacatacacgtatgttctactactaagtattaataacactgtgccaccatgcgcaccatatattttagttaagcagctagtaaggtttttaatgattgtggaatgacaggatattcaactcagatgtggcaatcgtgatgagaaaaatatcctgatggctaagcagtttccgaactccaagcatttcctgacttataagcattcattaaaggtaactttatagtaccttttgaattgaatatgcttgatgtgttctgatggtgctgaattttgttagtattaggctattagcatgcaatgttgcctccatttgtgatttatgtggatttcatttatgcagagcacattattctatttgtgccatgcgataattgtttgctggcccagtcagtcatgccagttcaaaatgacttgagtatcctttctgtgcaaagctatgcatccattttatatctccgagttccaagttttttccaaatgattttacgtggaaaagagattgagcaccataatattgtgactgacatgatgttgaagaaagaggtgaaatacaagccggttgcacctaatggtgttccaaaggattcaaatgttaagacctgtaacctcataactctttcctgaatactgaggatgtattgatagctcattactgatcaaaattttcttctgtatctcagatggtagccgatgtaacaa

SEQ ID NO: 87139 - DNA, 1446 bp, Oryza sativa
atgtattatttgttgaaatatgtgaactttgtttcttttagcctttctggagagtgtggactgccgctggaagtggtgggcgtggtgtcataggtaagtgactatgtggtttggtttcttctattctatttattcatccacttttggttctaggaatgactgacttactctgcacaggtgtactggaagctaattttatagagccagctcatgataagcaggactttgagagaacaactcttctagcaagacttgaagcacgattaattcaaatgcagaaagactattggtctgttttcttgtcatttttcttggtttacttttgtggtcacatgtcacattatcaattctattgtaggccacattttggcttatctattagttagagatttgattctagttttcacatgcccccgtctctacttctcacaggtcaggaaatgctcatcgaattggatattctgggacacgtgctggcagatccaatgaaacagaaggtaaatgagccatatgattgttcgacattgctatggctttatagtatagatatgcaacttagtttctttaatattttgatattttgttattacttaccttgagtaacaaaagttaatagagtatcaaagttaacatcttaaaaagtttgtaatgttgcttcatttgttgggtaattgggttttcaaagtgctgcgttccttttttgactctctcaagttctgtcaggtagtttgtcacattatgtcaattggacataccaaaatggataatagtatgcagaggatgttggatcgaaatgatttcactatgagtgtccaatccatttgtgcaaattagatacgtttcccattgaatctctttttcttatgctcaaacaaagcattctgtttctttactaacagaaatgatgaaaatatacaaaaataagcatgacacattgtgtgcagtgcctgtcagtggaacttagatgacacagtatccttggtgtaccccctgataacatttcacttactaaatagaaaaaaatgatatcggaaaaactcgatggggaacatgataactttagagtttatacatgcggttgattagataattgacaatagtttttagtagagtcatctgtgtaaagacaaggaataatagccctatttcaccttatcattcttcttgtgctggtaataaggaggccatatattggcaaacatatatgatttctgaatggtgttcatagatatgaaacatcatcataaatgcaatttcattgtgcactccatcctgagcacctgtgtttttaacaagtattctatagatatgaattggtgtgcacatccctctgctaaggcttgcttatccccgttacgaatatgtgatgatcgaacttatttatttgccttcgatcactaatattaaaaaatgttgtgtaattttggcattaggggctgcaggaat

SEQ ID NO: 87140 - DNA, 3738 bp, Oryza sativa
ttatgaagaaaaactaaagattaaaatgacacctcagaatggatataggtgtgatttcttatagtaccattttaagttccaacattgatttttccgtgctccgttttgggtcgttcaaagcgtcctttctctatgagtaactttgttctcttgatcatcagaggataccaaagactgggcgaaaatattaccaacggtaaacctgacatgcaggaagcaattgatgtaagtttatttttctttctttatttttagtgacccattaacttgttactagttaatcgctgagaagaaaaaacgtcacagtattatgcgcctattgaacctgataaatatggagatcttgccaaaccaatggaaggaactaatttgtggtatatttccaacctttcatctttgtttattttcattttataccttggcgctatattatttggagccctttatggaggtaagaggtactgttatttaagttatgttttgtgttataaaatatatatttgcttatctttagtaataaaatgacagtaaagaggaaaacattaatgacaatatatagaaattaataattgccatacatccactagaagaaacaaaattaattcaggcaaccatgaaaagtgtctataatagaaattttacttgaaatatactagcaccattgttttcaaaactcaaaagaaaatcttaaaatttgaagtggttcatatgtttaaagaattacttaaaattacataacaaatgattgaaagtttgaaagtgaatagtgtctagtgacgattattatcaaaacgggtggagtagcaagtgaaaaatacttttttcttcatacttcaagatctattacctctaaatgaggaaagagaaatatcaatatgaaatgaatggcctaaaataatccgggagtactataacaaaagctcatgttatttaacatatgtgagagatattgcttgcttgactttcatataaaatggtaccacaattctacttattgatcacttactatgcattgataataattatgataatataattaatttagcttatagcacacctctatttggaagaatgaaggaaatgaatttctaatttacaatatattaataataacaatatgtatcatgttatgcaatatggctacaattgtgaattatttgttgttgcatatgttgcttcaatataatgtattgttgttactagaagcattttgaatagttgaattatagcattccatgttatatattttgatactactagttgaattactttgctattactgaagagctgttctgaacttaatttggtacccttcccttgagtacttttggttagaaatatttcaaattcaattaaccatatcatttactttgatgcaggccaaaatatccatcaaattttgatgcactactaaaaaactatatcagccttctaagaggttcacttttgaacttagtttagatcttagctatgcatctatgttatttatccttttttttttctgatggaaattttacttatagatctttccagaaagatcatgcaaggtatagccttggcattgggtgggccagttgatgcttttgaaggtagaaccgcaggagatcctttttgggtttgcaggttgattggttatcctgtatcaaccgatattctagaagagcatcgcactgacactggctggtaagcaaaatgtatctatgtatttatttggtagtatattgtgctagaatgtacttactagattcatctgacaccgtttttctcttatgtcacatccgttctgcgatcaattcagtggagctcacacagactatggttagtacttagtacatatctttcagaagttcctttcgaaatagacttttatatatggacaacacatacataaggtgctttgatgcattgtaaaaagtttcacgtgttttctgtatttctgtttatcaaactcatgaagatcatttttgtcatttgattatattacaggccttctgacattggttaaccaagatgatgacatatgtgcccttgaggtacttgtttcttcaccatccatatatcttataggaatacatgctttctttgtgtttgaatattactcaagttccactttttaccctggacttaaaactaatcgtttttactagaaacctagactaatatcatccttgaccctgtttagatattgtttctatcgaaaaattggtggttttactttatgtagactcttatttcgcacattatgtctaatactatataactatatagttgatcctcactaagtgtagttaatgctatatattttctatcatgtagttaatgctatatatcttctctctcattaaaccacattacctcaattgtttttaaccacttgaccattaacctatggtactatgactatatagtttatccccactaaatctagttaatgatgtttctcttctctctcattaagtcacattaccttaattgtttttagccattggattaatctatggtccaaattgtctcctttctttttcttcactcatgatgcttcaccttaggttttgccttaactcattgaatgatcagtatatattcaatctaaattatcataacgcacatcatctcaattgtttatagctcttttcagagattgattagagatgaagttatacaaagtatataaacttatacattttgctacaaaataaattaaacctatactttatttctatcattatagcataatatttccatagcaaagcacgggatttcatctagttggcataatggttgtgtacatcgatgtggattttagggactggattgttatcctttatcttaaaaatgttggggaaagtcatcttataggggaccaggcattgataggatcagaaatagtatttgtgtggatctggaaaatgtgtagtaaaaaacaattattttacggagcaaggagaaaatgggactacaagaaaattaatgggccacccaaaatggactttatcctatcttatacttactcatccatgtcgtgctctctgttttatgtgtccctcaaatttgttgaactaatctttttagtctccctattccttgtgatatttgttgtacacaattaacatttcaactaaacatgttcttctatcccattgtgcaattcacgaatgagatcttggaagccacttaatcttgcaccggaatttgatctcatagtagtaaccaaggtctagtttcatggccgcaaaccagaaaccataaattcggatccatgccatactttatataccgatcttcactaggagtttgtttactcgatgattctcatctttgaaccattgtgtttttctctattctaataaggaaaaagtatgaattacctcccctcaactattgcggtcggccgaattatacccccaaattgaaataccagacattataaaccctcaactattcatacaggacaaataaccctcctcaacactgttttgagcggttttgacttaagcttgcacatgtggtgccaacgtttcaatctagtcagcaaaaaaataaaaaaaaactccatggggcccacctgtcataccctccctcaatccaatccttccctagtggttctctctctcgcacacgcgctcgagcagcagctacagagcccatgaaggaggaggcggaccggatggctggtgacggaggcggagcatgcccgggcggcgggcaactgaggcggagctctttcagggactagcc

SEQ ID NO: 87141 - DNA, 2081 bp, Oryza sativa
aaagtttctctcccctttgaacttggatttctcttccattgtaggaccattgaaattttagtaagtgaaagcacaaggaagataggaaagaagatttgaaaaacaaacttttaataccatttatgcaaaaaagaaagattgttttaaacttagagggagtctatgaattcaaaattgtgccaaggccaagattcatttagaatgagatctctagatattagatttcaaatttatatgcattatcttgcgagaaggctaacgggcgatcgatcgctgccagtgattgattttttttcttttcctcttttagtaagtttatacaactaaagtttacacatctaaagtttatccacctaatgtttgtaaggcgaatgtttataagtcaaaagtttatatacccgattcaaattcaaattcaaattcaaattcaaatatttttatattttcatcttttagtaagtttatacacctaaagtttacatatctaaagtttatccacctaaagtttgtagagcaaatgtttataagtcaaaagtttatatacccgattcaaattcaaattcggattcaaatattttatatataaaatatttctatacataaagtttatgcgtgcaaagtttaccgtataaagtctatgcacatgaatgagagtattagagtattagagctaatcacgatggcgactctcttctctggcgacgtccatggcgactctctctagaagatggtcacgccggcgccgcctactggatgggatttctccccgggggattccatccgcgatgaagtttggagccgttttggttcaccggtgcacttttcctctcactttagtcgttctccttttcgattagtggttgatgttcctcgttcttcgtttcgattgaccttgtcctcggtggcgcttgctcttagagcggcgattggtggttctccgtctgatcttcaagttgatcctttgattgattgaagttttacttttgtggtgtgttctaagaaagttggactctggatctactctctcagatccttttcttgtaaggatttctcggttcggttttttctctggaagaatggaggtcctgattggagacaagaatgggatctctggcaagctgagcaagataatgaatggaccattgtaaagcggcgatcttctttgggtaatcgttctcagcatttgataaaggcttcttctgtttttgatcgtcttaagtttaatattccatcatctccgaagaagattgctcagaagtctgattctattgtctccaaggaaattgttcttgctaattctgatccgaaaggtacgcatcttgatcgtgataagcggaattcttccttttcaaatttaaaccgatctgggctggtttgttttcgttgtttgggctctgatcaccttatccgggattgctgctcggaggtttgatgtttgcattgtaaaagtctgggccatattaaaaagttttgcccttctgctgggcctgttaagtctccctggcccaataaagtggtgtttgctaggggcttgggaaaaaaactgtctgtcccaaaaaagaaggagcaacctttgcgcattaaaactccacctaatcaggtctgggttaaaaaaaaaagaaaccccttcatcttctccggaagttgctcgctctctagtagtggcgtcagaatcgcaacctcaacgtaatccttcccctgctccaatggctaatactaaccctaatccccatcgcttcctgcgtgtggggcaagtggtacatcaaggtggtgatcgtgtgccaagaatcgacctctctgctgctaccaagccgccaaggtctcatgaagaatatgccattgctttggttgagccgatcttgccggaggaactttgggatgatcatcggattctaatttctgaatacattgagcaggtgcagcactttactgttcgccgtagttttcctcatgcttcagctgtgggtctgttcaagtttggttctgccatgcttagggacctactagtttatgctcccccttttatgtatgatggtataccccaggtcaactttgtcagacatgatcagggtcctaactgg

SEQ ID NO: 87142 - DNA, 7221 bp, Oryza sativa
cagacagtgatgattgcaaggaggtggcagcccttaatgcagcaactgcagcccttaatgcagcaactagtcaagtttcatcttctcataccagtggtctgaagccaaacaagaagagtttcaaaaagtgtgggaagccaaagaccttgcctcaatcacataatgataagggtaagcttaaggcaaagtcatcatctggattgcatgatgatgatgatattgatgtgctgatcactagtaccttggttggaatcaaagataaccttgccaaaccaatacagactgcagcccctcaagatccaaatgcccctctatgggacatgctcaagaagattgccttagaacctgaagataaaatgagagttggactacacctttgcaagccagaatttcaagctcatcgcagttttcttattagcatgggtcaagaatatcttgaacgttgggtttacaagttcttatctggtgatgatacaggcctctagtgagctataggtgcatattggttgcaaaagctaatcgtggttgatgagggtctatattttgctgcacccttttggtcatgcaattgccgcactatatatgtgtttagacaattgctaaatattaacatagatactatgatgatgcatgctgtgacatgctaatctgctagtagtgttgctttctaacttttggacaagttgataaccctagctttgtggcccttttcttttgtcttgtttaactcgtggcattactggctagaactgatctgtatgatggctgaaacttgatgttaaatatattcactatttccctgttgccatttgcatgtttaacaatatgtgatgcttttatcattaggaaatggaagatcgtttgacaattgtttggcaaaatcttggtagagggtactctcaccatctacatagtatacggtgagtgtatgctcaggcagaatataagccaaacactgcctaacccttatgtccactcaggcatgttctcagggcttcaaccaaacacctccttaaatttgtgtcatgcctggacaggtactttctgcaagcaagctcaggcagccctcagggatggaaaatactcaggcaggttgctcagggtagcaaccaaacaggcccaatgtgactagtatgacttcaggggtgttgtggggaaaaatatctagaaatagccatcccccaattccccttgtcgtggggagccccccaagctgtgccactgcgtgtcagcgggagcagcgtatcctcctccacctttgctgctgttggtatttcttaccgatcacagataaaatccgcaagcgcacggatataccgatatagcacttcccctacggagtattccaagggtatcgaatccaagggaacgtgtgtgatcagatcttcctctggttcattcaaggacaccaaggaaatgataggccaggatagagaggatttactggtgagaaacaatgtctagggaaagcttaactttaatcttaacgtaatacttcaggcactggcaatccgctattcccagatgtcgctatagtatgtacctggacagagaggacttaagtgctcttgagggctgtcaccacctctacacctacctcaatcgaactgtgggatacgcagcaaccactagaaattaattacccagacaccgcgtctacgcaattaataactactctagtgccaagagataattctcacaagatgtatgctatttaggaactaaccaagagataattctcacaagataaatctaaattactcaggaagaatattatattgaattcagagtaataaacagaataaaagaaatgagagaagattaccgacaactccggaattcttccgacgtcttctactctactctcttcctattctagtatacaatatagtacaatagagcctcttataattcagctcaagcttggaagtgtgtgtgagagtgaaggagtgaagctccttttatagggcagttatgacggttgtgagaaggggaaatgtccgaactgccccgcaaccgccatcaggagatcatctggagcgtccacgccaaaccctaggatcaacggtgatcaggggggttcggccgaaccatggggtacagccgaacctgggctaggccctcccggcctgtggactccctggactctcctctgtccatttctcggagtttcaggttgattttctggtattttgatgaagttcacaacccatccttgtatggatacgtaattctcctcactttagtctagatttcctcccaaccccagggtttatcacctgcatataaatatacaccaacgcttgtggaatttgtaaggttaagcacctatcactatgttggatgttttattatctggacttttatgcagatgttggcggtatagaatcgacatttaatagctgccaacaaaaccccccacacttagctctttgctcgtccctgagtaaaggttagtgtagaatgaattcctttaagatataaatcaggcatataaatcattcacaaccatacctgcacctgtgagctttaccagtggctatcttaccatcttgagtaattgataaatggaacgatctcgattccagtccttcttgcttcccctgtcaaactcatgtgattttttgatgaattttcacaaaccaactcctttccttatattgactctctctctctctcttatctctcatggatgtatattttctttttggatcctcaccaaggcaaaatgtgccagaatttacccctattctaaggctgatatgtggagctcggtagggacaaattgtgacatacctgcatcatatatattgcaaagccaaaaatacggactcaaaaagatcatcagtcatactcctagataaagggtctttatttgtggtagaaaatggaaaagtaaaatatttgtggaatggtggaataaagaaatgattatcccttttttttatactttctctccattttgttttcttggcatgaatatggaaggggcatggctatatttccttttcatcatgctcaatgttttgaaagcaagctttatttcctccccattttttaatagccatgcctttcctcccttttctcatttttcttttttccaagaaccttttttttaggagaaggaagcatagtctaatgtaggaagttatttgaatggaatttttgtgggaagccaacttccagtgtagaagcttagcttaattatatttggggaaaatgaaagtggaaatgaccccttgatcatgagagtatgaaaaatatctaacacgagtcacataaatttgacaaagctcattataatgtcaagtagtcatatgcataactaggggattccccgtgctttgttgcgggagttactaagtaatttttaatattatttttcgttacaattcagctatgagtaaaaaagaaaaaaaaatcaaatctcagagcttatcaatatttatcgtgaaacaaatgaaattcgcactttaatttagaacatgttgataagtgtatattaaatattataaaaaatgaaagagagatttgtaaaactattgtggaaatgatgtgagaggtggtgattgaatatgcttacatattaatttgtagaattaaatagattatagatgctcttgcatgcttgcatgaggttgaatatgtaattattgttagtgggtgatgatgtggcatggttgcatgttaagctttagagttagtgggttataactttatagaaagtatagataagatttatcaatgatatacttgcatatggccttggtaggtataaaatgaagtcaattggaggaatgagattttaaaacaattttattttgaaaacaaattcccaaaagtcaaaacaaaagttgcaagaattcctttcatctttaatcatctcacataaagcaatcacttagatgcataagggtccataaacatggatggttgttcacaagcacaagttcaactgtgaataatgaatatacaagatcaatcatatgaagaatttcattagttggaaatttttattttttcaattatgcttgaaccaattgttttctgaattttcagctctatactataccatggtggagatatacagataaaagatgtgctcacctgcttacatgtgaaaattaagagggattggggcagctttggttcagccgaaccaatctggtgcccattccctctgcaatttttagtagagttcagtgcttccaggtgttcagaaattttagcaattttcagagtatgcgcacgtcagaagctgagatatctcccccacacttattcaaaacctgaactttattaatcatgaaacaaaaacaaactcgacatgcattggggttaacaccaatgagccacattatttatagcaagttcttacatgattggaaaaataaaaagccagcacttactactattttattcatgtgagaggagacatctaattagcataatacttattctcctttcccgtttcttcaaatgcacacttgattttagcgcacaaaccgcgactaagggtatcaaaattattcctaagttcagcaagttctacccctagttccgtgttgcgatccctaagctctatgttctccttgcggagtttcttcacttgggcggcgagcttatgaaccgagggctccggtgatttcactttatcttcttggaattggccggctgcccttacaattggagggggcatcaagtgacgcttcaccttcataggtggagggcttctggattccgctgccccctccttctccgacgccgtcaaaggctgaagtaaacccttaccatacccaccgccgggagttcgcactccctgaatgcaaaaccggtactccttcggagtggatggagtagcggtgggtgtgatatatttgtggagcacttcatcccctgccttggtgaacagggtgcccacatattgctcggcgggaggcggagcgatcttctcatcatcctgaaaaaggcggcgtgccttcaagagaccgagctctcccgttgtcggccgtcgcgcaggcgaatccccccggattttggtcttcgtgacatggcgaggagagagggatcgtgctactgaacaggggaccgaacggggccgaggggggttcggccgaacccttggtttggccgaaccagggagctcgccgacgggctccagattcgcgcacgggagcccgacaccgtagcaaggggctgcgcccacagtgcattcaccccttccattgtatagtgttccactgggatctattgtttcgccggtgttggctctccgtcaagattgtaggtagagttggaggaggagccaatgtatgggatcaaggacttgccagccattggtgaattggaagtgatggagcaagggaattgagatgagatggagaggaggattgcaaaagtgggagagaggaggaagaacaggtgctctgggtctgatacgactaatctacctccgaaagctcatcacaacggactgcaaacgagcgggggagactgctattcaaagttggggctgatcgggtgccgcttttatttggctgaaccctggtgggtccgactggccgccaactttttcctaggcccactaaatcctaagctaagcacaaaaatgacaactttacagggttttaagcatgcattagatgagatcattatggttcataatcgattaatacaataacatccacttattcatctaaagtttcattgggctcaaggaaaatctttaagcgttgaccgtttaccttgaatatattacctgagtcgtagcggagtgtgattgccccgtgcgaagaggtgtctatgatgtcgaacggtccttcccatttactgcgcaatttttcgtggccgaaaagcttaaccctggagttgaacatcaatactttgtcttctggcttgaatttcttgatttttatccttttatcatgccagtgcttcgtcctttctttgtatatgttcgtgttgtgataagccttctctctccattcttcaagttcagcaatttgcatttttctccattctcctgctccttcaaagtccatattccagttcctaatggcccaatatgctctatactcgagttctacagggagtcggcatgatttcccgtagactatctgataggggcacattccaatgggtgtcttgtatgctgtccggtatgcccacagtgcgtctggcaatctatccttccatcctgttcccatattgttgaccgtcttttgcagaatattcttgatttgtttattcgatgtttctgtttgacccttggtttgtggatggtaaggaatggccacattgtgtttggctcccatatctcgtaggaggtctcggaaggttttgtcgatgaagtgagaacctctgtcacttatgaccatcctaggggtaccaaatcttgggaagatgatttctgtgaacatctttttggcatgcttcgcatccacggtgttgcacggcatagcctcaacccacttggagagatagtcgactgccaccagaatgtactcgcagttacgggacttagggaaaggttccattaagtctataccccagacatcgaatatttcgacttgcaaattgtatgtgaggggcattgcatcacgagtagtgattcctccttgcctctggcagcttgtgcatcttctgacgaattcttttgaatcttcatacattgttggcgagaagaagccactttgcgcaaatcttaccctgggtgccgaatgcaccataatggccaccatagggtgaggcatggcatcgctttatgatcttaagtccttcttcagtcggcacacatcttcttagtaagccatcggtgcagaccctgtataggtatggctcatcccatatatgacggtgactttcgtacttcaaatttcgttgattttcccctggtggtatgtatttggataccatgtaattcactatggttgcataccacgggttggagtcgcgaaccgtcatcagcatgtaatctctcaagaagtcatttatcggttgttcctacgtgtcagtgatctgcagcctagacagatgatctactacggaattttcaactccctttttatccttaatctctaagtcaaattcttgtagcagcaaaatccatcttaagagacgtggtttagcatctttcttagtgagcagttactttagagcaacattattagtataaactatcactttagctcccaccaagtaagatctaaacttgtcggtagc

SEQ ID NO: 87143 - DNA, 3149 bp, Oryza sativa
aaccgggacttaaagatatttttccgctattttcaaattctttttaaacccggttagggttaagaaccgggactactgataagcgcactgaatattattttccattacatatgtgtttctaaaatagaagataatgcattacaattatttaaagtacaaagattaatgacaaatacttcgaaaaattattgttgtctgtaataaattaagtggataaaacgtaactcagcaaatatatgatttaaaattaataaaaattctaataatcatatatacttagcatatgaatgatattattaaattggtaaaacctctaattaacatatgtatatgcatccaccatgttttataattaataaaattggtaatcatcatatatattcttagcataggaattatattaaattaattgttaaaaactctaattaatatatgtaaatgccacatgcatgatttaaaaattttaaaaattcggatagtcatatataattagcatatgaatgatagtaacttaaattgtgaaaaactctaattaacatatgtaaatgccacatgcatgatttgaaacttttaaaaattctctagtcaattataattagcatatgaatgatagtaaattaaatgttaaaactctaattaacatatgaaattgccacctgcgtgatttaaaacttttaaaaattgtaagtatcgcatataactagcatatacatgatttaaacttgttaaaacttctaataatcgtgcgtaattaacatatgccatacatcaattgatttatatggataatcaatacactcaaatagtttacatcgtgtacacaataattacggcaatacatcggcggtgacggttgaccgcacgtactttctcctcactattgttccctcattgtgatcgctacgtgagtaaggggtgtcttcatttgataggaggatgctagggtcaatcgtcaccgtgaaagggggttgtccatccaactgatcgtaatcctcgtcagtcttgtcctcaactccgacgatttttcttttgcctgggagaaccacgtgacgcttaggctcgtcaggccctctgcccttctttcctttgctatacatgtccttcacgaaaaagacttgcgttacatcattggcaaggacaaaaggttcgtctgagtatccaacgttgttaaggtcaaccgttgtcatcccactgtcatcaatcattacgcctccaccagtcaacttaacccattggcaccagaacagagggaccttgagaggaccatagtcaagttcccatatgtcctcgatggcaccgtaatacgtgccagttgttccatcgtgtcccatggcatcgacacgaacagcgctgttttggttcgtgctcttcatgtcttgggctctcgtgtagaatgtgtacccattgatctcatatccctggaatgtcgcgatcgacctagacggtcccctcgccaggaaggcaagttgttggttgatcgactcgttacccatgagatgttgtcgtatccacgcggggaaagtatcaatgttcctagcgcgaactagagccaagtgctcctcgatgtaaggagctaccaatgaagattgttgcagaaccgtgaaatgggctttacggaataaattgttgtctaccgtcattattgctttccttccgagagttccctttccctgtagtctcccttcatggcgtgattcaggtaccccgattgggcgaagatcttcgataaattctacacaaaattcgatgacctcctctgtttcataacccttggcgatgcttgcctctggacgagcacggttacaaacatacttcttcagaacgcatgtacctctcgaaaggaaacatgttgtgtaggtacacaggcccgaaaatactgatctctttcacaaggtgacaaagtagatgcgtcattatattgaaaaatgaaggtggaaatatcaactcaaaactgacgagacattgcaccacatcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttttccttcgtgcttattattcgcttgatattcgtggggtatccagatggtacctttatactctccaagcattcaaacatactttccttctctgccttgctaagagtgtagctggctggactcaagtaatggcttcctttctcctttggttccaggtgaaggtcgccgcgttgttccatatgcttcagatcattacgtgcttccagtgtatctttcgactttccgtgtacacctaggaagccaagaaggtttacgcaaaggttcttagtgaggtgcatcacgtcgattgcgtggcgtacgtccaagaattcccaatagggtaactcccaaaatatagagttctttttccacatcgccgcgtgaccatcttcgctctctatagactggcttccaggcccctttccgaacactacttttagatctttaaccatagcaaacactgttttcccgttgcgatgtttaggcttcgtacggtggtcagccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagtgctcgtatgttaaactcctcctgtttgtcctcgtcgcacacggggacaccttccttcttccacaacatcttaagatctttgaccagtggccttaggtatacatcgatgtcgttaccaggttgcttggggccttgaataataatcggcatcattatgtacttcctcttcatgcataccagggggggaggttgtagatacacatcgtaacgggctaagtgctatggccgctgctcatctctccaaaaggattcatgccatctgtactcaaaccaaaccgtatgtttcgtacgtcctttccaggggtgca

SEQ ID NO: 87144 - DNA, 1194 bp, Oryza sativa
taaaggcttggtgaaaatgtcggctaattggctttcggttctcacatgggtaaggcatatgtctcctttagtctcataatttctcaagaagtggtggcgaatgtctatgtgtttggttcgagagtgttgaacgggattattggctattttgatggcactcccattgtcacataggagtgggatcttggtgaagttgtagccaaagccttttagagtttgtttcatccaaaggagttgggcacaacaagaaccgacggcgacatattcggcttcagcggtggataatgcaatggaattttgcttcttggaggaccagaaacaagggaccgtccaagaaattggcaagtcccggttgtgctttttctatcaaccttacacctggcataatccgaatcggaatagcccaaaagctcaagtcacaacccttaggataccacaagccaagattaggagtatgaactaaatatcttagaattctcttgacggctatcaaatggcactctttaggctccgcttgaaagcgagcacacatgcaaacactaagcatgatatcgggacgagatgcacataagtaaagcaaagatcctatcatggagcgatataccttttggtccacacatttaccattatcgtcgaggtctaggtatccattagtaggcatgggcgtcttgataggtttggcatcctccatcccaaacttcttgagtatgtcttttacgtacttggtttgagagatgaaggtgccctctagtgcttgcttcacttgtagcccgaggaagaaggtcaactcgcccatcatagacatctcgaaccttttagtcatgatagtactaaaatcttcacaaaaagatgaattagtagaaccaaatattatgtcatcgacataaatttggcatatgaataaatcactcttaaattttttagtgaagagagtagtatccgcctttccaatttcaaaaccatttttcaaaagaaaatctcggagacattcataccaagctctaggggcttgtttgagcccgtagagcgccttgtggagcttgtacacatggtttggcaactttggatcctcgaaccctggtggttgctccacatagactaactccgagataggtccattgagaaaggcactcttgacatccatttggaataacctgaaatcatggtgagcggcataggctaaaagaattctaa

SEQ ID NO: 87145 - DNA, 1555 bp, Oryza sativa
ggttcttcctctcaacaatgccgttttggggaggatcatagggggcggagaactcgtgcttgattccttcttcatcaataaattcttccacttgagtgttcttgaattctcctccattgttgcttcgcaccctcttgatagtgagatcatagaggttttgggcttgctttgcgaagcgcttgaagacatcttgagcttcgcttttgtcatggagaaagtacaccccaagtgaagcgtgaaaaatcatcaacaatgacgaaaccatacttgttacctccaatgcttatgtaggccacggacccaaataaatccatatgaagaagctcgagcggtcttgttgtagtcatgatgttttttataggatgtggactcccaacttgcttcccggcttagcaagcactacacacacgatctttctcaaaagaaacattagatagaccaagaatgtgttcccttttagaagagatgccaaattcctcattccaacatgggctagcctacagtgccatagccaacccatagaggatttagcaatcaagcatgcctccggattcactctatctacatcgaaatcaacgagatagagatcactctttaacacacccttgaatgctatggaagagtcatctcgcctaaaaatggtcacatccacatcggtaaacaagcaattaaatcctaacttacacaattgagacaaggataataaattgtagcttaatgaattgacaaggaggacattagatagagattgattcttggaaatggcaatcttaccgagacccattacctttcctttaccatcatctccaaagacaatattttcacgacttccaccctcctcatcaagacttgtaaacatactcctctctcccgtcatatgattggtgcagccactgtccacaacccaacttgagccatcggaggagtatgcctacaaaagagatcaagcttgggatttaggaacccaaacttgtcgaagtttgggtcccttgatgttagtcaccaaagcctttggcacccacacacaagtgcggtactcatcattgtaattcccattaaaataagcaaccactttgccctctgaatttttggaaattacatatgaatcatagtaaagaccctctggccagaacttcctggcattataaccggaacttccggccagccccttcggcctatcagaagcccgaaacttcctgacaaaatgtccggaacttcctgtcttacagggcaggaacttccggtcattttgcccggaacttccgggtgtctgaccagtgaggggacaagtcacctcacttgcttgtggagcttttccttctcttacaaacatcaagcattctttcccatttatcatcacacgcttagacacaggacttccaccagaaaacctgagcccgtgtccatccttgttaggatgagcggtgatggtcttgtaaagggcatcttttgaatggtatgtcttcatacatccatatttcaccaatgtgcccaacctttcattttctttcttaagagcttgcatagcatcaacattagtagcatgagagttcaa

SEQ ID NO: 87146 - DNA, 1907 bp, Oryza sativa
ctgtggcccaaacgtccaactgcgcatggtgcatacctgcaagatggaaacactgctgtgaagcgtcgttctcaacttgttatcctctgtgaagaaatgaatgttaacgggcttcataagttcatatcagacaatcgcaaagacttaacatccatccgtgaggaaattcccgttgcacttaggggagcaactgatccatatggcttggtgttagcttctctagaagacttctattttggagacaatcttatattggatggtaaaaaggatggaaactttctgggtgtacggaggacgtgcctcatgttgatggaatcacttgctcagctgcaaactgatgctactactggtttcatatcaaaaggccaaatgcttactgctagtattaaggagagagcgaaaaagatagcgcttgagtggaaatccaagttggatagccttgactttgatgctagcaatgggaactgcctggaagcacatgcgtttcttcaactcctggctacctttgctatattttctgaatttgcggaagacgagctgtgtaagcttctcccatcagtcagtcgtcgtcgccagacacctgagctttgtagaatacttgggttgtcacagaacatgccaggtcagtgctatcatggattaatcatgcacctagttccgttatgtattgaccataggggttttctatttgtcattgtcactcagattgctagagagcttattcttaccacttcaacatttgttcatatatgaatagactatatcattggatttattttctagttagtggctgcagcgagaatatacctagaagtaatcaatattgcgacattgctgtttagatgatttatatggaaaatctgaaggctgctacttatgttttagtggctgcacatcttaaacccactatctagtatctgtattgttcttactggcaacaaaattcgagcagcttctaacgctgcgttcgaattatggactttcctctcacgcacgaaaaacgagggtggtttattagcgcataattaattaagtattagctaaaaatgaaaattagattaatatgatttttaaagcaatcttcctatatattttttttgaaaaaaaaaacataaagtttagcagtttgaaaagcatgcgtgcggaaacgaggtagtataagttgggaagggggaagaaagaacaccctaaggctgtgtttgatacttggggttgggaacccaactccaccgcacggaaaacggagcggtccattagcgtgtgattaattaagtattagttaatttttttttcaaaaatggattaatttgtttttttaaagcaactttcgtatagaaactttttgcaaaaaaacacaccatttagcagtttgaaaagcgtgcacgcggaaaacgagggaaaggggttgggaaacttgtggaaagaacgcagcctaagcatgctagtgcatggtctaaccagctcaattcaggactcaggagatcttaatgtcacaggatgttagttactaacttccgaataatatatgtaattgcatatagtatatattggattatagcaagctaatacgactttattcaatccctttttggttgaatttgtcctcccgtttgattatttactgggatgtgctgttgtgcatctcttttagaaaaaaaaatacacatatatgagtattatggttaatgttatgtagtggcaaaatgcattagaccttaaaagatgaatcaatcaagagttggcaccgacatggttttgaaatatataaccgtggaattgaacgattcaacttttatgctggcgctgatttacacatctatcaatttgcctaagattttaaactttctcaaagagttgtacagaagcaaggccctagttcgtgatatgttgttacagcttgtatagct

SEQ ID NO: 87147 - DNA, 525 bp, Oryza sativa
taatgaatatgatgagctgttggacccatctgttttcaattggttgatcaacttttgcaggaaggaatgccattgcatgctttttcttacccccgacaatgactttgctggacaagaccaggcatgctcctttttcacaatgttttcttcacagataccatctagctctccgttgtcattgcatgaacgtcatttctacaaattcctcaaagtaattttatttttccttatatatactctatgcatattgcaggctataaccttggaggagatcaaagacgcaacatcaaagatataacctcagtgcaccttttcttccattattctgcttgacaccagagtttgtatatgtagtctctgtaagatgacattctaccgatgaaatcggtcatgataagatgtgtagtaaacaacaatttgtcgttccttagctttcatgttcttgcttttgaacatgggaaaacacgctcccactaatacaacagcctattaactacgcacttgatacaaagcatcatgtttgtt

SEQ ID NO: 87148 - DNA, 536 bp, Oryza sativa
gttcttacatgttttctcatggtcaacttattccctgatcaatctcccgaaagattactgtttggattccatgacgtctccatgaccaatctcaccattgccatgctcgtgatcgttgccctcgacgacgaagagatcgcctaactgctcgtcgttgatcagagaatcaagaaacgaggagaagtcgtcgtcacccaccatggcggaagcggaacccatgtcgaagccaccatgaactgcatcctcggcacagaactgatcgccaaatcctccttcgaatccctcggcatcggcggcgctcaccatcgctgcgaagtcaccgccaccgtcggccggtcgggcacgatcgtcgctgcactcaatgccagcggccggcgaggatgccgtcctcggcggcttggccggcaccgccttctgtaagaagtggcggcgacggcagcggcggcgtttgagtgatcggcggcggccgtcagcggcttgtgcgtccgcgggtcgatgccctgcgcgatgagcttcttgctgagatgcgagttcca

SEQ ID NO: 87149 - DNA, 2305 bp, Oryza sativa
gctagtgcagatgaaccttattcctccaagcaaatagaagaaacaagcaataacaatataaaagcaatccgaattgcaaataggaattaaatacaaatgataagttgggattcggtaatgagcatactgacgatctaactgatcatgggattacacgacaaagtagcaaagctaaactttaatctaaacaaaacccgagaaaccataaagggatacctagctatttaaggaggtaggagaatgaactaggggtccctaggtttgtgctccacctagttggggcgtacctcacatgggccccacttgggctggggtcccaaacaaaatttcaagcccattggcccaatataggtgacactacatcttgtttctgtgattacaactgtcagagaaggaatatggagatgaggctagatcggttggaaagagggctccaagagcattccaccaaatactcatgggccaaaaacagagctcgtatgtagatttggcggccgtttgaagtcaacaatgtagaaggtggctgaatcggattccagcacttgaaggacttgatcttgatgtattattgttgattcatgatgtgagcaatggttgtatccatattagtgttaacgaccaaatttggtaagatatgaactaggtttggcattggactcagagtggattcggcaaagagttagattcaaagaacagagtatgcatcagctgcgatggcatcggctgagatggatcggacagaggacagccgacacagcttattagccgattctgatgaagacagttgtaaaactgcttctagaatcgatcaacgtgcttcgcaaggattgccacgatggagaaaagctctcagaaaggcaattgtatctattaattaggatattttgaatagtttccttagagatatgtttgggcaaaagtctgccgtaaagacttagagttaagagtcatgtccggcaaggacatatcatgtatctcgggtataaatatgacccgaacccaatgtaaacaaaaacacacaattcaataacactttcggcgcatcgccacccttttactttcgttctatttcgacgagttcttgctttcgggttgagctgcatcggtttcgatcttcaactagaggtaaacttgtcaagatggtttgcgttctcgggattagtgcttccatctttatgacactctaatcttgtttatgtaatttgtcgagttatcatatacacttcataatccttattagttacgctatacaacttgcaatcggctggttctcactgtagaaagtagccgatagagtttcagccgattttacctgatttagctatctttatctatatgcttgattgttatgctagatctgccctttatattaagatcttattgcattaaaagtatattacgctttctgtttaatatattttgcttgttttgatatcttaatatagagtggtatcgaagtattagccgatacatgctagatctatctgatcagctatgctataagcgttcatataatcatgatcttagtgtatctttagacttaaagtgatttatactgtctcgacatggcgttcgatctaccccaattacttagtttaagtatacatcgagagaaagattatatatcattaatatctacagccgatcgagtagatttagttttatattgctttatttctcattgctgatctaatgccgataacatcggctcagcgattgacaatatgtcatcggctcatagccgatcggctatcgtttatggatttaacctcattttcttgtcttttattcttgttgattgtaggatcaaatcaactggcatgctcacgaacctaaaagcaagattttggatctgcacaggagttaagcagatcttccaggccagtgtgtgtttttcgcatcaacaagtagccatggtcacatcagcagggaacctttgttaccatattaccaatagtttaccctctagagtttccctagtgcgatgaactgaagggctgagctactcttgcaaatttgtctgaacccacacggaatcgacaggaactacaccccaagggtggtcagttacctgagcatgggaatttcaccggaatcaagagagtttgaacaatcttatcccaaacttgttgctagcatcgctatcaatgttgcaccctagcaatttatgacccgagatggaataagaactaatattcaggggtaacaaagaagaagaacaacaaaggaagcttagggaagaagaatatcggaatttcttaggtttgcttttatctcatttcttaacaaagtgacagatttctca

SEQ ID NO: 87150 - DNA, 560 bp, Oryza sativa
gagccaaatgagcccctgctactttacttagcggcgaccccccaagtagttagtgctttttttgttttggagcgcgaggaagacaaggcgcaggtcgtgcacccccattctgtggtaactaggcccgggagcgagcggggaggagaggcccccgagtcggacgggggcctacggcccctgacgaccggagccggccctctgcccgcttgtcagacggagctaggtgcccccgaccctcaggagggccccaaggccactgcgggaagggcgcacttaacgccctttgaccccgaggctaaccctgtgctgactcgacccgggaaagagcagggagaagaggccccccgagccgaacggaggccagaggcccctgacgaccgaagtgggccctttgcccgcttgtccgacgatgccaggagcccccgacccccaggacgggcccgaggccactgagggaagcccgcccctttcatcctccgaccccaaggtcatcggcacagaaaacaagtgcgccccgaaaggccacttgaacgaagaacgccccggggatacggccccta

SEQ ID NO: 87151 - DNA, 1336 bp, Oryza sativa
tgaactaacctagtattacatatattaattgtctcgatcagatttagtataatattaagatgtgtcacaaattatattaaatttgtttattttggaacagagagcctctgcgactaggatggacacagaggagctagccggcgcacatgcagtcgacggccaactacatctcggcaaaaaatctaatacaacactttaattatgttggctaacagaattgcccatgtccgtgggcctcctgatgtctcgtgcatctcttccttccacgattcttgaaaaaccagaggtcccagatgattatgattcatgatctgtgacaaaccgagtgttggcaataccaccgaatgactaaaagtggcttttgctagtagaattaagtaggtcgtgctttccgttttttcagatgatcaaaatccctttttacatgtggccaggtatatgcgaaaatcacatttttctacgtggctagtgcaaccgcgggcaaaaacatgcagtcacaaatgccgaccacctcaaaaaaaaaatgaaaaatgaaaataaaaatattccacaaaaccaaatcagccgaaacccccagcgcagcctaccgccagctgaaaccctaactctccaagccgacatcgtcgtcgccactaccaccaccaccgtcattgctgtcatcgtgttcaccgtagtccgccatcatcgtcactgcagcggtcaatgcctcttctgaggccaatggcaataaatctgtagcacccaagtccggcaccgcccgatacaccgtcgtcatcaccgtaattgtagttgtagtcgatagatccatccgtcccgttgtcattggggacagatctggacgccgcaaggtcgctagtggtggatccgcccgccccacggtcacaggcaatagatccacccaacctgcccaagccatgattgtcgtcgtggtcaccgtagtccagcatcgttgttaccgcagctgtcaacgcgccgatggcgacagatccaccactcccgagtccagcgctgccggatccaccgtcaccgtcgtcgatggatccaccagtctcgcagtcgtcggggatggatctagatgccacaaggtcactggcggtggatccgccagcctcgcggtcgctagtgactgatccacccatcccgaggtcgtcggtgatgatccgggcgtcgcgagtcgccgacgccagcactggacgcaggcagtgcatccggctaccccgctcccgtgcccgtgttgaagccgctatcgccactccctttctctcgtgagggaaccattgacgccgctgcctccatgcttgcgtgatggagccgtcgacgcaaccgccgcctttgt

SEQ ID NO: 87152 - DNA, 733 bp, Oryza sativa
gccccgtttggcgattttagccgacccgagcccccgagggcaggattgagcacgagtgacctatttcaagtcaagattcttcaaaatgaaaaaacagcacagatacagcctttaggaaattgaaactgcttttatagaaattcagatataagagaaataagaatatgcatatgttgtagcccccggccaaccctgcacgcccgaggggggtgcggggttggcgcgagcccgaaacctgacacccgaccccccccctcaggggtagaagcgacgaaggtgttcgatgttccacgggttaggcagctcagtgccgtcgcccgtggccagccgtatggagcccggccgggggacgccgaccactcgatacggaccctcccacattggtgaaagcttgctcaatccagcacgcgtttggacgcggcgtaggacgaggtcgtcgacgcagagtgatcgggcccggacgtggcgctgattttagcgccgcaggctctgctggtagcacgcggctcggagggccgcgcgccgccttcgctcttccaagtagtcgaggtcatctctgcgaagctgattttgatcagcctcgcaatacatggtagcccgaggagacctcagggtgagctcggatgggagaaccgcttccgcgccgtagacgaggaagaaaggcgtttccccggttgctcggcttggtgtagttcggtttgcccagagcaccgctgggcaactcctcgatcca

SEQ ID NO: 87153 - DNA, 813 bp, Oryza sativa
aggtaaacggtccggagcgtttgagaagcttaaataagggtaacgccttctctcccagcctcgatatgaaccgacttagggcggccatgcaaccggtgacgcattgcacatccctaagtttgctggggggcgcatccgctctatagcccgtatcttctcagggttggcctcaatgcctcgggcagagaccaagaaccctagaagcttgcccgtaggtacaccgaacacacacttatcggggtttagttttatgcgggcggagcggagactctcaaaagtttccgctagatctgagagtaacatttcctggttgcgcgtctttacaaccaagtcatcgacataagcctcaacattacgtcctaattggttacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacaaccaccgggttcgccagccactccggatggatgacctcacggatgaatccggcttccagaagtcgcgccacctcctcgcggatgaaggcttgacgttccggggcctgccgccgcactttctgccggaccggccttgcgcccgg

SEQ ID NO: 87154 - DNA, 1151 bp, Oryza sativa
tggggagcgtcgcctcctcgtctacggcgacggcagcacgccccagggcgcgctccaagctgcgggcgcgctcctacgtcacccgcccatcgcccatgacccggagtctccagcccaacgttggctggacgatgtggccaaattggtcatgactgcacggcagcgcctagatgctggtgggcggtcctccgccaccaaggcctctggtgctgctaccaccggctccgcatcgtcaagacggagggcgcggcgagcggcagccgctgttcgccattcgaccgccactccttcgtcaacgcctccgacccgggaagatctgcgtggggaaccggatgctcgcatcagtatcgagcgccggcgtaatggccgacgtgctccccacgcaacggagggcgcctcctcgtccggagtgtcacctcaccacggacgcggggatcagccctccgtgcccccggttggtggtgtcttcggaatgtccgtcaccacggacgcggggatcagccctccgtgcccccggttggtggtgtcggctgtagagcctttgtggcgagccttcggaatgtccgttggcccccaaggtgccggcccaccatcgccgaaaaatatgacgggagcgtcaaccccaccgagtttctccaggtctacacgaccgggatcgaggccgccgggggtgacgacagggtcatggcgaatttctttcgcatggccctgaaaggacaagcgcggggttggctaatgaacttgccacccgcgtctgtccactcttgggaggatttgtgccaacagttcaccatgaacttccaaggcacatatccgcgcccaggtgaggaagcggacttgcacgcagtacagcgaagggatgatgagtcacttcgctcgtacattcagcggttctgtcaagtccgcaacaccataccatgcatccctgcgcacgcggtgatttacgcgttcagggggggtgtgcggcacaaccgcatgcttgaaaagatcgcctccaaggagccccagactaccgcggagctttttcagctcgcggaccgagtggctcgtaaggaggaggcatggacctggaaccccttcggttccggtgtggcagcttcggccacccccggatccgccgctcagatagggcggcgtgacaggaggaggaa

SEQ ID NO: 87155 - DNA, 1560 bp, Oryza sativa
catcactggttggagccgaagccggcgtagctgactgcgggaaccgtggctcgggacgcctctactgctgctgctgccttggatcaacgccgggtgctgctggaactcgaggacctgctgacgaacggctgcgcgctcgccgccgtcggcatcctctgcttccttaccgcctccccaccgcgacgccgcgtttcgccgactcgccatcccacggtgagccctcgcgtccgtagcgtcctctaccctactattagctagcctcggttcctattttagcgattagcacccatggccgtgccggcccggctgctgttccgccgccggcgaggtccccgtggacatgctatcccggaggctttcccttccatcttgttaggaaaaatggaatcaccatacactgtagaagctttcgcacccatcaatttggttggaacctagccctaccgccctatccccttgcaccccggagctcggccatggcggccatgccgcgccgctcgcccccgcgccgtcgtgcgccgtggctgccggcgggaggtcaccggagattcgcctcatcctccccggccgcctctgtgccggcctcgcgccgtcccggcgtgcgcgctaggcgcatggcgcggctgcctctgcctggcgagaggtagaagacgacggggaaaaaaagaaaggaacgagagagagagaaaccgtgtggggcccacatgtaattagcacacagtaatgctctccctaatggttattagcccactcaatgacatgtggggtccctgttattaaaatctaagaaaacttaattatagattttgtgtccatgacagaggggacccaccggcaattatatgaccggcttgacctcagtcaacagggggccggacccacctgtcagtagcacatcacatttcccttagtagaataaagataaagaaaagaaaataagagtggacctacctgtcagtcactaccacttactgttaacgctgcaataaaaataaatcaattatgaacagtactgtttcacaattattggaattaattcaaatttgaatctttaaactagcataactcactcattttaactcggattcgaatgaaacttgaacctaaatttatctaaaatcaagatctaactattggtaccactttatcaatttaatttgtactgtttgaatttttggtgattttatttgaattctaattgaattcaaatcaaatctttcgcacgtaaatttagattccgaaggagttgctgagttaatcaaagatccgggtcagcaaatctgtgagcaaggcaagtcatcactaatctttgagcatgttggacctattgcgaacttattttgatttaaataaagtttgcatgctatttatatgtgaatatcctactttgttatatgccatacctttgatattgattatccatatgtcggtgacatgggatcaggagtatcatgactagaggtttgaggcagacacaatcgcacacgtggcctggtacccccgagggacgtcgggcccgagggtgatgcgttcgccctcctcttagtccccccgaggggg

SEQ ID NO: 87156 - DNA, 1789 bp, Oryza sativa
ttgcggcgtgcctgctcctcctgcgctgcctcgcggagggacaggttgaccgccagctgttgcgccgcggcctcggccccctcgagagctcgctcccgttcggtgagcgcgtcctcgcggaggcggagcgtgaactcttcttcggcgcaggcagcctcgtgcgccgccagcgttgctcgcggcctcgcggtccgccagatccctctccacgacgcaggcgcgctcttccagcgccatggcgcgcgcctcaagggcctctttgcgccgccgggacgccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcatcacggtggtggcaatgagggcagccccccgctcctcctccacttccttggcgatctccgccagcaccttcttacgagtttcaagctccgagacgtgctggcggtgagccttacggcccacctccaccatggcctccaccgagcgtcgcccctcttcgacacgcgcccacgcggcgtcgagctccgcccgctctgcctgcaggacctccacctgggcacttaacccatccaacaccgtggtgtttgcggcggccaaggcctgcagaaggggctctgcgttcagtagggcgatagaaggcgtggggaagagccgccttggagaggatgccacgcggctcgggccgccgatggaagtgccggactcggggatgtcccccggacccggttggtcctgagcgtcgcccgagggagtaggcccaagcgacgcgcccgcggcctcgtcgccagctgccccggaagttgtcgcctgagtgtcgcctgagggagtgggcccaagcgacgcgcccgcggcctcgtcgcgagctgcctcggaagtcgccatcgcctcgtcctggcgaaatccggcctcctcccgagcggtttcctcggcctggcgagcccgggcggcctcctgggcggcctcctcggcttcccgtaggcgatccgcggcctctcgccggtcagattcccgcctgagggcctctgcggccgccggatcctcggcctcagactggccggacttggaatggcgggagggacgcgacgggatctcgctgacaccaaagaaaaaaccagaagactaacaagatgggtgagtgaaaactcgcgttgagagaatgaatacagccacgatgggtgagagacgaacctgcgagggggtcggttaaacgaccactttggaggggaaatgaggtttccccgagatggttctgtctcccacatcttacggggccgcttcttcttgcgctccccctcgggctgcgatgttggcgcggccccctccgggcgcctgttactggcacgcgccgccccgccccctcggggaggagatgggggaggtgttcctccctgcttcctcttcccccgggcgtcggcagggcggctgctccccgggcccctgtcgcgggacccagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagt

SEQ ID NO: 87157 - DNA, 3145 bp, Oryza sativa
cattggaagatactgaaggcatggagttttcatatcctgcagtgatccagaccatggatgatctcatacatatcacgtacacatacaaccggacacaaattaaggtaatctttctgatgcatattcaaaagaaaatatcgatcttgttttccatcaagaacagttttctgcccgttagtaccttttttaatagtattattgaatgattcacagcatgttgttcttcaacctagcgggaaagtgaggtggtgagtgtgcaactattgggagagttattgctgccaattgcaaggcacgcaagtttttctctatgtgtgtcacatcatattggctggaccgtggtgctaaattggtcatcaatgattctttttttgggtatatttggtcatttgcataatttcttgcaattgtaacctaattaataatctccctgattcctatcaacaatgatattgaacatctgtacatatgccccaaagtttaacataagttgttccgtatatggctgttcttcatgttcatgttgtgataacctaagatattactactttaactgagaacttgagatgtcccttttgctgtgatgcaacttccagaaaataaattatggttatcttgataaaataatatatgtatcaagtttgctttatttaaaaagaaagacttcattattgggcaccatagtatgcttgaataatgatcctctagaaagcagatcctaaatcttattacattatcatccaggtactataatctttagccttttattttctgaattgagcttttcttgttagtaccacaatgggttggaatatagtaaaattcttgtcttgactcttaggccctgtttggatcctccaggctattaaatagccctccggaatcttgctatttaggagtattattaaacgtagattactgaaaaaacccattccataacccctagactattttgcgagacaaatctaacgaggtatattaatccatgatttgctacagtgatgctacagtaatcatccgctaaccaaaactatgaagaaaaggaaatgtctattacaccttgatggatttaacaaaaactcggcctctggtttagggttgctagcagattttgggtaaacagtaggtaactgggatttttctcgtaacagagcaacagaaacagcatttcatgattattagttgttaaggaaccataatcatggtcagtatctcaaaaccaacactacataagaaaagacaaaattatacacacatatacaagttctgaagttcattgtccccactgacacaggtcacagcaaccaacagggaaaaaacattttttttatagatagccaacatcttgtgaaaggaaccttgtatataataagcacccatgtgattctacagtaaacaaagagttgtgccagttatatcaagcatttgtgaacacggtaggcaccattctcttgttcctctctgtgaagagatcttgaaatttacatgtgaatttgtgatctcgtgtactctttatgaaatatacttgcaagttgcaagttactctgacttgtggcacttgatctccctatcaaatttctttctctcttgctgaactcgggcttgcagtttgacctgcctactctcagctctcaggtatgcctcattcctcctaagatgccatcccaacccttgctctatgttttgtatgattagccaatctatcctaagatgccatcccaacccttgctctatgttttgtatgatttgccaatctattctacttatcttatctctattcccaaatagtagcaataagtcaacagattgttccagctgaattctgcttttgtgaaagataaaagaatatggatgtcaaatgctatgatgtgaaaatttccagggtctcacttcgatgctgggaattttttttagataatggatgcttcaatgctgggatagaataatctatcttgaattttatttatgaacttccttcctgtaaggaaactggaaatgcatggggaaagacatacaagtgaaacagtgcctactatacctgcatcaataaaaactgtaaatagaccaggttgtcttctctgcctgcacaggggagtaaagaccacggattaatccttcatatccaagaaaagtgtgacagtgtgtttgaaggatgaaatgtttttttataagaaaaaatctttgtgtacaattattctccttttggcgattcagaaatgaccaataagtggagcgtattgagggaagaatttacattttcagaaggcaacgtacctttcaaaacctgccatgcttccacaattgttgaggtatattatcatccaaactttgttctaattttatttaaattttcttttgatggattatcttctctgtataatgtacctttcctggtcaggttcagaagaatatgtttctggtggcctactttgggggaacacaggaaggtgctgacgatgttaaaatttggctacagagatattacgtatgttaaagttcctatttcctgacggattattgatcttccagcgtatctgtgtattgttattgttcacttgatacacaatacatttaacaatttcacctaatacagaatggctcgtggcactctcctgaagtagttgatgaagtgcccaatgttcctctgtggaaccctgttctcttccagcttccttctggtgagatcctccttttctacaaggttggcaagactgtcgaaaggtgagtgatccattcccatatctgcattcccagcaattaataccccagttaaatgtctgcaccaactgttcagctgaatttgacaatttttgtttagttggagtggatgcatgaaatgctcatcggatggtggtgttatctggtcaaagagagagcaactcccacctggtatccttggccctatcaagaacaaggtgtgtatttgttccagacttgatcagtattttgacactgtcacataacactacgattattctatggacctgcataccttctcatcaacagtgtctcccaatacagcctttcttgctcaaggatggccacctgctctgtggaacatcagttgaaagctggaattcatggggtgcttggcttgaggcaagtcagctgtgagccatcagctgcaactgttcttcaatatctc

SEQ ID NO: 87158 - DNA, 2514 bp, Oryza sativa
tcctgcaccccaaaattgttcgtcagtctctcttgattacttgttgggtttcctaatggtgtttgcctactcaattactgctttaatagaataggatttttcgggcatgctataagtctataacaatggttctcaaatattataattagttaaaaaggaggctgttcagacagagaaggccccggcagcattaggcccgtattctcaggccatcaaagccaacaatatggtctttgtctctggagttcttggcctaaaccctgaggtttgtccctcaacatatgttttgtgatccttcacgtatctctgcatcataaatgtatgccactttgctggttttaggtgccagtataactgatatagagtaacttctgtctccagactggaaagtttgtatctgaaagcgtggaggagcaaactgaacaggttaacactttgaccttcatttatgttctgtgtagttttgagctctaggaatttcttgcagaatgtggatggaatggttaatagtgcacctactgcaaaatataaattttctgagttgttcccagtatccgcatccatttttgaagtttcccatattctatattgaagtttgtgctgacttttatttgacttatactgaggatgtgtttgtgttttggtaatttctatggaaagaatttgcatgttaggttagtgtttatatgaaagtgtctgcaacaaattcgaatggtggtccagactccgcatcataaatcctgtttttcctgcatgcctctccatagctgcctttgccttcaataaaacagttgattttatcaatgcaattttcggaagatgctctttcttacatcatgtttgtgtttctcgtctgtcacaggttatgaagaatatgggtgaaatattgaaagcaagtggtgctagctactcttcagttgtcaagacaacaatcatgtatttacctgttctttaaatgaaactttgttttgctctaagttattatgatctctgtgacggaaattttcttctatctgcaggttggctgatctacaagatttcaagaaagtgaatgagatctatgccaaatgtaagctcaaaaactttgttcgtccttagtagtactaccttttatttggcctaagtttagtgacattcttgaaacgcattcatgctaatgtttatatgttcaatatttttgccgtgatctctatattttgcttctgaagaattttgcaattcttacttgcagattttccagctcctgcaccagcacgctcaacttaccaagtagcagctctgccgctgaacgccagaatcgagatcgagtgcattgctgctctctagttacctgctactgtctatcaatcaaattgccaataagcattctgtggtgccgttctagttggtcactatcctggaagaatgcactgccattctgaacctgatcttgtagtaccaattaagatcttgaactgcctgcaataaacgttgatgcccaggaaaaaagaagtcccatctgttgtccaagggttccctttaatctccatcatgaattgatcatcccaatggctcacagtgctatgttgcagaggtctcctgctgcaatatctgcaagaattggtcttgccaagcgtcatgagtctaataaatcattaaaaggtttatcaacatgatgtatctccatgttactatcacatatccacatattgacaccaactgagtctgacctggcatctagtatgtttatattaatttatcccactcaacgcaattcggctgtctagttggcgagacagcgattatcgagtagataacgtatgaaagatgagtttacactggcttcttccattaagaaatgactagcaaaatctacagtgcatttctttataccggaagctcaaaattttctactgatatttatatattaatctcaatttggtcgtccttccaaccaagcacacccttacactcccattcgttgcaccgtcacatttcttattctataaatcgcgacaaaaaggttggcaaagggtgttcatatttcccaaattgattttgtgcacgtcctattctcatcccaggaagcatgatggcaacatgaagccaggataaactggctttatttcttaataataataaaaataggttatatcttcggcctctaccattagacacacagcggtcgagtcattatgattttttttttgttttgcatgatttgtagtagcaaaagcacattggtttgtcagcttatctattcccagttcgacccagcttcgcgtaggagacacgtgaggcggcggccacttctgagaaggttatgggaagcttccgtgcggctgcagaggctgtttaattgtgggggtgacaacactgtgatgctttcgtgtaacgataatgtcgacaccttaatgacatttttactggattagttattcatcccagggatatatattttcttttctgagaaattctatggtacagttcacaaatcacagactcacacactttctttgttgggaccgtttggaa

SEQ ID NO: 87159 - DNA, 2972 bp, Oryza sativa
tccacccgccgtgcaccgcatttctcccaagccttgcgggcttctcttctctcccatcacactcgaggccacgcctccaccgccgccaccacctcctcctcctcctcgtcggcgtcgccgccgccggcgtcttctccacctcctccgcgccgcgctcgcaaccaccttccaggtcagtcagcgcggccgcgtttcgtcatgcttttggaccactctgtcgtagcccgtagcccctagccccagtaggcggcagtggtggaacactcgccgccgccatgattttttttttttttttttgctcccgggtaatgtggtgcgctggctaattaaggagcagttcgaggttgggggggaggagtagctgaagagttgttgtgttctaggaagaggagcgtgtgggtgtgcagtgctagtagaaatcaggccacgcagattagcatccgctgcgttcctggtcttttagcttgatgatgagctattgcagctttgaggaagaggaggtcccgtttctgtggaaggaaatttcggtttatggaactgtgttccatggcgtgggatactggagtgtttgggggaagattgtgatccaactttgtttttagtgatggatgtgatgtgctcaggctcagcaattaggaaaatacattgtcaagtacagtttgttattctgccaatttcaagtaagtatggaagcagatcagagagaccaggaggtccatgccatttttttacttggatttctctgattgttgaggaaaccagatggctagctttgtttgttcgtcagtacaaattccttctaattgaaaattttgtggttcttgtttctgtttgatgcaactatcttgctttctttcccctgcacattgcattgtactgacctgtttcttttcattccattctgtagattggatgggactataactgaaaccttctgtattaagcttccgcgagggctcacctgcagaacgtgatggtcaccatttactggtgcagcaggcaaaaagttgcatggagcgctacaggctgtacacttttgatttccctgctgttctttttctctggttcaccgcataggatcctcttgaacaagaaacctctcaatttcaaaacagcaccatctaggttattgcgtgagattagcatcagttcaagtcgtgttcagaggtaagttctaaattgagtttctgtagcctcgtgaaggattactacccagagttctaatcttttgtgtttaaaaagggttaacaattcatccgcggagtttgttgcaaacctgaatgaccgtaatgtagaaattgtacaacatatggaagacaacgatcataacatcatcaatgcaactgcaaatgtgacttctgactggagcattgtcaaggaggaattcacatttccagctggaagtgcccctttcaatagctgccatgcttctactattgtagaggtatatgacttctggatacaagtttattttgggtaaaaatgtactataagttacttatagattaattttgtctttttttagactgagaaggatagttttttggtggcttatttcggtggatccaaggaaggtgctcctgatgtgaagatctggctgcagagatacagtgtgggttcgatcatccgggatacttccatttcttattttctttactcagaaaagcggttattcttaagaaccttacctttgtaggatggctgctggcatactccacaagtggctgatgaacaggatgaggtacctatgtggaatcctgttctgtttcagctcccttctcatgagcttcttctcttctacaagattggccaagaagttcagaagtatgaacatgttttatgttatttaatttcttatctcttattcaaatgacaaaaaaaccatatgatagtgcaaaaattgaatgcgactatatgattatttgatattctgatgctcaatataacatgttcaggtggagtggtgccatgaaaagatctctagatggaggaaaaacctggtcggcaagagaacagctaccacctggcatccttggtcctattaagaataaggcatgtctaaatctgtggtgtattgccttccatcttagcaaagcacattgtaaccataaaataaggaaaatattgtcaacctgaatacatatggcagcacaatcattatgggttattaacaagtcagtactcagtagtaatttaattgcctttccattgtgattctcaaaagtttattgatttggttcctgaatggcattttctccaatgtagcctttcttggttgaagatgggcgcttgctatgtgggtcatctgttgaaagctggaactcttggggtgcatggcttgaggtatccattacattgaaaataaaaaaaatcatagactgaactcatgcgtctcacattatgtgtagtggaagttttaattactcttatcaacttaggtcacaaaagatgccggacgaacatggcggaagtatggccctatatatattgaaggcgaaacactaggggtgatccagccagttccctacatgactgccaatgggactattcgagtgttgctgcgatcttttgagacaattggtcgtgtctgcatggctgattctgctgatgggggtgtaacatggagttatgtgcacgagactgaccttcctaacccaaactctggtttgttcatctcctagctaaattagttttctctttgcttcagtacccttgtatagaatagcaaatcctcgaatgctcattagtgaccactgagcactgaacatctgctggtgctgggaacacattattaaacagtttgaagtttccaaaaattttaagatatactgatagatttctgaagaatattaataactctctctctcgacttcaaacctgaagggattgatggagttaagatgaaggatgggagagtactccttgcttacaacaccttctccagaggaacactaaaagttgcagtctccatg

SEQ ID NO: 87160 - DNA, 1345 bp, Oryza sativa
gagtgatccacgatgtcggacttagggggaaaggacggggaaattggtaatgaagatggagcaagcagcaagggaactccatcacccaagggagccattataccttttgattacagcaaacttactattccctctcacaaattcgtctccgtgccttccgggggtgctcctcaatttgatgggacacattacgccgcttggaagcacaagatgaagttgcatctaatctgtttgcatccaagtatttggaaagttgtttgtacaggtatgacgtaccttatgaagacatggagctcacttcggagcaagaacaactcatccaccgcaatgctcaagcttctaatgcaattctctccgccttgagtccggagagttcaacaaggttgatggactataggaggccaaggagatatgggatactttgcaattggctcatgaaggatcaccagccgttcgtgagaccaagattgaattattggaaggaaggcttggaagatttgtgatggatgacaaggagacaccacaagagatgtatgataggatgatgattcttgtcaacaagattaaaggacttgggagtgaggacataacaaatcactttgtggtcaagagacttctccgtgcatttggtccaagaaatcccactcttgcatcaatgatacgggaaaggaaagacttcaagagactcaccccaagtgacattcttggaagaattgtgtctcatgagatgcaagaagaggaagctcgtgaagtgagacaaatggtgaagaatgtcgccatgatcaaaaatcaagaagttgctttgaatgcaaaacaagaagaagagtcaagttgtgaagaaagtgaagatgaagaaatggcttttattgtcaagagattcaagcactttcttcgcaagagtggctatggcaaagggaggaaggatgatgacaagggaaagaggcaatcaaagagagcgtgcttcaattgtggcgaatatggccacttcattgccgattgtcccaagtcaaatgaagctaaggctaagggaggcaagaagaagccggaacgtgctcatgtggcggaggcacacatggcggaagtgtggtactccagagatgaagaagatcccgaggtcaaccccaagcccaagtcaaaagacaaggttgaaggagaaggtggtgttgctaccgtcgccttcaagtcatcctcttcaagcaaggagcgtctcttcaacaacttgagtgatgacgacgacgagtcctaccactactctttcttcatggcccaaggccacatggtgatgactcaaaagccatctcaaacttctcttgatgttgattctagtgatgaggaaagtgataat

SEQ ID NO: 87161 - DNA, 682 bp, Oryza sativa
ggcctgaagcaaatgttcacaaacatggacacagacaacagcgggaccatcacatatgaagaactcaaagcaggattagcccaacttggatcaaagctttcagaagctgaagtaaagcagttgatggaagctgtatggcaccaatcctagactgttacagtatttttctgaaccatggtttattgaccttttatgctgaccttttctgatccattccaggttgatgtagacggcaatggatccatcgactatgttgaatttatcactgcccaatgcatagaccccagccttcgaaagagatgagcatttgtttaaggcattccagtattttgacaaagacaacagtgggtgagtattctgaactgtcacattgaaaaaaactcacaagtcgcagtattttcacaatggcagtccgccaaatatgattatgatcataattcacaggttcacattttataatatctagtgctcactagtctagaaccatcattggaaaaaggcagttgtacaatgccatctgcgcatcaaactccccatggttgatctgactagagaattacctcaattttatgcagcttcatcacaagagatgaactggaatccgctttaatcgagcatgaaatgggcgatacaagtaccataacgcatattatatcagaagtcgacacggataaatgtaagt

SEQ ID NO: 87162 - DNA, 808 bp, Oryza sativa
gattgtcctcatcgcgctccacaaccaacgctgcactaactacttggggggtcgccgctaagtagagtagcaggggctcatttggctccggggcgaccagaaccggaggagagctgagatatgccttcaatcgagtgagggcatgttcagcttcctccgtccaagcaaacggcccagagcgtttgaggagcttaaataggggtagcgccttctctcccagcctcgatatgaaacgacttagggcggccatgcaaccggtgacgcactgcacatccctaagtttgctgagggggcgcatccgctctatagctcgtaccttctcggggttggcctcgatgcctcgggcagagactaggaacccgagaagtttgcccgcaggtacaccgaatacgcacttatcggggttcagttttatgcgggcggagcggagactttcaaaagtttcggctagatctgagagtaaagtctcttggttgcgcgtctttacaaccaagtcatcgacataagcctcaacattacgtcctatttggctacccaaagaaattcgagtagtacgctgaaaagtaggacctgcattctttaacccgaagggcatcgtcgtataacaataggttcctatgggggtaatgaacgcagttttttcctcatcctccctagccatgcgaatctgatggtaaccagagtatgcatctagaaaacacaaaaggtcgcaccccgcggtggagtcgacaatccgatctatgcgaggcagggggtaaggatccttaggacatgccttgttaaggtcggtgtagtcgatgcacatccg

SEQ ID NO: 87163 - DNA, 780 bp, Oryza sativa
cctcataagtaagtatttatcgttttagttaatttgatgaatctgtatattaaattgtcagtttgtgtacctcggctgattcctggacgaggattttatgcacaaataagttcggaaattattagtgaatttctgggcgtgacagtggagagacccgaccaaaatgtcatcggcaccaagtggatcttccgcaacaagcaagatgaacatggagtggttgtaaggaacaaagcccggttagttgcgcaagggttcacccaagtcgagggtctcaattttggtgaaaccttcgcacccgttgctcgtcttgagtcaatccgaatgcttttagcctatgccgctcaccatgatttcaggttatatcaaatggatgtcaagagtgcctttctcaatggacccatctcggaattggtctatgtggagcaaccaccggggttcgaggatccaaagatgccaaaccatgtgtaaaagctccacaaagcgctctacgggctcaaacaagcccctagagcttggtatgaatgtctccgagattttcttttgaaaaatggttttgaaattgggaaggcagacactactctcttcactaaaaagtttgaaaatgatttattcatttgccaaatttatgtcgatgacataatttttggttctactaatgccactttttgtaaagaatttagtagtatcatgactaaaaggttcgagatgtctatgatgggtgagctaaccttcttcctcggactacaattcaagcaagcacaagaaggtactttcatctct

SEQ ID NO: 87164 - DNA, 1690 bp, Oryza sativa
atgacaaggtggttaaaggggactaacgtgtttatcaagtttattcacaggagtttagtcccaaagcaagttgtgatggctaagaatgcaaggagaccccccaattcaaatgttcctaagtgcgaaaatcaccgaaggtgattagactaggtttttctcttttgaaattgagtttaggaaaatccgtactattaagaggggtttcaagtgtggttctagggtatacaaagtgctcttagtcatatccatgagtcaaaatattttttggaatcatttttgaaaaatgattttctccccgggacagagagggctacccggaggttctggccggaacttccgggcaccatttcattgcaaaaaatttcctaagtgctgcccggaagttcctggcacttttgcccggaacctcctggcaggtttccagttcaagcttgtgagtagcggctagatgacgtcacctagccgttatatatatggatttcgttcccaggtcactctttggctattccacttcagttctttcatgttctagggttttctagccactaccaagcttcctttgcttcctccactcaaatctagagcctatcttgtgagattgagagattagatgagagtgtaggagtgttttggagatggcttgaagattaggtttgtttgagcactttggataccttgtgggctatcacttaggcttattactcttggagatcttctcctagacggttaggtgtcacccgtgagcttccaaagatcttgtggatgtcccgggaaagtttgtgaaggttttcctcacctccgcaaggaaacgagataagtgagtaaagattattgtgctgagttttcagaggttgtcctaggtagagcaacttgcacgtgtggtcttttttgaaggaattgtgagttggatcttggtggtcactcaattctagaaaacgacctagaagtgttgagttgaaggctgtggacctcttctgggatctttgcataagtgaggcaaggggttaatcgagacccggctctttggagcacctcaacggagagtaggatccgtgtgatccgaacttcgggaaaaaattgcctttgtctcacttgtgcatgatctgtgtttgaatctgctggtatcttgtgattttcatcttgtgcatccctgtgcctgattttccctagctaggacctgtttttcttcttatatttcgtttatctgtgttgcccggaagttcctagctcaagaactccggaagttccgggctactcatcactgccaggaagttccggtgttcatcaccaggaggttccgggccctgtcattttaaccgctgcgtttgttgagaaaatttcaggaaagcctattcacccccccccctctaggcaacatctctgcacgttcatcgcaggattgagaaaacgtaagaataggataaacatagaattttgataggaatgtaagtgtaaaacagaggattgcaaaatgcaggaaaaacacaagaatgaccgtttgattgaaccgcaggaaaaacacaggaattggatgagagaaatagactcaaaggaaagttaccaagaggttgaagctcttgctaaatttcctccaaaatctctatagtattgtccattccataggaattttaaatgattggatagaattcaatcctttgtttcgaagggtttcataggaaattttcctata

SEQ ID NO: 87165 - DNA, 593 bp, Oryza sativa
cggcacgaagaactctccatcataacttggccactgcgatggatctaggtaagggtcaaacctaggggagtacgagtcctgcacagccttattggaagcttcataacacattcggggggccaccttcacatccaaacctcgcaacatacaaacggttatcatgtgggagcatggcaagtgatggagctgaaggaactgacaactacatgtgttatctctcgcaaccacgacgtagtgacgtccaccccattgaaccccagccgccgtgactccgccttgctcgctgacctcatacttcatcgaagggaaatcaaaacatgctgctctttgccccaaggttcgtctttgctgctcctccaacatgtccttaacttttgtgggccacttctttccacacaggatatctacagttgcctctttgtgtctatcgacaaaccaactattgcacttcgaaaatgtgtatgccacaatagctgtaaccggcagtttccgaatgcctctcaatacattattgaaactctcggccatattactagtcatgatgctatgacgacgcccgttggtatcaaatgctcttgcccatttgaccttaa

SEQ ID NO: 87166 - DNA, 607 bp, Oryza sativa
cgctcgtcagacggtgctgggtgcccccgaccctcaggaaggccccgaggccactgcgggaaggccgcacctatcgccctctgaccccgaggctaaccctgtaccgattcgacccgggagagagcagggaggagaggcccccgagccgaacggtggcccaaggctcccgacgaccggagatggccctctgcccgcttgtccgacgacgccaggagcccccgactcccaggacggccccgaggccactgtgggaaggccgcccctgtcatcctccgaccccgaggtcatcggcacagaagacgagtgcgccccgaggggccacttggacgaagagcgccccggggatatggcccctagcgaagaggatcggccccaccgaaaagtgcagcgacctgtctactttgttagtgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgagagggtgcacgacgggtgttaaaatgggcaatcgagctttctgag

SEQ ID NO: 87167 - DNA, 654 bp, Oryza sativa
tatctcaattgctgttacatcattgccacccttaccatattctccttatcttcatttgtcacctccttcaccacatcaactgaaatataaattcaccacaccaacgattgacaacacattcagtaattggtggagttataacaggtgtgatatactgataattacaatatctgaaatacatgatggcacttaccaggttcttgctctgtaccaactggcaaagccttgctgcctccattgcaatcttccttctgccccttgacctgcttcttggctttcttaccagtattcttggtgatggcttcttttgcaggattccggttgtaggagcctctaacctttgcatcaggcttcttctgaatgttgtcttttttagctgcttccttactttgagctgcatcagaaatcaacgatcttggctttaaattacccttttgtgacacattggtggcactattagcagcccttgcagactttttcggctgttctgaagaggtcacagtgatctttaacttctcaagatcctccacgatatttgtaacctggaaaatattcttcactggttcttcaactctgttgcaggccatccggacaacataaacccttagctcatctctataccaaacagaggctgtggaaaagccacttattata

SEQ ID NO: 87168 - DNA, 588 bp, Oryza sativa
gggatgcctccagtgaggctgttatttgtgagtatatgaccacattcagaaaagagttacttccaagtgagaaaggaatattgccgcttaggttgttatttgaaagatataaaactgaaaggttggagagtgtacctaatccttctgggattactccttgaagtttattgtcaaacaagcagatagcttgaagatttgagcatttgttcatgcttgaggggatctcaccatcaatcgagttatttgagatatcaatgatctgaaggttagagcatgaagacagagcctctggtatcgtgccagtgaggccattagaggtgaggttcaggtaggtgaggcgacgcaaatgaccaatttcaggtggaatgttgccagtcaactgattaaatggaaggtggattattgtcaagaaagtaagattaccaatgcaaggtggtatttggccatggagggtggatgactctaggttcaattcagtgactcgagatgtgtggctcttgctacaagtgacacccggcgcattgacagtattgcgaagaatcatttctccaggaagccatgactccggcattgtcattgagatggagc

SEQ ID NO: 87169 - DNA, 1383 bp, Oryza sativa
gtggtgtcgctgtcgctgccgaacaccttcttcaacctgtcgtcgctgccgccgcagctcgcgtcgctgtcgtcgctccagctgctcaacctctccacctgcaacatctccggcgccatcccgccggcgtacgcgtcgctcgccgcgctccgcgtgctggacctctcgtcgaacgcgctctacggcgacatcccggcgtcgctcggcgcgctgtcggggctccagtacctgctcctcaactccaaccgcctcaccggcgccatcccgcgctccctcgccagcctcgccgcgctccaggtgctctgcgtccaggacaacctcctcaacggcaccatcccagcgtcgctcggcgcgctcaccgcgctccagcagttccgcgtcggcggcaacccggggctgtcgggccccatcccggcctcccttggcgcgctctccaacctcaccgtcttcggcgccgccgccaccgcgctgtccggcgccatcccggaggagctcggcaacctcgccaacctccagacgctggcattgtacgacaccggcgtgtccggcccgatccccgccgcgctcggcggctgcgccgagctgcgcaacctgtacctccacatgaacaagctcaccggcccgatacctccggagctcgggcggctgcaaaagctcaccagcctgctgctctggggcaacgccctgtccgggaggatcccgccggagctctccaactgctcggcgctcgtcgtgctcgacctctccggcaaccggctcgccggcgaggtgcccggggcgctcggccgcctcgccgcgctcgagcagctgcacctgtcggacaaccagctcgcggggcgcatcccggcggagctgagcaactgcagcagcctcacggcgctccagctcgacaagaacggcctgaccggcgccatcccgccgcagctcggcgagctcagggcgctgcaggtgctgttcctctggggcaacgcgctctccggcgcgataccgccgtcgctcggcaactgcaccgagctgtacgcgctcgacctgtccaggaaccgcctcgccggcggcatccccgacgaggtgttcgcgctgcagaagctcagcaagctgctcctcctcgggaacgcgctctccgggaggctcccgccgagcgtcgccgactgctcgtcgctggtgcgcctccggctcggcgagaaccagctcgccggcgagatacccagggagatcggcaagctgccgaacctggtgttcctggacctctactccaacaagttcaccggcgcgctccccggcgagctcgccaacatcacggtgctcgagctgctcgacgtccacaacaacagcttccggggtgccatcccgccgcagttcggcgagctcatgaacctggagcag

SEQ ID NO: 87170 - DNA, 834 bp, Oryza sativa
attatgccgccgctgttgggcgtttacgacttcaccgccggcctgcctccgtcgccgccgagtggtgcctccaccaacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggtgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggtgtctacgacttcaccgccggcctgcctccgtcgccgccgagtggtgcctccgcctacacggctggcctattatgccgccgctgttgggcgtttacgacttcaccgccggcctgccttcgtcgccgccgagtggtgcctccgcctacacggctggcctattatgccgccgccgttgggcgtctacgacttc

SEQ ID NO: 87171 - DNA, 1654 bp, Oryza sativa
tttgcggcatcactctggtccacgagatggtaattggatccacatattatatctggtaatgataactataaacaggcttccattttattttttaccttttgattaccttgtaaacagtcatagtgccttagtgatgtagttctctagtggcttacatatgcttgcaagttattaagtttcataacatactattcgtaagagaataattttgatttgctcgtatttcaggcttttaaaaaaataaattttccaagcaccttatgtcatcaagtagcattgttgtggcagtggtagtttttatttacatattaatagcctattggactttgtttgaatattgatctctttgaaattttgtacaagccattgtctaaccaaccttttttttacaaacctttatcccggatgtgctcatgctgatatttcatagaatttcacattgttgatatgacaaaactgacaattttcagtcctggtctgggtcttatactgacaataatgtttgtgtacttggctttgaagcactcttatgatgctcggaaagcccttcaaaagaatggtgtccagctaagcagtggcgtcattattggggtgaagcctattgatccaatgcataggcagcagctcgatgagaggttcgctggaaacaaacaaggaggcttcatggtttccttgcctccaaagtctcttgttctgaagggtaccggtgcgtcgaatcagttgggagccttgccacgcccctatgatcctaaagctaacacaaatgttatcagagacgctaaccgtcgtgcaacaggtagcgttgctgcaccagcaaaatctcttgtaacgaatgtgatggatttgatatttggcatttaacctgccattttgaggacctatgacctcaacctttccatgtttcttctatgttactagtcctcttggaggacgtggtggtgagcaagatgtcagcgtgccaaaggtccaggagcaaatttgcctaagatttagagaaattggagagggaacttatctttggcgatgtaaccttcatattttgcaaccttttcttttttggctgcacttctatattatgattcactgagagcagttgttgtatgctggttgctatatagctcgggatgaaaaaaaaaaattccatagaaatgatgaaaatacagagattttttgggattaatttagggaaaattaggtgatttcagctttaaaaatgatcggggagaacaatttgattgagtatccatactgttgatttatcaatgccagttgattaaaaaaaattcttgctggaggctgctgaataaccgaaattgtgttgaactggcactcgaaaatatttatactacataatttggtggttgttgccaccatcttgaatagattggctgaattcaccagttatttggattcatgattttttaattgtgttgcataatcttctgcttttccccaatgtcccatttcagtttatagaagttacatttattcatttttttttaagaataattattaaatatgttgctgcaacctatgataaattgataatgaagctgtggcaattaatacgtgtaaaggcaatggctcttgcctactttaaaatcacagacaggcttagtttagttcgaatctcattgtgagccatttttttctt

SEQ ID NO: 87172 - DNA, 676 bp, Oryza sativa
ttcaagtagtcggactcttttaatcggatctgatgataccctgagtagcaatccaggaaactgagtagctcgcagccggccgttgagtcaactacctggtcaatgcgaggtaacccgaagggatctttgggacaagatttgttgaggtcggtgtaatcaacacacatacgccattgcactgtcctcttccgaaccaggaccgggtttgccagccagtcgggatgtaggacttccttgatgaagcctgctgctaacagcttggtcaattcctccgtgatcgcatccttcctatcctgtgcaaaacggcggagtcgttgcttaatgggtttagcgtcttccttaatatgtaaagagtgctcaataacctctttaggaataccaggcatatcagatggtttccacgcaaagatatctttattattttgaagaaaggtgatgagcgcgctttcctatttacaatctaactcagcgcttattacagcagtcttagtgggatcagagggatctagaggaattttcttagtcttggcatcgccttctccgctctttttggaaattaatttcctttttggggggaaattttgcatgtacaccctaaaatcttaaatatataattgttgttaattggaatattagaattgattttaaaagcctagaagagaagatctaattttaa

SEQ ID NO: 87173 - DNA, 565 bp, Oryza sativa
  unsure (1)..(565): unsure at all n locations
attcctgcaccccatctatgcaaaatgtgcacttctcaagttaccaaataaacgtgcatctcgtagagcatcaaaaacagcacgcaaatgaccatgatgatcctctattgatctgctatatgtgagaatgtcatcaaaatataccaccacaaatctgccaatgaaagcacataaaacttcattcattaatctcatgaaagtactgggtgcattagtgagaccaaagggcatgactaaccactcatataggccgaatttagttttaaaagctgctttccattcatctcctaacttcatgcgaatctggtggtaaccactacgcaaatcaattttagagaacacaagtgaaccactcaattcatcaagcatatcatctagcctagggataggatgaacgaaaaatctgaatttttaattggaaatggggtttttggggtttacccaaaaaaaaaatttttttttgggggccgtctacaatccacacacatgcgccatgagccatctttcttaggaactaaaagcacggggacagcgcaaggactaaaaaactcacncacatacccct

SEQ ID NO: 87174 - DNA, 523 bp, Oryza sativa
agttcataccatttggagcaggcctaagaatgtgccctggtttggcatttgcgtaggttagcatggagcttgctcaagcctcattgctatatcatttcgactgggaactccgtagtggtgttgcgccaagcaatctagacatgtaagagaagatgggtatcaccatccgaaggaagaatgatctttacctggttccaaaggtccgtgtgcctctatagtttggctcgtaactgcttcacacaatatgtgtctcctgtgacccgtacctgccaagtagcgatcatgagcattccattgtgtttcatgcccttatggtgttatgctgctcaacttttttaatgttttctcgaaataagtaccatcatagttgttcatgtaactataaattacgagtttaatttgtgtcgtagttaacaagctcgagttgtttgtgttgttttccctttgctaaaatgctaaaacattcattggagagggagagagtggtgtaagctagtcctaaagaaaattaagaacaccaaac

SEQ ID NO: 87175 - DNA, 523 bp, Oryza sativa
gtcgaggctaaacttaagcgaatggtgcttgttgggcttgcatgcagtcagaacaacacagaaacagagcccgataatgtctaaagtcgttgagctgctcaaggaagaatctgttgagaatctttccaacttggagaataatgagatgttcaagcttgatctgaccagctccttccaggactcatctcattcgtctcatcctgatagttcagactgcatcacaaaagagaagaactcaaaagcagatacaatagacgaggcagttgattcaagtgagacagtaccttcagctaggtagtttgatgcatagaattataagttatctgtcattcatcagcaggagttattggtttccttccgtggagcattgtgtgtttacctctgcatgcgtgtttatgccttgtttaccggcaggtttgggtgcttcccttgtcatctcacagatatacttatctgtgtgtatggttaattgttacaatctgttttcggtatggttgtaccatggcttgtaaaattctgcata

SEQ ID NO: 87176 - DNA, 616 bp, Oryza sativa
ggaagtgcaagctcaggtttggcatataatcgtagactatcaggcgttcttggccttcggcacaatagccacgtaagctcaacaggctcttgtgtctcactgtcgccaaaacctccacctcaattgcaaattcagtttcagctttgttgctccaactcttgagccttttcaccgcaatctgtcccatgtagttaacagaagaagcgttaggttctggttaaagtgaactactttttcctgattttggattaaacagatagaaggtaaatagttccaacataatacttatgatttatgaaatgatgttcaaaaacatacttgtcaaaacgatagtttgaatttgatattgtaggggctgttcaaattgatgctattttcaaccataccattttttggtaaagctgccaaaaaaatgtctatgtttagtttggtgtcaaatttggtaaatacaaaaaaaatcctgccaaaattttagcaatattggtattttaaattttggcaacattgccatcttgctaaaattttgctacaatctgaataggcccggaattttttttcacccaaaatgaaacacaactcaccgggatgtagcagtttgggggttatatcaccatgc

SEQ ID NO: 87177 - DNA, 603 bp, Oryza sativa
actatagggcgaattcgagctcggtaccccgcatatgtagcagtagacaagtagcatctgcatctgcgtgccatacacgattgctccagctagctgcacctgcacatcgccatggccatggccgacctggagttggagaaggttgcgagcttcttgctggcggcgctgctgccgctcgtgctcttcaagctggcggcggcgaagcgcggtggtggcgatggcggcatgaggctgccgcctgggccgtggcggctgccggtgatcggcaacctgcaccagatcatggcgggtggccagctcgtgcaccgcaccatggccggcctggcgagggggctcggcgacgcgccgctgctgtcgctcaggctcggcgaggtccccatcgtcgtggcctcgtcggccgacgccgcgagggagatcatgagcaggcacgacgccaagttcgccacacggccgtggagccccaccgtgcgggtccagatggtcgacggcgagggcctcgcgttcgcgccctacggcgcgctgtggcggcagctgcgcaagatcaccatggtggagctgctcacccgcgccgcgtcaggtcgttcccccgcgtgcgggaggagg

SEQ ID NO: 87178 - DNA, 628 bp, Oryza sativa
tttcttgagccttgcttacaacaaactaacagggagcattcctggtgctattggtttcttgccaaacattcaggtgcttgtactgtcagggaaccagctttcagggccaatacctgcatcgctgtttaacatgtccagcttggtacggatgtacctgggcaagaacaatctctctggctctatcccaaacaacggaagcttcaaccttcccatgctgcaaacagttaatctcaacacaaaccatttaactggcatagtgcctcaaggctttggggcatgcaagaacctgcaagagttcattctattcagcaatggcttcaccggtggcataccaccgtggctggcttctatgcctcagttggtgaatgtctccttgggtggcaatgacctttctggtgaaatccctgccagcttgggcaaccttacaggtctcacccatctggatttcaccaggagtaatctgcatgggaagataccaccggagctgggacagctgacacagctgcggtggctgaaccttgagatgaataacctgaccggtagcatcccagcctctatcagcaacatgtctatgatctctatccttgacatatcctttaactcattgactggatctgtgccaaggcca

SEQ ID NO: 87179 - DNA, 657 bp, Oryza sativa
aatctgacttgatcttgtttaacttgataactacttcattcattggaactctgtcatcaggtgcatctcttgagcaaagcaagcccaactcaattatggatgctagacagatattcaagatgattgaatcctcagatagcttactcgaatcctcagtaccacccgtatgaccatcttgttgtagactacagtcggcgacatttgagagctcatatgggaatgcttgactaatccattgcctgaaggtcaactcattgacgaacattggatcagttggttttttccttgtgaagacttcgaggaggacaattccgtagctgtatacgtcacttctgcgtgatgcttttcctgttgatcctaactctgtttgcaccatgtcaaaagagaactggtcagcttaagttagatgaaacaagaatacagattgtacagactttacaagggttatcacctggtgccatgtatcctacagtgcctggcatactcgttaatgtgatagagttgtcatctccaaacagcaacttggaattccgaagtcggcaacatgtgcaaccatatcattgtcaagcaaaatattgcttggctttaaatcaaaatgcaggacaacctcaaagtgatggtggtgtagatactccattgccatcgcaacatccagca

SEQ ID NO: 87180 - DNA, 1271 bp, Oryza sativa
gacccccacgaccgcgccaccgctcgtttttgggcgacctacttcgacagcacggtaatcgatggcatcttcctgaagaaatcaaccttagatagatagcaacgttcatgtcggtgattgagaaatcaatattagagagatcgacatttttgttttgatactgtattaagttcttcccgccgtggagggcgctgatgagggcgacgacggcggagcagagagcggaggccttcatgaacgccgtacctcaggtggaggtgctggagcgagcgttcgtggagtgctccaaggggaaggcgttcttcggcggcgacgccgtcgggctcgtcgacgtcgtggtcggcggcttcgtggtgtggttcaaggtggtggacgaggtggccggctccagcctcctcgacgaggccaagttcccgggcctggcggcgtgggcggagcggttcttggcggtggacgccgtccgggaggcgatgcccgacgccgggaagctcctggagcactacaagggatttctggctaaattggcttcgccagctggttctacctaatggcaatctatctgccttgctcgcctgctttgacgatgaagaagttgtttggtactgtgtcatgtgaaaatattttgttagtctctgttgagcggtgttcagaatgcaaatgtgtacatcttgaataaaaggagagcaaaatagtgaggcgacttttagttgtacaagtataattttgctcaatcagcagtgtgatcacaagggtacagatatgagggggcatagatgaggtgcacgattttttttttaaaaaaaagacgaatcgactcgagtcgattgcttcaagttttttttttcgcaaattgctcttcatcaatcacaaattatttatcaacatcgcaaatcacagaaagtgaatcacaaatttttggcacaaatgcattactactcaaatcagaatccatctaatatccaagtattacctatccatttcagcatcaaaggagaaaacaacatcaacaagggagatcggaaaaaccaacaaatcattaccgaatccataaaaaatcaacttgccaagggtatgggggagggagccaccgattctgctagtggtcacctccgtagtcgtggtcccatccgtgccggcactcgctataggtgaagtctgcccgctcgctcactgacatcgagtgacccacttgcgcgtggatctagccatccccaagttctcggtgatcgaatctagcgccgagctcacaggaaccagcaacccatggtgat

SEQ ID NO: 87181 - DNA, 1167 bp, Oryza sativa
gaaaaagtacgaattactcccccgaactatcgcggtcgaccgacttacctccctgaaccacaaaaccggacattcttcaccccccaactatgcaaaccggacgaattacccccctcgacccaatttgcggtggttttggtctacgtggcatacgcgtggcagcccagtcagcattatatttataaaaaaatgtgggacccacatgtcatactctctcattcttcctctctctctcttctctctctcgctctctgtctcactcttcctctctctctctctctctctctcacggtcatgggtcggcggcggcgggggacgaggaggaggtggcggcggcgccgacgggggacgaggaggccgcagtggcacgggacggatggacagaggccatgacgaggaggcggcggcaacgcgggatggacggacgaaggcggggacggcgggggacgaggaggccgtggcggcgcgggacggacggacggaggcgggggtaggttgtgggcgggtgtggacggtgccgagagatgcgtgctggtggcggagctggtgcagatgcaaggcatcttgaggcaactggaggtggaaatgggcacacatgggggcgttggcggcaggggtagggcggcgatgtcgtgtaccacggcgaccacacctgcgcgcacggagcaacatcagcagccgacgctgccacagaagtagaacgccgtcggtcgcattcacctccatggccgtcaacgcatgtcgtcgtcccccttcgtcgtcgtcctccactcctccgtcgccatcctccactcctcatcccccgccaccaccgacccgtgagagagaaagaggaagagtgagacagagagtgagtgagagagaaagagtgtaagagtatggcatgtgggtcccatatttttttatataaatagaatagaatgctgactagactgccacgcgtacgccacgtagaccaaaaccaccgcggattgggtcgagggggtaatttgtctagtttgcatagttgggggtgaagaatgtctggttttgtggttcagggggtaattcggtcgactgcgatagttgggggggggtaattcgtacttttccctttttgttatgtgttcttctactagaaccttattgcttttagtttgaaacagattattgagcagattgttgcgg

SEQ ID NO: 87182 - DNA, 936 bp, Oryza sativa
tggttgttagtacagcgcatgggcttaagttcacacaatcgaagatagactaccatgacaggaacatcaaggacatgctgtgccagtacgctaatccaccaatcaatgtgaaggctgactttgcttctgtgatggatgttctccagaacaagctgaatggtaagatctgagctttagttaaccccccatggccgttatcttgcttattgtcaccatgaactcctttttctgcatcttattcaactgcagttgatgaacttggtgtgtcacagtaatctttaatttgtagtactaggttttgaggctcttctaactatacacataagtggatagagctgttccttgtactttatatatgtatcatataatatgacaataagtggttatgccctagcacttaattgaataattgtttcgaatggatacctgtgactgcctttccgattgcttttactcactattgtctgtcaaattgtcaatgacaataagaaaccctctttggttgcatggtttgaagtctgaactgatagaatttattaaacatttcagttgctgcaaatcgctttagttttgttagtcaagaattcttttctgaaaagcataatataatccttgttctcaagacagcaagtgttatatagcaccgttgtaagtatataagaaaatagttttattagaactacatagcaatgttccatgttcagagtaaactataagtggatatcctaaatttagttcggttaaaactgtaaaatctctagtgtgctggacctatcactatttctgaatagattgtcatataggttgactgcagtaccacagtctttccatttagtagctttaagcctttaagctagattgtgttacaaactgaccaatcattctaggtggtttgaatatcctgtgacaacaaataaaatgtgagattgatctttt

SEQ ID NO: 87183 - DNA, 1145 bp, Oryza sativa
atatgtatatacaagtgttgattaagtaatcactcatttgaatacgttgttacttgcacacactgaattgagccataccgggtgcattctcctcttgttcttgcaaggccgctgcacgccatgagctcataaacccgtagcaacggcggcacaagatattgttttgcagcacggcaggagccggctggaccgctggaatatgctgctgaaccgccgttcgctttcgccactatttgttgcgtagaaatgtagaatcgcgtccattttcagagatatggtgatcttgtgtgggagcagtgctgcagcggctctggtggggtccccgacgattcctccagcccgtagttactatccatccaaaatcattttgcatgacgttgtcctctcgatctcgattttccacgttccaaatatgcgatggtagttcgctcttgtcccaaaaatggaggatagcgtacagctcagtggatattcactttttttaaaagaaatacacagtacaacagacactcacaatgcacgcatactcacccctataaaaacgcgtaagcaacagtggcggattcaggaaatcgattcgttggtgtcataatgtgtctatcggtgctatagtatgctaatcatgcttagattatggtgttataacatatgggtaaacaattttgctatagttttgccaaaagtcgtcggtgtcgcctgacaccggtccttcttctactgtatatccgccccttgtacgcaaaccctacccctataagcatcttcaaagactggaccagcaaatcaaatcctagagattggtgaagtcactttaggcgtctcactgtcgacgggcacgtcgcctactactgaaagcacaataccgttaaatcctgaaaaatttgctcccatggggagtcgaccccagcacctaaggtgctaaaatttcaatgcaatatgaatggaatgcgaacagtaagctgctacctacatccataaatataagcaattttagaatgagtacacgtttatcgatctaaatggaagaaaaccgataattgagccttgcaatatccattaaagggaaccggatcatttcataaaaagtgaatcgggattttttttttcttagtgctataagattgaaataatgatcttccgatgct

SEQ ID NO: 87184 - DNA, 850 bp, Oryza sativa
gcgcgccatggagaagagccacgccaagagcgacgaggcggcggaggacgcagcgaggaggaagaaggaggaggcgcaggacaaggcgctgctgaagaccgcggaggccgagctggacgcggcgaagaaggagctggagacgatcaaggccgggagcttccagttcatgacgtccatggactgcacgcgcaccgagatcatgcgcgtcgccgaggagatccgcctgctcaaggcgaaggaaaagaaagcggacgcgcaggtgcaacagctgaacaccaagctcctcaaggcgaaggcgcggttggaggccgtcacggcggccgacgagaggtcgaaggcgatcgtgtccaacttggcggcggcgatgaagcaactgaaagccgagacggaggcggcgaggatggaggaggacctcaccaagctggagaaacggtgcgtgatcgcggaggccgagaacatcgagaaggagatcgccacgaccgagggacggatcaagcagtcggtgaaggagctggatgcggcgaaagcgttggaggccgaggcgatgaggaagctcagggcaccgtggagagcacgatgcaggccagggcgtcgtcggcggcacggcggcaggggacgatgaccatctcccggttcgagtacgagtacctgaccgggcgcgcggcgctggtccgggtggtgaccgacaagaaggtggccgcggcgcaggcgtgggtgcaggcgctgaaggccagcgagaaggaggccgcgcgcgcgccaggcggcggagcgggaggtgagggagatggaggccagggcggcgcatgtggcggcggaggcggagaagacggcggcggagcagaaggagctg

SEQ ID NO: 87185 - DNA, 518 bp, Oryza sativa
acaggtcaaatccaatcgcattggtggccactcccgagagcagcatcagcgggtgattcctcttgggcgcctgcacaaaccaagctagaaccaaatcaacaaccataaccactaaccagccgccaccctctccgctgggaggggaataagcacgcgcacctcaggcggcgggcggtaccgccagagcgcgagccgccactctgtgccgggcacgggcacgtagtgcagctcatccgccgtgcagatcgcgggcttcgccccctgctcgcacgcggcggccgcggaggcgagggcgcgggatggcgacggcgaggatggttggggcggcggcgggggaggcggcgaggcgcggtaggaggcgaaggcccggacgcgcggcggcggcgggggagccggagggggaggggcggacggggaggaggcgcgcgcggtggcggcgggggaggagaggtgcgcgaaggcggcgccggcgaggaggacgcggaggttggccgcgtggaggagcggcatggcggttg

SEQ ID NO: 87186 - DNA, 703 bp, Oryza sativa
gaacatcagctcaccaataggccgatacggagtgggcagttattgagcagtagtagtaccactgcaagttttggcatatcaaggaggggtatgtggtgtgccatcaaagaaacacattaggagtcctaaaccacaataactgaaagaacatgtaatatctcgctatcgacgaatactcatgtcaagtttataatctgaatttagatgaacaggtttcaccacgagaaacataaccaagttcataacttagaccgttttagactgatgttaaaaatactcattatcaatattttggtagtttgaatattgcatatgatgattttggttagaagataaactttgattctaccaaaaatttggtttctaatatatcaaatcaaataggaaaaagtatgaattacccccgaactatcgcggtcgaccgaattactcccctaaacctgaaaaccaaacatcattcaccctaaactttcaataccggacaaattaccccctcgacccaatccagagtggttttgtcctacgtgcgtacgcgtggtagtccagtcagcattttatttataaaaaaatatgggacccacctgtcatactcctctctcactcttcctctctctcacttttcctctctctcttctctctcactcttcctctctctttctcgccggttggtggcaggcagaggatacggagcggctgcgggtga

SEQ ID NO: 87187 - DNA, 1050 bp, Oryza sativa
cgagaggcatccacgccggcgactcaccccacccgcgttgccggccatcagatccgtcgtcgacgcatcgccttgcaccggatccgcgcggagatggaccccaacggcttcgatttcttctcccaagatcccatttcgtccgccgccggcaacatttggtcgtcgcagccgtcggcgtccggcccttcccacggatccgttccccgcgccggcgtggacacgctggacctcaacacccaggcggcgtcgggccaggagttccctcacctccacgagtacggtgccttcctccagggtggcggcgaggaaggagctggccgcggccgaggctccggtctccctcccatccgtgcaccacgctctctgggagtgagggctggtcgagggggcgccgggccatctcgtgctgcaccgcgtgcccgccagctcaacttcggcgcggtaggtggccgtgctggacacggtggaaatggtgggtcgtcgtcgggcatcggcggcggcggccctgggcgaggcagctcctcatcaggggcaacgggtcgccgtcggcagcgcgccatggcaaccaaccgtggccgcgaccgcggacgtgggggccgcggttggcgtgtgccgaggagtgtcggcacccaggaagcacccatcggcgattacgtcgaccttgacgaagaaggtgcatgggacgatgaggtggaggaattaggcagcttcggcggccctccggtgagcattgctgaccgagctaactggactgataggaataatagtattttgttagcattgtgcatagagcaagtaagagcaggccactacaatggtagccaaatgaattctgatggctataatgctatagccgagggctaccatgccaaaactggtttgatgcacatcgtctgcagctaaagaatcaaattgggattctcaagagcacgtactccttctggcgttacttgcaaacgcacacgggcttaggaagaaaacctgatggaacagtcgatgctgattctgatttctggagtagtcacatagaggtacttttctaccattttt

SEQ ID NO: 87188 - DNA, 588 bp, Oryza sativa
aaaagagaaagaatcgaaaaccctagcgttccgctctttccaaagctgtaggaaaccaagaggaccagagagtcgaaggccttacgaagatgctaaggcaggcaagccctatctaccggccaccagacctgaagagaatcgctacggaggggccgagcaagcctaggcaagccaaagggagaccggatgtagtgccaaacttaacgagcgaacacacagtcgagcatgatgtggctcgctatttcatgcttctgagcgcaaaatgggcaggtcgagcgtctgtcaatgccgtgcttatgcagatgatctgccgcctagcaacgctgttggaacacgtgacccatgacatttgaaatcgaagttgggaaaaccaaaaataggaagaataagaagaataggaacaggaaaaaaaagaaagaaaataaaagatggcaaggaaaaataaggaagaaataggaagaacatgagaaaaattaggataatcattgtgaaaaaaatagatggccaacggattaggatccgctgacatgaagtcagagggacgtggtgactgatatgtgggcccaaccgctcgcgagcccacctgtc

SEQ ID NO: 87189 - DNA, 2519 bp, Oryza sativa
catccttgtaggtaactcgatcgtcagaggcaatgacgattgtggaaacaatattttagcaatataaagggaatagcgcacgagacctaaaagtggatggatgcggagacaaaggatttagatagttcaggccctctcaatgagaggtaataccgtactcctatttggggatttgaatccactgggtgtcttatagatctgacgatctgattgtgtgtcaccttatataggatggggggggggcatgattacaagatagaaaccttaaccaatccgatatcggtttcctaaatctactttacaatattatcaaaccaagactttaggccgttccataatatacaaggaaacgtaatacccaagtcatgatctgttacatattccatagatataagttatcccctataactagtcggattaccatgtcgtgtgggtatggggtacctataatctccacagtagcccttgagaccttcacagtcgaaaagataatcttctctcgaactagattactccaaagccgagtgtttcaatcatcttcgccattgtctcctgagtacttttaccaaatcagaagactgtggagggctgaaaaataattaaatgaaaatttaggtgcatcgactagatgtacctaataggtgtagccccgactacgtggttacttgaacaaaccaagcatagtcaaggaataaataacatgatccgagtgatataccaactgctttgtaaaatatgatgcgcgcaacctaaagttgactacatcattgaaaataaaatagctataaagaagcttatatgctgtgaataaagaaatttctaaagtattgggcacacaccatgcacacattgctttaacagatgtgcttaagtctctaaaagacacatggttgcaccacacccaaaaatatatggcatatgtggtatgaaatccgagtaaataaactcataaaggatttaccaacagcctagaaaatgactggaatatataatcagcctaagccataatattggttaataagaaatgcacacttacgtggcaaaaaagcaacgatactgtaccaatcgattgcttttataaacccaaacagcgccatgacttatataaaaaagtcagcgggatagcgatataaagcctcactatttgataccttttaaaatgcattctaccaactcctaaatagttgagtaacagcggtataaaaggattttaaggtattgggcacttgatcacgcgcacttttgcctaagcaaaaaatgcctaagtccctaaaagaacgtgacatgccacacctgaaaatatgggttgtagacatattaggcctagacctaaagtatgtctaccggtgcccttaaaatatgacgtatagaacacaccaattaatatgatcccaagtgataaatatcctgggtgatgtagatcatgcatatctcatctgagtgggttctgatctgagtaattatccctcatggagaataccaaaatagatgtgataattgaatcccgactggcgcaagtactcagttgatggccctcgtgggaaataatgaatagtccaatcgttgagcatgaccatgaatccatgttgaatgtaaccagaataagtccgaactaaaaatatgatccttgtgtttgagctaggaagcccctatgcatgtagcttatccttttgttgtagtcacaaatgtccattgatggtagctgacacagttggcatgtagacgaaatgaccaacatgaggatgatatcacccatcaaagccggcggagatgttgatggtgctaaagacaatgacaccaatcaaaggtgacgaagtcacatagccatggaggcgaagaaaccagtcggcggcagacaagttagccaatagtgaagacaaaggcgcccagcaacggcgacagagttgtgcagctatggcagcgaaataataagtcgataacagacgaggtgcccggtgaagaagacgaagacgtccatcagtagaggcataataagcaagccgtgaaaacgaagacatcatgggtggcggcggaggcaagccggtggtgaagacgtggacgctcatcaatggcaatggcgaagtccatcaatcatgcaaaagaagaaaacaatcggtgacggcaaatgcaatcggcgataatgacaattggcggcaatagagatagccggctatgatgacgaagttgcgcatcaacggcaacagagtaggtatagcccaagaggcatggtaggatgttgatgaagataatggtattgttgatccaatcaagtagtgtagtagtcaatgataacgataaggtctcccatcggtagttgcatagcaggccaaccgtgaagacgaaataagaagtcggcgatgatagaagcaaccgaaggcgaagacgtcagggccgatgaagtagaggtgctggtgatgaagtagaggtgctggtgataatatcaaagcttgagtagtttccttgacggtagggtgtgggtattgtagattgatgcaacgcctttttatttatgaaaaatg

SEQ ID NO: 87190 - DNA, 518 bp, Oryza sativa
cttgcaccccctccacgggggtcccttttataccgtggatcatcttgatctccaagtaagacttggagacatcggatcccgtacaacacaatagaagctgtatcccctccgtgtaggactttgtaaatcacccggcccgtagagatattttctataattcgtaacagattcctacaacgcatacggaaacaacctgtgtacgtaaaggtataccatactcgtatattctataagtcgtaggataggagactttcataggtcataaactgccctcacagaccaacacatgtcttttctgcaacactttgtcctcactcgtgtgcacccggaaagaatttctcggtcggccacccatcccaaattgctccaggccaagcacgcttaaccctagagttctttggagattggcttcccgaaaagaagttgcaacttgttgatataagcattccattaatcttattaagccctaggccgggatgttacattacatatatatttttttttttcaaaaaacctgg

SEQ ID NO: 87191 - DNA, 838 bp, Oryza sativa
caaccaacgttcaagtacctacagtccagcaacagtgcaagttatcagaatttctcaaaactgagactccaacctttgccattgtcgtcgaacctatggaagccagtgattggttgcgcacagtcgagaagaagctggggttgattcagtgcacagaccaggagcgggttgtcttcgcaactcatcagttggttggactggcttcagaatggtgggatagctacgaagcatcacggccagaaggacataccatcacctgggacgagttttcatctgtattcaagagatcccatgttcccgcaggaatgatcacactgagaaaacgagagttccgctacctgaagcaagaagatttgaccgtcacagagtacctgcacgagttccatcgtttggctcactatgcaccagaagatgtggaaaatgatgaagacaaacaagagaagtatctccaggggttaaaagatgagatcgcagtgcaactactcctagaggaatatgaagattttgagaaacttgtggacaaagccatacaactcgaaagtgagcataatcggatgaagaactgtaagagaaggattgtcagcatcccagtattcccatgtggtaaccaaagacagcgcacggagccacttcagatcaccggatcttctgttgcgcatcaagagtttccgccccaagaagatggacacaatgcagacaacaacattagcaatactaatgatgatgataccaccaacaaccatgcttcttgccccattagtgaccactcaaatcaagcgtgcaatgtcaacatcattcaccaaggtgtcgacgatagtatcaatgatggcacccaaaa

SEQ ID NO: 87192 - DNA, 546 bp, Oryza sativa
gatggagtatttgcatgagtttaacaacttggcccggtacgccccggaggatgtgcgggaagatgaggagaagcaagagaagttcttggcaggaatggacccggagctgtctgtccgtctagtctccggtgactatccggatttccaacgtctggtggacaaaagcatccgcttggaagccaagcacaaggaactggagtcgcacaagcgtcgcttggcgaatttccgcaaccaacagggtgctaaccaaaggatccgctacaccaatccctatccagggggatcttcctcgcagcagcagcaacctcgctccgcgcctcgacctcaattcgtggtgcgcgtcccacagccgcagcaacagcagagccagcaagggacccatgcgccccgtcctcctacgccagccgcgcagtctggtcaaggccgcagggacgttcaaggtccgcagcgtctgtgcttcaactgcttcgagcccgggcactttgcggataaatgcccgaagtcgaggcgccagcaaggccaagcgcctccctgctccaacaacgg

SEQ ID NO: 87193 - DNA, 606 bp, Oryza sativa
cctattggatcttctagtcgtgtgtctcagtactggattcctaaatttttgttatcatctaaccccagtactgaggcttcgacttctgcttgtgtgtaggctttggtggcgcggaaggagaacatgtggatcgtagattccggttgttcacggcacatgaccggtgataaaaattggttctcctccctcaaaaaggcatccaagactaaatcgattatctttggtgatgcttctacaagtctcgctacaggtttggttaaggtaaatgaaaattttgaattgaagaatgtagctttggttgaggacttaaagtacaatttgctttcagttttacaaattgttgatgaagattttgaggttcactttaagaaaactggaagtaaagtttttgattcttgtggtgattctgtgttgaatatttctcgatatggaagagtgtttaaagctgattttgataatcctgtttcacctgtgataatatgtttggtagctaagtttgataaagatatgatgttttggcatcgtagacttggacatgttggttttgatcatctcactaggttaagtggtttggatcttgttcgtggtttgcctccacttaagaaa

SEQ ID NO: 87194 - DNA, 923 bp, Oryza sativa
tgaactgttatagttggctatatggtctgctaattctacgctaaaacaagtttgcttttcacctgccaagtgccaagtgaagtcatggcaaccaaatttcatgtaaatgctctgaattagtgtgactactaagaacacaagactattcaagcaagaaatcctcacccgcaacttatagaacaaggcaagggcctccctccacaggccatgcacagcaaatgccatgatcatagagttccaagaacagagatcctgctgacgaccgataccctgaaacacctgccaagcttgtcgaatgctgccacacttggaatacatctccagtagtgcattagccacgtacacattcctcaggaggccttttcccctcgcatactcctccaccttcctcccaagctccatcgccccaactgctgcgcatgcaggcagcacactgctcactgtcaattcattcggttgtacccctgccctctcccacatctccaagaacgtctccaccgcttcctcatgccgaccgttctgcgcgtacccagacaccatcgcagtccaggaaaccacattcctatctggcatttcctcgaacagcttctctgccgaatcgacgaggccgcctttcgcgtaggccgaaagaagcgcattgtacacggccgtgtccctgcacgtcaattcgtcgaacaccttcctggcttcaaccaggagcttgctcttggcgtagaatgagacaagcgcggaggagaggaagggatcgcttgatgcgaagtggcctaatttgataagcagggagtgggagcagaggaagaagggggtggaggaggaggcggacgaggaggaggaggagaagaggagagtgaatgacagcggagtgaggaggcgaaggcgatggaggcgggagaagaaggggaggaggagggggtgggggcggt

SEQ ID NO: 87195 - DNA, 560 bp, Oryza sativa
ccgtgcgtctcattcgcatgggtgttcatttctgttttgacacccatggctttgaggttagtctggtcattaggaaggccagcagctgccattagttgctttggctcgtgcatgttttgtactggaagttttgctgcagtttgcttgggatagctcttcagaccctctgcagatgaacagggaaaacattaaacatttcaaagcataaaaaaattgctgaattttacagggaaaaagggggaaaaacagctgcttcgctgttatcactgtattatctaaattggtatgctgttataatctagtatccagcaacaataataataatttaccaggtaatccttccatacggcaaccacacaccaccatagctagttcaaaaaccatgtttaccaagtgatatcataacaacaagtatatgatgttggatttggtttgccatggatatgcttttactatctagccctgtaagcattttccccaaacaatagaatatctctcaacacttcagaccaaaagaacttctaggcttatgcttattaccattttcatgcaaaacattg

SEQ ID NO: 87196 - DNA, 1453 bp, Oryza sativa
gcaaacccaagcacatttattaacagccattacctaggctcctgtttagaccacggcagaaagccttttatcccagttgttgttgtttaacagtgtgtttttcccttgcataaagaaaacaaatgttcctttgcttaacatcttttggactgttctcattttagtaaacctttgcttttatggtgatcagttacgaagatggaagcacacttttgtgggatgtacgaaatcctggtctacctgtatcctcagtgaaatatcactcagaatcaggttgctctccattctgaaaattactattttagttatttaacctatccttttttcagtagtagctatgtttatatctttggtgtttggaaataatgtatgatctaataagagtctggtgtgcagctttatccattgctattgatgggctatgcaatggggggatctcaggaggtgctgatgataaaattgtcatgtttggccttgatcatcaaaaggtgtgcaccaaattttctgatttcctgtttcctgctacacaaatctttactcttgtcgtgaaaggtgcaccttgtgagtacaaaaaaccatgttatgtacatgcagtacaaagctagcccaagttgacattgattttatgctttctctgatgtcgtgctattaattatctccaattatctgctagtcattcaattatataaagaaataagctgctaaggagatctttgcattcattatttttctgtaatattgacttcaacgtcatctgctattgtcttcttgacaaggttcataagcatttcaatttcctaaatgatgcagtatactgaaggttaagtttagcagtgtttaacactcagaagtaggcctagagttggagactgcactattatccttctgatatccacttctgacatctgtgatatttgaatcccttcatatctgaagcaagaaacacgcgcacaaccatggtttttttattagctagatgggtagtaattcttttcctcagggaggatagtagttatttccagttacaggcatataaacattctacatttcataacaaaattatcaccgctggaaaatgcatttgcttctgttgtagcttttgcaattacattagtgaatgctggtttaacttggtaagccatcttttgatttactggcatgcagttttgttccaattacagggtgcatttattctcaggaaagaaataaaacttgagcgaccgggtatagcaggcactgcaattcggccagacaacaagattgcagcgaccgctggttgggatcacaggtttgtttttcccattctgttccttgatgaccaggatgttaacataagctatttttagtggcttcctaaatcctgaattaacatgctcaagttagtaggtacattatacatatgatttaatatatataatctattaagtagtaatacctgagtgacgagtacaaa

SEQ ID NO: 87197 - DNA, 703 bp, Oryza sativa
gagggatcttcatctgcgggaagcagcggcggcggttgggagctcgcggaggcgctggcgcggcggcggttgtaccgggaggtgacgctggcgctgcgcacggggctgcgcgacgccaaggccgacttctccttcctccgcgcgcgggggctccgcagcctcctcggcttcctccgctccaccgcctccgccaccgacgactcgcagctgctcctcttccggcattcccagtctatccccgatctccaaggtacaaaccgattttcccatccattccggcgatccaacgatagggcaccgggttgttctcgtgattctcatccggcgccgtaattggagcgacatttggttggcctgatctctaatgcaatgcaatatccagtggtggttagaatgaaatcgatgaacatagttactgtcttgccacaatcggcacaaatttaagatgagagcatcgagtaaacctatttgttattagatgtaacatgtcagtcagaacacaagattcagtattaggtgataagcgctgattgagctggtttagtttggtgctgcacaaaacttggttcattataaatgaaacaagtgctcttggtggtatgtgtttattatatcgatgctaatgctttctacttctcttcgtgatgcatttatggggagagctaacctcataacggtaccttgataatctctttccgagtta

SEQ ID NO: 87198 - DNA, 1716 bp, Oryza sativa
tgggccgggacaaggtggattgcataccttattttcaaacatttctttgaaacgaggatcagtccactatgccttggtcatttccaggttctttttcttcttcttgatgcccgaattttcatccttctccaaatcagcatccatttcctcttcctctttaaggatattatccattatttggccggtaacccttggtattttccccacctggctgctgaaggtaaaaaagggccaccttccttaaaggggatggtccggacctggtaccatgtatccagccaaggacccctttttaagggcagacaaaccggtattgcaaaatttctccggttctccaatttcttttggttaaccctctcttggatattctcaggatccacagcactagtagctagtaggtggaaagaaatgaaaatgttagtaaagagcatgttcaatgtattcgttcctgccacccaaccccacatacaaaaattccaatataggcaggccatttttatattcaactctaaggtcagatggctttagatgggatatacataatgacaaaaaaaaactggtccacaaaagagtcttcatgttactagagaggttgactgcaaccatcctacagcagcatgaattcacttagatgtccacgaaaacagtttaccttcttatatagctgaagtttcatcacatatccatgcatatgcgctctcacaagaccctgatcaatgtacttagagagatcatatcgatccatctcatcttttgttaaaaacttgaaatcttcatatacaatattctctgtcttctcttccatttcttcctgttcaggagaaattcatagttggtagtgtcagcaaggtttattagaactagaaaaatagtgaaaattattcactcaccgttagattatcaagatgcgagcaccactttggagcagggcccaatgcaggaataaagtgggcagggatctggctattgtccaaagctaataacatcaaaccactgttccggaaaacacaaacatcattgatagtaccaccatctggttcaatgctagtcatgttatttccctgtagaaaagggtaaggccatcatccaacaaagttaatgccttccaggaaaaaatgaagcctgcactttccaaagaaagaaaaatggaagaactcactgtattaggatcccaaactctcactatatgcttgtcagcagtaatcagcttaggttcagtagaattaagtgtctggtgccacttaatacttaatattgggctaccatacctgcaataacagcaagtacatgataatatattatccaatgcaggaacatttcagctattggctaccacggctcaatcccccaccagcagcacctttgcttttataagataagatgatcctgacttggagccaagagaataactttttgaaaaactaggtggggttcacaataagattttcatagagaatcacatctagtaagagtatctcattttctccaaaagtccttatagctttgacatgtactaaaggaatatggtttatgatgaaagcatgaaaccttttctttttaaaagaaaagataccgaacttacatatgatccttaactcgcaaaggggaagacatacgtagatcatatattgctacctgcagaaaatcccaaacatttaagactaaaaaatgataaacaaaaatcgtcatttttacagattgggttgtccatgaaca

SEQ ID NO: 87199 - DNA, 1023 bp, Oryza sativa
tctgcccctccctctgcctctgcctgtgcctcctctcctaccaccaccacctcctcctccaccttttccaccaccaccacctcctcctctcccacgacctcctcctcctcctcttcctcttcctctgccacggcttccaccgaacaaatagtactcggctttgccttgtttcaagcccagggattgcacacctctcctcttgaaatccttgggctcttcgtcatcagattcttcggtgcgccttcttgagcctctagcgatgaatgagattttgcgtgaaccaccaggtccatactttacctcataaagggcatggagttccgctgcctctccagagcagctaccctatcgccaataggtatagcatcctcattggcaagggaggtgctattcaaaaatgcctcagcgtgacggtcatccttgacttcatacaacctgcacggtggagagcagttggcataactccaatgcgccacaagaaaagcatcctcgggaaatagaacgaatagccccctcactaatctaaaaatgaaatgaatggatgtggccagaagccagatccctctataggatagatagaatgcagcttaactcatgtaattatgcacgttggcattgcttaaaaccagtaagcatgtgcctattactcaatcatcaacctaaccaaccgaggccattgcaaacgatttttttataaaaaaaagaatcaaataatggtaaatgcgcaatttaacctaaccaactcaccttatacgctttgaactttgcatgccattgtcactgtcagactctgctgatgcatcagatgaactagcatcttcttgttcctcatcatcactaacagtctcaaaatgttcctcaattagacgaggctccttcaaagatgtttgaggatgaagtgcaagatattctcttgattgttcatcaatttcaaagtcctgcccacgtgattaatgggattagaaaaccagattagcttaaaaaatataacatatggtcaaaaggcacagctgagacatgact

SEQ ID NO: 87200 - DNA, 536 bp, Oryza sativa
ctgctcggtttgtgttcgtgcccagattcagtggccgaagaagcaaggatgatgcactgaggtgggggggggggggggggagtcggtgagagatttcagcggagaatctcgtctgattccagcgtgtgggacctccgggcgatggccgccgctggcggcggcggcgacgccaagtacaactcgtacaaggcggcggggctacgcggcgccatactggaggcggcgcacgtgtcgtgcctcgaggatcgctacgcgctggggccccagctcgggtggggccagttcggcgtgatccggtcgtgctccgacatggtcaccggcgaggcgctcgcctgcaagtccatcgccaaggaccgcctcgtgtcccccgacgacgtgaggggggtcaagctcgagatcgaggtcatggcgcgcctctcgggccaccccaacgtcgttgacctcaaagccgtgtaccaggacgaagcgtccgtgcacctggtcatggagctctgcgccggcggggagctcttccaccgcctcgaggagcgcgggtg

SEQ ID NO: 87201 - DNA, 644 bp, Oryza sativa
ccaacaacagtggacatcaatcagtacataagaatgatcggctaattcgaccaaactgttcaaatacaatgttgagagaattgcttttacatgcataaacaaatttggccaaaaaaaagaaatatactgaaagcagcacaatactgtttgccatgttaccgcctacatcgaaaatgtatcatagtctacagcaatacactaacaaatgccctgcatggcatggcaccaacgttctgcaactccagcagtggttccatatagcagtggacaagtctgcagtagcagcacacggcgtatgctcctgcacctccatgagaagggtaaagaagaggaaaagactccaaaacacaaaggaaactcttaactcgataaaatctcaacccagttattaactttgagaggttctctgaaacttacccacactcagattgagcatcagagcacacgtgcacatcaagtcaagatcccatgtatagcatggcttgcacaattgcatgttagggcttttatgatctataaatcagcaaaagcgaaaacttccagctaactgtaaatcgccatagtagtcatatagcttaccagacaggttgatactagaagaccatgctgagattggtttataggtaaacttaagttttatgtta

SEQ ID NO: 87202 - DNA, 2798 bp, Oryza sativa
ccacctggagctgctgctccaaaccacggcacaacagggcaagtgccaaattggaatcccgggaactctgggtatgctccagctccaggagcatatccaggtcaaatgtactcgtcaccaatgcagtatggcgcatcagggggcttctctgctcctgctgccccaccacaagagttgcatacttcgcagcagatgccgccgcctcaatatggaaatcagcctggaccagcaggtgcaccaggaaccgggcaaccacatccatattatcgctaaatttagattcctattcacaactggtactatgccctttctaattagtaactttgtgtacctttgcaatagggcaaaaccagttccttttccctgtctttcttctcatggaaccttttttataaataaactcttcatccagttgttctcatccgcggcacaaaatgaagggttttcatcgaaactcatcatagttttctcccaaaggtaactttgtatattcctaatatgtttatcgtcagctcgttggtctgtatcttggaatttagtattccctcgttttttacttgtcactgttgtgacaaaaaaaatcactgctttaactttgatcaccaatcatttttttaagttgaacaaatccacatggttacatttatatcagacgcactttgattaatatggtactatttttttacaagtaaagtgcacaagcggttattaaacttataaggttatgtcatttaggttcctaaactcttaaaatatagatccaagttttagaacttgtcaaagtgtcatttaggtcttaaaacgtcacaacctctttaggatcttacgtgacgtgtgacgttgatgtggcatgccacacgaacatgacgtgacatcatcttgaccggcaaatgagacctagatgagatattttgacaagttttggaaattggatttgtatttgagagtttgggaatctagatgatacacccttacaagtttaagtatcacccatgcactttactcattttttaagtactaggaataatgcccgtgcgttgcaacggtaaagtcgtttgttccagtggtacaacaaaagccaaagccattttctccaatggcacaacaatcattaggagctgagcgataaattaaaacattggtaccgctatacattatattgaataagttaattaaaatccatacttggctttgggtcgaaagcccattctttcctttctttttagccgcagcccggttgtaagatttccataataccgttgggccaaaatagagtgaaatggcatgattgaaataaaatatattaattgtgcacataaataaaaatctattccttaatatcgtagacatatatggaacaataaaatattaaaacataacgtgacaattaacacgcataatttcataggattttaattgtatctcactttggggctataaataaagctaagtgtcaaaatgtcataaaaaacatataatggtttggccaaaatgaagctaaattaacattatatatgaataatggaaataaattaaattttgttgccaaatttattgttggttccatttagctacatatatgatcttaattgcacaagaaagtttataatgcaactttatgtcatcaaataattgcttaaacggattaaaatgctcttatgtaaagaggaaatcattaattcggtccgataataacggaaaatcaatttggcccgaagaccggcaacggctcggaggctagagctggcacgtgatcgtgcggcccatgaggcacgcgaagcccaagcgcggcccgttagcgtgagctgtccgatcctgatggatggctacaatctctgatgggtggctgatgcagtgtgggagagtcgtgggtcctctaatgctgatcggacggtttagattgatcaacccggataaaattgccaccagccgaaaccctaaccctattaccctctctccctggccctattttctggtgctaggcgaggggtagtggtcacggcgacgccgacggagcggcggcgatgttgaggcgccagtgtgtggcgaacctgatgtcgagcatggctccggcgaggccagggcggcggcgcgcagtgggatgccatggccaaggcgacggttcatgtgagctgaggccgtcggcatcgagcgaaatggcggcgatggtggtaaacggcgtgctgcgagctgataccatgcgtcgatccctctctcccacctcagttctcctcctcgacacggcgcaagactacaacaaggcgagcctcgacctcgagcggcaaactgaggcggcgctcaagttcgagttctcctcctcaacatgacggctaagggatgcacggcggtgcgtgtagctgtacaccagtcgcacgaagatggttgagagttcggaggtgcgcacacaggcggagctcatgccgtgcgccacgaagtccgacgaactaaccctaatcccggtgagtcttagggttttccattgagctggtgatttgcctgttcggggttaactgttcttaattttgggaatttcttaggttagggttcgtatttttcggaaaaatcaaaataagggtttcgaatttgggggatattcttactcttataccgatctgattcgcctcctcgtaacaatctcttattgtacttttaggatcggtaggacttaaggtttaggtagtgacaaacgaacaaagattaagtttccttatatatgagctaggggattgggggcgagtccatggcgtaatcggatgtgctagtatacgaatgaaagattaccgcggaatcgacggatg

SEQ ID NO: 87203 - DNA, 792 bp, Oryza sativa
  unsure (1)..(792): unsure at all n locations
aaagtcagtgttatgtctgcacttctcttataatgtatctcagttgatctttacaatatccattattgtattccagcaatatgggaatatccgaacactttatactgcaacgaaacatagaggttttgtgatgatatcttattttgatatccgagctgcacgtggtgcgatgcgtggattgcagaacaagcctctgaggaggagaaagttggacattcatttctccatcccgaaggtttattatgttatggttcactttcaaatgcttagtccctttaccataaagtacttagcagtttgccatgttgattttgtaggagaatccatcagataaagatttaaaccagggaactctggttatttttaacttggatccctcagtttccaatgaagaagttcgccagatttttggaacatatggggaagtaaaggaggttaggatgttacttccaatttttccctttgaaatatgtttttgcttgaaaattgcatgttcttacgttcttcgtatactttgtttctgttttttggaattcaatctgatggtgttagtttctatccacagataagagagacaccaaataaaaagcatcataagtttattgagttctatgatgtaagagcagcagaagctgctcttcggtcactgaataaaagcgagatagctggaaaacgcataaagtaaaaaccaagtcgtcctggtggaacgcgcagaaagtatgattatgcgttttctttccctatccatttttctgtcntgtgcttggggtgcganctgcattcctacccgcg

SEQ ID NO: 87204 - DNA, 741 bp, Oryza sativa
  unsure (1)..(741): unsure at all n locations
actggccttgaatgacgctcggctccctacnncgcncgcgttctatgaaaatatccgtccaactgaaaaaccaacggggccttagtttctcacatgcttccgtacgcctcaaccaattctgattctgaaaccttatagcgagatgcatctggacatacagaacgtacaaaggttcattgcacctggacgtacaaggttcattgcacctggacgttgtaaaaaccaacgaacctagccgcgcaaacgccccggcgtccacacaccgaaacatatataaaaccgcctcgtatcgtacaagacgccaatccacccgaacctgcaacggaaaaggaaacggctttgccggcacacggcaacaaatcttgttcgcgcccccgcgtgcagtgctcgtttcgatcgaggcaacccggcgatcgcgcgccgcccgattggcgtgttggatgggagcgacacggccgtcgccgatggcgtacaagaaggccacgccggtgctggacgagccggcaagggcaccgttgcgtggcccgttcgccagcggtgccgcgtccctccggcgtgatcaagacgacgacgacgacgacctcctggtggatctggtgcacgagttctacgacgacggcgagcccggcgcggacgccacggcgaggggcggcgtgtcgtcttcgccggagcccgagcctaccgagtggaaagacnctcttcgcgaagcgctaagcgacgcaacgttcgacgcgggggccg

SEQ ID NO: 87205 - DNA, 740 bp, Oryza sativa
  unsure (1)..(740): unsure at all n locations
cgtgacattggtggagacattgnaccaccncaccactgatgatgttctattatcgagagaagaaaggtcctttcggatgtggatcaacagtcttggggttgactcttacgtgaacaatgtttttgaagatgttcgccatgggtatgagattattcgaatgagcatttgtgtctgtctccaaatgaattgggcacttacatcctttctcatgcagatgggtacttcttgaagtactggacaaagtttctccaggatctgtcaattggaagctggcctcgaaacctccaattaaactaccattcaggaaattggagaattgcaatcaagtggttaaaatcggaaaggagttaaagttttccttaataaatttagctgggaatgatattgttcaaggtaacaagaaattgattgttggtgagtgtgactgaatcaagtctttttagtggtttctgattgatgttatctgttcagcacacaattgaagccatatctgttgtttttcagcacttctgtcgcaattgatgagatttaatatgcttcaattgttgaatagactgagatcccactcccaaggatcccaaggaaaagaaattactgatgctgatatactaaaatgggcaaacagcaaagtgaaagcttcatgaagaacatctcaaatggaaaagcttcaaggtgttattaaatttcttgttaaattagtatttagtttgttggtaagatcacctacagctaatgaaatt

SEQ ID NO: 87206 - DNA, 706 bp, Oryza sativa
caaaacatatgatataaagattaatgaaatattaagtagactaggcctaaaaaaaattagtgcacacttaagagtgaatttccatacatagagaaacataaatatttggtattatgacaggtactgtctatactgctgactcataaagtacaggtatgcttacccactgctgccagaacgaccactatatccaccataagccccataacctcctccagagacctggagaaattccagtcgaagttttgataagagtctgttagcatgaagaggaaaggaagggaagtgaaagggaagctatacctgggagctgccataacttgcatagctgtcaatagggccaatatcatctgagccacgatatccacttgaatatggataatcatgcccaagaggcttagtatctctgcctagatactttggcccttcagaaacaccaactggaagaggatggtaagggattacaggtgggaaacctgataaagcaccttctctttcaaagaaattggctttcagcctagtagttatttgcagaagagcatgtcttacaacatcaaggtctccactgatctgttgtgcaagcaaattacattggtgaactcatcgcagtacaaaagaccagtaaaaaaaaattaaaacataagtttaaattgtacctgaaccatctcttcgtcttctgctgctacttttggtacattctccttag

SEQ ID NO: 87207 - DNA, 979 bp, Oryza sativa
acaggccaccccagtcccaacattgttaatttacatgatcgctgcagcaatcgttagtgataattataaaacgatcatatacgtgtgaaacatttatcttcttttatcttctttcttttttatatggtatataagggtagaatggtcattttgttcataccgctgcatgcgaggatgacttagcatgctcacatggctttttttttttggtcaaaggactatattaacccaaatgattaatttggaggacttgtttggacgatttgaaacctcaagaactaaactgagcccaaagcgaaacttcagtgaccatgttagttattcacccttaaaaaaaaggaataagttcacttggtgactctcaaaagtgattgtaatctaatccgtgaccctaaaccacagaaccggatatcttgacccccaaactatggaaatcggtacaatttgactccctcggcggttttagagggcggtttcgctgatgtggcgctgacgtggcggtattgaccgggtcttttttacacgtggcgttgacgtggcgcttaggtggcatttcaattaaaaagttatacgtgggacccatttgtcattcacatacacaattgtggggcccactaacatgtgggccccacacgcatcttctccctttcttcttcctcccctcccttctctctttctttctccctctcctctacgccgtccgtggggagcgagcggcggcggcggccgtgggctggagctgaagcggcggccgctcgccgttcctctcgcaccaccaccacccgcaccactcggcggccggcatcgagacgtcgtcggcggccgagcggcggcggcaacagcccacgggcagcggcggtgggcggcggcgggcgggagaagcagtgggaggacaaggggaacggcggcgggcggcagaagcagtgggaggacgaggggaacggcggcaggcgggagaagcaggccacggcggcgactt

SEQ ID NO: 87208 - DNA, 656 bp, Oryza sativa
caccgtctcctcctgggtagtccaactcgaggtcctcgtacacggcttccaccagctcaactttaaccctcgagtatcctgctggaatcggcctgcagtggtaagtccctgaaatgtccgttgggatggccattcccaacgccaccttcacgtgatgagaggttatctattagtaatcaacctaagtagcaacttgcggaatgtacgagtcaaaaatcatatattacatcgagtataccttgattgataagttcttgaagggaatatgcagctcacatggtgtccgttgcgtgatctcatcaacggggcaggtggtttcgtcctgggtttgcatggcgtccatgctatgtgatactacctgccccattgaggcgcagctgctatgattgcctgatgggctgaccattggaggaggtatgtacggctggggatcgtgtgaccgatgtgctgccatgcgttcatccaccttccgggccacctcctcttgcatgctgagctcgtagctcgataccctgtactcaagatctgcaatcttcgcctcggtatctctcttgctcctcatccgactcttgtacgtgtggatgtcctccttgaatcccatcttccagggaatcacgcctttccctcgtgttcgtcctagatgctcgggagtctgt

SEQ ID NO: 87209 - DNA, 536 bp, Oryza sativa
acacgagcagcgcacaggcgcactagccagtcccatcggtcattcgaccggtcacagaacggttgagtgcactgcacgccgcattaaatacggcgtggcgcgatcgctcgggatgccataaatgcggtaggtgggcacctggaggcggacgcctaacccaccgtacgtggtgacctagagagggggtcgggggagcctgacccctagtcacgggagggggcggccgccgcccgacctcgggcccgatccccctcggggaggagccacgtggcgcctggggcggcattctccctctagtctcggccagggagtggccgccgccctacctcgggcccgacccccctcggggaagggccacgtagcattggagggcagcatcctccatccagtctctgggaaggagtggccgcggtcctaccttgggcctgactcccctcaagggagggccacgtggtatcgggaggcagcctcctacctctaaacctgatacccccgggcccatatcaccgacaatatatatatatatatatatatag

SEQ ID NO: 87210 - DNA, 687 bp, Oryza sativa
  unsure (1)..(687): unsure at all n locations
aattgctcttgtcgatggcccggtgatcacaaggtcatctacatagaccccgacgagtagagcagagccaccattgtttcgtcggtacatggcgtgctcatgcttgctttggtcgaaaccgagctccttcagagtacaatcaagcttcgcattccaggctcttggcgcctgccgcaggccataaagagccttgcgcaggcggaggaccttgtcttcttctccggcgacgacaaaaccagggggctgcttcacatacacctcctctgccaaatctccattgagaaaggcagacttcacgtccatgtgatggacgtgccaccctttttgggcggcgaccgcaagcaggagacgaattgactccatgcgcgcgacgggcgcaaacacctcgtcaaaatcaatcccaggttgctggacaaatcccctggcgacgagacgagctttgtgcttgaccacctttccggcctcgttcttcttcaatttatagacccatttgagtccaattgggcgatggccatgtgggagatcaacaagctcccaaatcccattgcgattcaccgcgtccatctcttcacgcatggctgctcgccatgcatcatcaccctccggctctgcaaacgagcatgggctcacaggtccagcgagggagcaagacgcctnctcgantncccgtttggcatccttggtgcg

SEQ ID NO: 87211 - DNA, 699 bp, Oryza sativa
tttactatggctggttttgccgatgcactgagaccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctaacaaccgttctgtagtcgaacaggctcatgagatacaaaccatggctaaggaactcgaactccttaagtgtgtcttacccgacaaatttgtggccgggtgcattattgcaaaactaccttcatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccaaaacaagagcaaggggaaatacaaagctcagcagaccacccacttcaagaagcagaagaagaac

SEQ ID NO: 87212 - DNA, 1666 bp, Oryza sativa
atagtatcttattttacaaattctcttcaaaagtatatgtctttcatgaagacaacaaaaaaattgtcacatgcaaatttggggcaaaattgaaccgtcccatgatgcaagtgtagtagtgcacaattagccttgctcgtcttcagttcttcacaagtttcaggaccagttccagtttgataccggtgttacctatgatccttcagtaactgatgacgacctggaactatataagtaattccagaatggctaatttgtgttgaattcattgcatggttagtatgaactcgttgtgattaacatgaactgcattgtccagttgtgagctgagacttctgaatcatgtatcaatgttcagatcgagcccaatgttcatcccgttgtacgcaattggcgcatacatccacatttcatcggagctgaggagctgcaggattggacaaaatatgataagtggatcttgttacaggataatggatgatatgaactgaactgtattctgtagatgctcaccttgatctgaagctgcaggaacttcacatagtggactgcctcctcaagcatggtgctgatatcaacctacaagatcaagacaagcattgttcttttagccatttggttcaagaattccatgtcatgtgagtgtaattggtagcacttatgttcagaagcttactttggtgccattgggcacaaggttctgaagtgtcttgagcctctcattgatcctctctctccttttctgattaagcagagaacttatgttagcatttttttttcacattcagttgttgaaaagattatgttttcaggagatgatcatgttctagtacccttgcatagaggctctggggatcagtggctgctccgcggccagcccgggatttgcctttcgaagtagcaccagcatctgcaacctcctgggatgaactggaatcattgtcagaaatggaacagctcccatttgggatggcaacacttgcatccttctccacagtttgcttggccttcttcgctcgcttcggttcagcctttctcgcgcattttgaaccctgcatttcgatcattccaagcgatttttacattagcactccaaacatcttcctgaaagataacaagagtgaagaatgatcactgatgagcaaggacttactcttgtttggccatcaaattctccttctgccgactgttttctcttgttagtcccactaaccgaatcaagatcctcgtggcccagctcgccattaccgaatgaatcaagggaatggtttgggatcacattcagaaactcagttgcaccttgcacctggaccatgctcaggtcatgtggtgcaatgctggagctgacacccagggcctcatttgagtcactgaagcagtatccttcatactcagatggagcaggaatgctactagcattgctgttgctgtatgcagtgctgctagcattgcagctatagtagcatggattggaagattgatcaaaccatgggagctgctcatggccttcctcctcaccatggatggggaatgcactgaagagttgcgccatcatctccgactcatcgctgtgcgatggcaagtcgaagacggtccagctcatatcggcgatcagtcctccaccctccattctgatgtgaattcaggacttggaggtagacaactg

SEQ ID NO: 87213 - DNA, 989 bp, Oryza sativa
ccctttagcttttgatatgcgccacatattgacatgggataccggcgcatacatggacattatctgaatatactaaggaaatcttccacagtgtttaagtcctactcggacaagaaagggtcgtcaatatatcgtgtagggtcagatgtctccaagttcgatttgagaccacctgatttgcgatataaaggggaccccgtgggaggacctaaaggatggaatctgatagccaacacaacccccacagcttaagaagtgggagcttgcaggagccaaatcgccggggatctagtggaatcaacttaattaggatttcgccggtttcatcgagttccattgttccttttgtaacctgtggttttccatcatataatcccatatcaataaaattagggttattacctatcaaggggcttgacccagtataatttttgtctttaattgcttgatgtcgtactacgtagatccttgtacaaacgtaccccaataccctctatatccggtctacgggtatcaccggtcgacagcttgatatttagcacatgtgtgttttgcttatcaaatccatattatacatacatgttgaaaatgccagttctaagtggtggaattggtaggttggcatataatatgtttgaagtatgatttggctcatcagtctttaatatttatttaaagccaaatcgtatgtgtttttatgggtcaccatataagatatagatttattgcaccatgaaagttttgcttattagtaattcggctaatatcaatggtcaatgtgatgatttgttttagagttattttatttaggaacattggcattgttaatattttgcatacacgctcaagccaattacttacatttgtagtttattggaatctatgcatgtgacacatatgactttggccattcattattgattatacttcaattggctaagtgttttgatgccatgatgattattgttttaaaagccatttgaattagt

SEQ ID NO: 87214 - DNA, 1576 bp, Oryza sativa
  unsure (1)..(1576): unsure at all n locations
cttgtctttccgacaagaaccacgagccgacgagaacagcttccgaagcgacaagggcctggtgtcctatccacaaaaccaggaaacatactttgcaagcctgctgggtcttcctcaatgcccacgccgaaattcgcgcctgtagagagcgtggaattcagcgcgtttctccaactcgtgatgtctattgtcctattcacaagacaaagaatcacgacctctcaagctgcaaggtttttctcagcgccataaagatgtcatctcctaaggtccagccatcaagcgtatcccttagagaggaagacaagagacagggaacgacgctgacctcagatcgattcgttggtgcgattgacatcgactcccacgaaccatcagttctacatctactcaaggactatggctcgtcatcaacgagtacaccatgcgaggtattggctatcgatgggaccagcacgtcagcacgcgctaatgccgaggcggagaatcaagtagttacaccggctcagcgcatcagtacccttaacacaatactgagggaggcaccttacgatcccgttctgaacgacgatcttgcgtggtggcaggaacggctacgagaatcagtaaccaacctcagccacacgttcgaaggggctgctgctgatgcacacccggaacagccaccaactggcggcgtcgatggcgaaaaccccgaacagcgggagtcaccctaccgagcaaccccttcaccccgcggcactggcgacctccgcgatcacctgaacggccgccgagaagcacgtcgcacacagggcaacgggagccgctctcgacatcacatcccttcacggcatcacgataatgaagaacgaggaggccgctcgaacgaagaccgagaccgtgatgatcgcgacaatcgtgagcggcgggcgccgggcaataccagtcgaggacgccgccataatggcgaagacgacagagatcggccccgggacaacgacggagggcgacgatgggattctcgagaacccggccgatgtcctcgtaatcctacaccagaaccaagcgattcttcgtcatcgtcatcctcttcttcatcctcatcgtcagatagacatccacgaaggacacacgatcgccgacaacccactgcccccagcgctgggtgtagagctttcggtcgttccctgcgtgatgtccgatggcctgagagattccgacccggaacaatagagaagtacgatgggagtactaacccagaagaatttcttcaagtctactccatagtactttacgctgccggagcagatgacaacgcattggcaaattatttgccgactgcgttaaaaggctctgcacgttcatggctgatgcatctaccgccctactcgatttcttcatgggcagacctgtggcagcaattcgtcgccaacttccaaggaacttacaagcgccatgcgatcgaagacgacctacatgcgttgacacagaactcgggtgaatccttgagggaatatgttcggcgcttcaacgagtgcagaaatacaatccccaagatcaccgacgcttctgtaattngcgccttcaagtctgg

SEQ ID NO: 87215 - DNA, 962 bp, Oryza sativa
actcagcatatccagactctgacctccacgtttcacacatcttcggaggctccacatcgtactcttcatagcgagaatacaagaaagtggaacgtgaagtctgttcgacatggcagggggctgcacctaatatgaagtggtctgaacagaagatagaattttcggaagaagagcatcccaagactgccgttatcccaggacgctatccgatcgtggtcgagcccactattcggaacatcaaggtcgcgcgggttctcattgacggtggcagctcaatcaaccttctcttcgccagcactttggatgcgatgggggtcccacgaagcgagttgacgcctaccaatcaacccttccatggaattactccccagtcctcgtccaaaccattgggcaaaattacgttgcctgtgactttcggccaagcaaacaacttccgaaaggagcagatcacctttgatgtcgctgaattcgatacagcgtataacgccatcatcgggagaactgcacttgcgaagttcatggccgcatctcactacgcgtatcaagtgctcaagatgccgggaccgaagggaataatcaccattcaagggaacgcaaagctggcggtacaatgcgacaagcggagcctcgatatggtcgagcaaacgcccaacccacccgccacaactgagcctcccaagaaagtgagcaagacaaataagacgccgaaaccagacggcgccatcaagatcgttccactctccagtgccaaccccgacaagaccgtcaagatcggggcatcactaagcgaggaataggaaatcgcgctcatcaccttcctccgcgacaatgctgacgtgttcgcttggcagctgtccgacatgccgggggtccccagggaggtgattgagcacaaactcatggtgcgacccgatgccaagccagtaaagcaaaaactgcggagatttgcaccagaccgaaaa

SEQ ID NO: 87216 - DNA, 2512 bp, Oryza sativa
  unsure (1)..(2512): unsure at all n locations
tctcggtgaagtcgtgagaaacaaagacgttgtcggccgcattgcgaaatggggggtggagctaagctagtgggatgtccactttgtgccacgaacaaccatcaagtcccaaatactcgccgacttcgtagctgattggactatgcccgacaacaaatcagacaaccaaatcgacaacgaaacgtggacaatggcgttcgatggtgcactcaacagccaaggagcaggggcaggattcatcttgacatctccttctggagatcaattcaagcacgcaatccacctcaacttcagggcaaccaacaacacggccgagtaagaaggactactcgccaggataagagccgcaaccgcatttggggtcaaacgactgatcgtgaaaggggactccgaactagtcgcgaaccaggtacacaaagattataaatgctccaaccccgagttatccaagtatctcgcagaagttaggaagcaggagaaaaggttcgatgggatcaaagtccgacacgtataccgcaaagaaaacgtcgagccagacgagctagcacgacgcacgttcagacgagaaccactcgaacccggcacttttctggacatcctggcaaagccatcggtaaaagaggtcagcggcgaagttaacccagacacccccgacatcagctgggaggccacagaagcagaccgccgccgtgccgatatcaaaaccacagacgactggcgcaccccacttgatcaaattcatcaacagcgacgagttgctcgaggacgatgcagaggccaagaaaataacccgtaaagcaaaaatctatggcacgatcggcaatgatctatacaagaaagcgccaaacggggtacttctcaaatgagttccgtccgacgacggcagacacctcctccacgatatacacgaaggcatctgtgggtcacacgccgtcggtcggacgttggtcgggaaagcttttcgacaaggattcttttggccaacctccctcaaagatgcatgcgacatggtccagcggtgcgaagcctgtcaatttcacagtaagcacacaaagctacccgcgcaagcgctccagactatccctctcacttggccgttctggtgctaggggctagatatactcgggcctttcccatgaggacagggcggctataggttcctattcgtggcgatagacaaattcacaaaatggatcgaggcgatgcccacgggagaaatcaaggccgacaacgccatcaaatttatcaaagggatattttgcagatacggactaccacatcgcatcatcactgacaacggctcccagttcatcagcgccgatttccaagattattacatcaggctgggagtcaagatatgcttcgcttcagtctctcatcctcaaagcaacgggcaagtcgagagggcaaatggcatagtgctacaagggatcaagacccgtgtctacgacaggctcatgtcacacgacaagaaatgggtcgaagaactcccatcagtactatgggccgtacgcaccacaccgacaacgtctaacaaggaaacaccctttttcctcatgtacggctctgaggccatgctccccagtgagctacgacatcaaagtacatgagtacagaagtactccgacgaggatcaggaggaacagcgaaacgacgatgtgaatctactcgaggaacatcgcgaacgagttgccgtccgagcagccggttaccaacaggccctccaccgttatcacgagaagcgcatccgagcacgcatactttcgacgggttcaaagccaagcagggcgaaacaagctctcacccaaatgggaaggaccttacatgatcacgcaagtcttgcggccaggcgcattcaagatagcagatggcgacggccgcgagttggcaaattcttggaacattgaccaactacgtaaattctacgtataggtcaatatcatccatacctgtaagacaccttacagtatcaataaagcctatgttcgggcacatattacaattacagtgttcatgcctgatgatcccttacccagatgatacctagcgttgaaacctatccttatgtccctttacaccgtcctgacaaggcctccgaggaacctaagggatcctcggctggggacgcccagagccgataaggtcttgtcggatcctgtagagacgaaagaccatgtaagacctggtcgtgtaagagttctcgccgtgcgtattaaccaagccgtgtaatcggaaaattaactttccaacttcacggctgggggctaggatcagtgctttctcaaccaaggcaggtcaaaggtctaagagccttgtcccccgagaagtatcctccgacgacaaggctgggggctagggagagtgtacgactcaaacgactgaccaaagtcgtgaactgaggaaacactcttacacactatatccagagtaagaaagattcaccaagatagatttcttccctacttcgcanaatacttcttacaattatatacaaatccagaactttattaca

SEQ ID NO: 87217 - DNA, 1875 bp, Oryza sativa
ctacttcgcaaaatacttcttacaattatatacaaatccagaactttattacattctttccctaagatatctgtcacagggtacgaatactaccaagaaggccaacgccagtccatagactggaaaaccttctccgctaacggggccatcgacttcgccaggtggtctatctccgcaggagtcctctgagaatgagtgaatccttcatggagaaactcgaggtgcagttgcggacgatgatctcgtacacaagccaatacatgccctcctgcatatcggctcgatcggcggcattcctgtttcagagcctcgtcaatccgcttgccaacgccctcaagctgagtacaagccccattcaaccacgggatatatccggctgctgactcctcgggatccccgcgaggtactcggagctctctgcaaacttgggccatggacgtgcagcaactcttcaggtatgagttgaaccacacctcacgacctcaaagtgtttccacggcctgctccttctttacttccaacatggctctctcgagttccaccacttcaaatttcgtcttccaatattggatacgacgatctcggtcagcaagtgcgttctcgaggtctgttcgacatggaaacgactacgttaggctgctcttctctctcgagaacacggttgatcaagtcggaggagcgaaaaggatgaaaaggccaccaaccaaaggaagtcgtcgccgtccccgctctcccgggtacaatgtcattcacatcgtccagcaacgcgtgtccctcaaacgcaagaatcggagggatcactggcgactcaggttgcccgcgctgctggacaccctcgtcatcagcatctctacaaaggacaaaaattcccgaggtcaacatacaagggcaaactagaatgataattgcacgtattctgaggcggtccaatttcaagttttacacagcatgtcttggaagtacaagaagacctactcttcaaatagggggagaacagattccccagatcaccgacttcttccatcacctccttacgcgtggtactagccgccccctgatccaagatctcgcgcagatcgagttcaggacgcgatagctttacgcacgcaaggacataacacgccccagtgtagatcccgttcgatgtctcctctgcgaccctggccgcatgcttggaggggatctccgtcatcgccgtcaatagtaccgcaagggaggaggtcagcgaaaattcgtcaggattcaccgggatggtagacttgatgccgcactccccggcaagctggtgcaggccagtgtaggtgacccgcaacgagccctgaatttccgacaggttgtgcccgagttccgacatgcggttctcgagcccctaccgttgtcgctcgttgccggccaccagttccctcatcttcgtgaggtcttcatgagcttccgccaactcgcgcaccaaccggtcagcacgcgcgttcgccaacgccgcttctgaccttgcctctgcaacctcgtggccaatgctgcgggcaccagcttctaggaggcgccccatttcgacttggagctcctcccaggcgaggatagcagtgggcggaccacgacctgccgcgggatcgctgactgggccactaggcgtcacctcccggctcccagctgcgagtacgacatccgtcgaggccgcggtaggcgaggcgctggaagcccctcctgacttgctctgcgcggcctttgcccacgcttccctatgggacgaccacggatcatacaacgcttgaacagaatcatgggaacttaaaaacccaactacttacttctcgccgatcgtcacaagacgttgtcgtcgcggaggcgggggagatgcgtccaaagcctgaaagacaa

SEQ ID NO: 87218 - DNA, 644 bp, Oryza sativa
tagggtccgatgtctccgagttcgacttggagaccacttgatttgcgatataaaagggatcccctgggaggacctaaaggatggaatctgatagccaacacaacccccacagcctacgaagtcggagcctgcaggagccaaatcgccggggatctagtcgaatcaacttaattacgatctcgccgcttcatcgagttccattgttccctttgtaacatgtggttttccatcatataatcccatatcaactggattaggactattacctatcaaggggcctgaaccagtataatttttgtcttttattgcttgatgtcgtactacgtagatccttgtaccaacgtaccccaataccctctatatccggtctacgggtatcacccgtcgacagtggcgcgccaggtaggggggcttggtgctcaaggttttactactatgtcatccagcttcgtcgacaacagcgtcaacaccaacctcaaccacgggtttcctgcttcaacaacgttggtgtggactcaagtcggcgaaatcgtcttccccgtgtacaccacgatgccgatctcagccggtccattcaatgaccgaaacgagaacgcagtggcttgaacccaaggcgaattcatgtcgaaagaccctcccggcaa

SEQ ID NO: 87219 - DNA, 4839 bp, Oryza sativa
  unsure (1)..(4839): unsure at all n locations
atccctctaccanaatccgtcgacaggctgtaccacgagaccggcaagagaccatcgccgtcggcgcgaaggccggcaccgtcgcgtttatgatctctctggcgcggcgtcttcctcgtcgacgagctccccgtgctctgggacatcccgctgacggcgccggcgaaggggaattggaataacttcctctaccaattcgatcctactccctccgtttcatactataagactttctagtattgtccacattcatataaatgctaatgaatatgggcaatgctagaaagtcttataatatgaaacggaggaagtagctatttccgcgacgtcaccgtgtctcgaaacagacaagtatgttgagatggaaatctggtcacgaacagagccaatgaataataatcctaccccagtttcttacgtggattgggtgcgcgatctcaataaaccgaagaaattcaaagaaatcgatcgtggatggaaggctacaacatatagcatgccaatgccggtgaattgttcttcttcgtgctgctgtgatgatgattggcagattgactgtgaaatcgatgataattaaacacatcagcttaagcgacagctgtcgttctaatctgagctgcagcgacgacgacgaaaacagagagacaattgaaacaatattcaaaaaacttccaattggaaaccccaccataattaagcatggatgaagatgtgattttcttgctttctataactagccccatgaaaacggataggttggaagttgtgtttgctgttgatgtgaggaagggcatgcttcaaggattagcaaagcttgatgttcgaccgaagaacttggctatcatggtcaccttatgcaccagcgagatttgcaggtatctagcctgatgaatattattacaggtaacttaattctctacgctggtaattaactttattgtgtgtttttatgcgtgatcaatatgtgtgattatgaatgccatgcttgccaattaagatctagggaattattgtgttggtaattttctggtttcagtagggtctagagcttaattcagaagccatggcttgatgacagtgttatgccacaaaaagattgtatctgtctcgaagtacaccaatccgttacattctgtttgcccccttaattaacaatcctcttttgttggctacattgttcttaattagtgagacagtctgatgtgcagatgcacaataatgttctctcatttgaagaaaagaacaataatgcacaataatgctactttactcgcttggatccattttagttgagttgtatttactatttatgcaaacccaactttgatggtaaaatacctaaaattattatatgtacgtagtatgtgccccctccagttataaatatttaatgcagttgattttgatcataaagcttgatcatttatcatatttaaaagtttagtgtaaaaatatgcaaaaatatcatgtttaaagtacctttaacaataaaataagtcataaaaaaattagtgtactttttttaataagacaaattatcaaatttttgtggcaaagtcaactgcgttatgaccagaggaagtaccggaatttctcttaacatacagttggcattgtcttaattgtattggacttgtcgagcttggtgtttttttgtgggcatttctgacatgattttccctaatctatttacaggaggaaccattaactttgacaggacctaataatcgagtacttggtgcactatacagaatagagttacatttaaagattagagacgatggtggtgttgaccaagatttctgcgagaagccgagaacacaatgcatcagctataaatttttagtggaagtagccacaaaatgtccggaccagtatgtgaacaagtataatcgagtggcaaattgatcttctgtatctgctataaaattatgtagctctgtgatggaaagcttgaaggagctcacaattccagtcaaatttctagtaaaaaaagaaaaggaaaactaaaaaaaaagtttaaactcaaagcccactagtaaatactactaatacaactaaggcccatattgggccgcccatcacggcccacgaacagcaacctaatcctcgcgctggaagagacgagacaatacgccacgcgccgcctgagccctcgcgtcgcgacaccgctcgccgcggcggcgctgctcctctccggcgaccacgcgaggagggagaagaggaggaagaaggcgagaagggagcgagctggaagagcgggagagggggacatctaggtcgtcgacggcctcatcaatggggtggggcatgccgacgcggccaccggcgacgtcgacgccgtcgcgggtgcaggcgctgtacgagctctgcaagcgcaccttcccatcgccgtcctccgtcgccgcgtcttcctcaccgtcgtccccgccgcccgaccacgccatccgcgccatctcctctctgatgggtaggtgacctgacctgacctgacccgccgcccaatcttgtttttgttcttgtgttcagagttcggactgcaaattgattgctctttcctctgcaaaatcgttcgtatgctgatgtattgaggaattggatgtgatttttgtgttcagatacaatcactcctgtggatgttggactcagagatgataatctcgaggatggaagagggtttgggttctttgaatcaaacttcctgaagaattcagcgagggttgctagatgggcgcaacccataacctacctgcatgtctacgagtgtgacgccttctctgtatgtggatgttcaaatgttcaattgggtcatcttcttgtaacacttctgtgacagagaatactactagaagttaatgaataattggatatcttctctgctaatctgcaattgcttcgtgtttgttctgtagattggaatattctgcttaccaacatcggcggttattcctctccatgatcatccgggaatgactgtgttgagcaaattactctatggttcgatgcatgtcaaatcgtatgattgggtagagcctgctgttctagcaaatggcaagccaggttatttttcataccctgtttcaaatatttgtttttatttatctactagtatatattgcattgcagagtgatgacttaatgaactcgttgtctctgagaatacaagtgtactgaaaacatttatttcttcagatggtttctacagtaccaagttaatgaacaatattggttgtagcatagtaatagtattgatactacccaaccctattggtcactagtgttgcactgttgctcaggcatcattttagattgctcatttctatgccttgatgatttttcgggttctggtatattaaggattttttttctttctcctgatgtgcagtgaaacttggaaagttacatacggatgatgttctgaatgccccttgtccaactgctgttttgtatccccaaagtggtgggaacatgcactgcttcacttcagtaaaatcatgtgctggtcttgatgtcattgccccaccatactctgaatcttctggccgtgtttgcacctattttcacgattatccattttctagcttctgtaagtgaaatccctcactgtcatcatattacatgtttgtgtcagattcatgtttaactaaatccaccattttggtggaagcagaataccagccatctctggtatttgttcaaaacatatattattagtcacagtgctgttcagtccttttctgtcaggaacagcaatcaccttgtacattatgttcatttatatgagaagaaaatttaatttgttgatatgttgtcaaaactcaaaagtgttcatattcactattctatgtcatatctgattttctcacggatcactccaactgcagcagctggacaagcaaaagtagtccatgggccagataattatgcttggcttgaggccttaatcgtaccggtgaatattaatatgcgccctggcacgtacactggcccaactatacaggtatggcctaatttctacatattattgttgatgttgtcttctgtagcaaccaaaacgtgcttgggaggtgagagttgagagttgagactgtttctgatggaagtaatatttgtctttttttctaggaacatctgccataatcaataaaaatgggcaggacagagcgtcaaactgtgtccaagtgccatctcacaaatacagttcttgtcatgtagtgatgtaaatgtaacatgttcatctttaacttttgatttatgttgtccttcattgaaaaggtgtggctatagtggtgacatagtcaaaacagtttgtactagctactttgtatcatagttaccaatcaaattctgcattctaaattgcttctggagatattgtaaatgtatttatgttaatgtctacatttttctttctatttctatgccttcagagaggctggttggcatggtgtcaatatggtctggaattcaaatattcaacaacccttgttaagatggtagttgagattcaatcaaaatttttagattattgtgctccattttgtacctgttctttccgtatttttattgggattacaaagcaaactcaatgcagttcaagaaagagttaaagtgtgaaactgacaagctggcagctcaaaaagtactggcccaatatgtatgggctgaacatgaactacaacactgttctggcccaatatatatgggccgcatgtgagtcacattactcttccgtcgntcaagcccattaatttgggctcaacacgcaggaccttgccttttttggcttcttgcgggaagttcaaatttttgcaccacattggcgcgggcgccactata

SEQ ID NO: 87220 - DNA, 1952 bp, Oryza sativa
ttcaagaacgcaaaataaactttggtaggtccagaaaaggttatacagactaccagacagatccatactccctactagacatcagtatcttatagattaccagtctaccagtacatataactaaataagtcttgcaggcagattttcagttaagcacgagttcaactcagctgaacaaaaaaattataatctatataccaagaaagaactgcttgagatgtaacagcttcccccatataaatcttcatactacatatcaccttaacacgcggaagtcaccgatacgctcaaacaattttctgcgctgtcgatgcttaaaggcagctgtccaaacaacattcacctgcagttcatagggaccttgctcaaggacacattcttcatcattgtgtccaagaacgagctcaaagattgagccagctccttcagaaacacagacattgagcaccagttcatcatccaaattgacggctacgaaacagcgagtcagatcgactgatccatcagctccaagaactctgttcctgccttccacttcactgtcatacaggatgattttgttctgatcatctccagtagtccaagcagtcactttgccagtgaaaaacttggatacaacccccttaattttgactgcaacagaagcttccacagctaattgaacaggactatacacaaaatcaattctactcaggcagctctctagcgataaagtcatcggctgctttgtatagcagatggcattgtgttctcgcacacctttgcagaaatctttgtcgacatcaccgtctctaatcttcaaattgaactcgaaatacattttgtctattgcacccagcgctcgattaggtcctgtcagagttagtgtgtcctcctataaatagattagggaaaatcatgtcagaaatgccaccagaaacactaggctcgataagtcaaatacagttcagacagtgccaacaatatgttaagagaaatttgggtacataatacatacagataataattttaggtctatgaagttatgaacagcctgtgaattgcatttcaaactcccatgttcaaatgagcaacatgccaatataaattcttttgtttccacttttttccagtacaaaacgtacatgatcccagagcactaccgttgcactggattaacaaaatagtataacaggtaaaagtaccaggatcttgggatatagaaactaaataagtaaatcaaatctcacaaaaaaaaggggaagtcatggattgattgatgttccaacagtaactgtcctgaccctcttagacagcaggaatggactaccaggcaatcagattcagtggatatatgatattgacagcaaggtttaagatctggcagtagggattttaatgtccaggaaacaggatttctatcgtatcaggcgtttcaccagccattatggaactatgcaaccgtccacatttcacttaacaatgtgagcctaattaacaggtcatttatagtgtagaatatcagacagcggattgaaaaggcaatggcatatggatttgaacaataaatagtattaatctagcaaggaggaggaacgaatcagtaacataccggcgaggtgatgatctggggattgttcctgtcacgcctgaacaaatagacacacctgaaatcgtactcatccctggccagcacagtgccaaataccctgatagggtaacccacatcagactcggccaccttgattgcaatcacattgacagagtccatctcccaccagtagtcggggaaagctagtgacttgataggtggtccacgtgcaagctttgctgcaaaatcaagccagagacataaatcaaaccaggaaagtaaatttttttaagacatgtacaataatcaaagaatgaacaagaaccaaggatgatattataacaaacaaatggatggatgtactcacactctttgtccaggt

SEQ ID NO: 87221 - DNA, 664 bp, Oryza sativa
tcgtagatccccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaagcaggccggcggtgaagtcgttgacgcccaacagcggcggcataataggccagccgtgtaggcagaggcaccactcggcggcgacggaggcaggccggcggtgaagtcgtagacgcccaacagcggcggcataataggccagccgtgtaggcggaagcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaagccggcggtgaagtcgcagacgcccaacagcggcggcataataggccagccgtgtaggcggaggcaccaattcgcggcgacggaggcaggccggcggtgaagtcgtagacgcccaacagcgggggcataataggccagccgtg

SEQ ID NO: 87222 - DNA, 649 bp, Oryza sativa
tcgatacagcgtataacgccatcatcgggagaactgcacttgcgaagttcatggccgcatctcactacgcgtatcaagtgctcaagatgccgggaccgaagggaataatcaccattcaagggaacgcaaagctggcggtacaatgcgacaagcggagcctcgatatggtcgagcaaacgcccaacccacccgccacaactgagcctcccaagaaagtgagcaagacaaataagacgccgaaaccagacggcgccatcaagatcgttccactctccagtgccaaccccgacaagaccgtcaagatcggggcatcactaagcgaggaataggaaatcgcgctcatcaccttcctccgcgacaatgctgacgtgttcgcttggcagctgtccgacatgccgggggtccccagggaggtgattgagcacaaactcatggtgcgacccgatgccaagccagtaaagcaaaaactgcggagatttgcaccagaccgaaaacaagccatacgagaagagctcgacaaacttctcaaagctggctttatcagagaagttcttcatccagagtggctagccaatccagtcatggtgcggaaggccaacgggaaatggaggatgtgcgtcgatttcatcgacctcaacaagcgtgttcc

SEQ ID NO: 87223 - DNA, 955 bp, Oryza sativa
aatcttgtgtgttctaattgtcgatgcattaaggatttagatcccatcctaaaattttatacaatgtcacatcgaatgtttaaacacctgtataaagtattaaaataactagttgcacaaattgtgactaatttgtgagacaaatattttaagcctaattgctacattgtcacggttatggataccacatacctaatagcagttgactagatcttggcaggacccaccacataccatgtcttgtatggacattgacctcagatatggatgaagttccggataagaaaagacaaccagagttctacatggaaacgataaggactacttagattgtatccatattggtctccctagttctacttggacaaggggacacatatgggtataaatacaagaccccctagaaggagaggggagacggacaatatagacgccacaaagccacaagccaatacaagccaacatacgccaagacaagtcgccggatatcgacatcagagatatgcctggattgaccctatccggtacctacagaggccggccatagggatctagtgctatctctgatctcgtcgggcactgattcgaggaggaagactaccctgttgtcgactacgtgatgatactccagtcccgctatgtcgacaacagttagataggctaccccaaatattgtactggtgtgattatggtgaataagagcaataccggcttcggtcaacgggatgtagggttattacctgacaatttaggggccagaacttgtataaaaatcactgtctccatctcttttacctcagtcttgcgtatatcctagtaccaacgatccctataccatgcaaataccggaatcgcgacatcaaacgtccccatacataatttaataatgtggtgctacagtaaacatttgctaatggcgtgttaattaggcttaataaattggtatcgcggttta

SEQ ID NO: 87224 - DNA, 751 bp, Oryza sativa
attttgctacgttaagatgcctttcggactgataacagcagggaatactttccagcgcacggtccagggcgcacttagtgaccagctcggcaacaatgtcgaggcatacgtcgacgacattgttgtcaagaccaagacaagcgactcattgattgacgatctgcgggagacattcgacaacctacgacgatatcgcctcatgcttaatccagagaagtgcacgttcggagtaccgtcgggcaaactgctcggtttcctcgtctctggcagaggaatagaagcaaatcccgagaagatcaaagcaatcgagaacatgaagtcgccacaagactcaaagaagtacaaaagctaaccggatgcatggcagcactaagcaggttcgtcgctaggatgggagaacgaggacaacccttcttcgctctgctgaagaagaaagacaaatttgtatggacacaggaagccgaagaggcattcgttgcactcaagcgctacctaacaaacccccctgtacttgttgctccccaacctaatgaagaattatttctttatattgtcaccacgccatattccgttagcaccgtcattgttgtcgagagagagaaaatacaacgaccagtctactacgtcagcgaagctctccatgacgcaaagacaagatatccgcagattcaaaagctgctctatgcagtaatcatgacatcaagaaagctacaccactactttcaagcccacagagtcacagttgtctcct

SEQ ID NO: 87225 - DNA, 1209 bp, Oryza sativa
atgacgggccgtggtgacgtctttgctgagctcgatcgaagcatcaccggcaccgtcaaatttggagacagctccatcgtagacatcaagggtgccggtaacgtcatcttcaccggcaagaatggcgagcacaaggttctcagtggcgtctactacattccgcgcctcaagagctcaatcatcagcatcggtcagcttgatgaaagcgggacgcgtgtgctggtcgaggacggcatcatgcgtatctgggaccgccgccgccgccgccgtcttcttgccaagatcaagcggggacgaagccgtctatacgtcctccgcctcgaggttgctaggccgatttgcttggctacgcgacacgatgatgttgcctggcgctggcacgagcgcttcgggcacatccacttcggctcgctagagaagatgggccgacaagagctcgtgcgtggcctgcctcgactggagcatgtcgagcagctttgcgacacgtgtgtcatcaccaagcatcggcgcgctgcctttccaaaggcagccaagtaccgcgctcaggagccgctagatctcgtccatggcgacatctgtggccctatcacgccggcaacgccaagtggccggcgttacttcttgctgctggtcgacgatgccacacgatacatgtgggtggcgctcctagcagccaagagcaatgcacctgacgccatcaagaaaattcagatggcagccgagactcactgtgggcgcaagctgtgtgtatttcgcacggacaacggcggcgagttcacgtcgcttgagttcgccacctactgcactgatgagggtatccaacgtcatttctccgcgccctacgccccacaacaaaatggcgtggtcgagcggcggaatcagacagtggtgtccatggcgcgcgcccttctcaaacagaggggaatgcctgcggagttttggggggaggctgtcagcacggctgtcttcctcctcaatcgtgcagggtccaaaagcctcactggcaagacgccgtatgaagcttggcacggcaagaagccgatggtcagcttcctacgtaccttcgggtgcctggcgtacgtgaagaagctaaacgatgtgcgcaagctcgacgaccgcagcacacccggcgtcttcattggctatgaagaaggggtgaaggcatatcgtgtcctggatccaaggacacggcgtgtacgtctcgcccgt

SEQ ID NO: 87226 - DNA, 1800 bp, Oryza sativa
attaaggggagattgttagtataatccttgttctagttagttatttggtttccttagacagtaagctataggctgcagctgttactcggttgtcagactgctgctattagtggtagtagtcaattttgattttacctctagcaggaacatagcagcagcagtattgtcggttcagcaaccgacctatccatgtactataaatatagctattgtgctaacataagtaagctttttcagctcattttcagtttcagtttcagctagactattgagtgtagttcagaagtgatcctaccaacaataaccatcagcatattgtgttcaattgtgcttattacagatttatgcattagcaagcttcagaataggtattaccttcttcagaaatctgttcaaaataacacagcatttacgattgatgatgtctcaacatcttgagggcttcctctgttgactttgctatcagcaccctgctgctcgttcccatgggttttcactttgagcttatgattattatatgcaacaacacctgctattgctgcagatcgcagaaaaaatggtgtaaaagaaattaatgggcccaaatttggacaagggtgtaagataaaataaagttaaaccaataagagaaaaaacagtataatatacctatcaaataaccaattatatttataaaggtaagctgtgtatctgcaacgataagagctgacagcaacaccacagtccaatccctcacaattccagtaacacgagctgtcagtgcactagttctggaaatgacaaggaagactgtgggattttgggtgaaagtgcatatgcagtttaagaacaatgtgaatggtgggaagttctatgagactttcattcatcttgggttctctaaataaagacacacaaagtgcaggaaaacaatatgataaagttaaaatagcaaacagttttcaagttaattaattatgagatcaagtggtcaagatatatgcaagggctaacatagtacatggaaatcaagttaagcctaacacccttttttttttcagaaaaatctcatgaagatcagtctaagggcttctgtgatgactcaccccatccggtaaaccacacagacccagctgattgtattttcaccaacagatgccacaataaccccaacgctgatgacaggcacgatagcaagcatttaacagctcatttcttcaaggccaaaggcagctctgagaagaaacacagctactacaatgctcgaacaaagagtacattaacatcatattttaaattaatagaaaccagagagctcgcatacttatttccttcaacatctgcgcaaatgcaacagatatgtagaggtacgcactgctccctagacagtgtatcattgcaaacattgctccaattggaacgaccgaactaatatatcttgcaagttcaggtgtactggttagaaagaaatacatttctgggtttctgatactcattattaacaggacaagcaagcagtatgccaggagttcagcgttacatgctagttaataaacaaatagtgaaatactttttctgaaggaacaatggcattgaattagatagaaatattgtagagcacctaaacatttgcttctgggtagctacagccaaatattgaaaatcaaacctttcgaaaagagtacaagccaaatatagctgtgtttggtggatgttagttgtgttaacttcagggggaaaaaacggcaggcagttgtggtaactcaactgttcaacagtcttctgtcaatgtaaaaccttcattatctaccatgtaaaact

SEQ ID NO: 87227 - DNA, 799 bp, Oryza sativa
tccttcaacctcagaaagtttaatatagtcaggcactcggccaataggcaaacagctaacatataatttcaagaagcattttaaaagcacaaaacactaagtacataatttcttacagaagaaaaggaaatgttctgtaaaccaaaataagatgggtgagaaaaggaagatttccacgtttgcttcccagatgtggtacttagaaattcttctacagaagatgtcatggtgattaaggtagcaaagagtaggatacctcaggttgatagatgctgccattcaggttgaaacagtggaaataggaaacaggacatcaataggtctagctccaaagcccccataaggggaatcgcttagcagggtcatagcattgtagtgcatctctgtttccagtactgcctgccaaccaacaaaaaaacagtggaagtacttaaatcaatgttgtcatatgaccatcagaacacaagaactaagagattgttacaaaccatttggccgaccagtgggttcgatgtaatgcaaggaatctggaagccatgggatttccatttgaagctacagagcacaaaacatccaagatttcaaggcaacgacttcaagacagtatgcgtttatcaactagagagctgacgatgaaatagtgggagggccagcaagaactagcacacctgtgaagtctatggctaccatgaaattcaattgacacccccctaatgagagagcacaagttagcattagattttgtccttaagaaaaaaagatagaaactcgccaccgctgcgcgcgcacacctaacctg

SEQ ID NO: 87228 - DNA, 2422 bp, Oryza sativa
  unsure (1)..(2422): unsure at all n locations
acgtgaaactggggcgtgtcctcattgatgggggagcagccctcaacatcctttcccccgctgcctttgacgctatcaaggccccggggatggtgctccggccgtcccaaccgattatcggtgtgacgccgggtcacacttggccgctaggtcatatcgacctcccggtcaccttcggtggatccgccaacttccgcacggagcgggtgaactttgatgtggcggacctcagtctgccctacaacgcggtcctagggaggcccgcgttggtgaagttcatggcggcagtccactacgcctacctccagatgaagatgccgggccccggtggccccatctctgtccatggcgacctcaaagtcgcgcttgcttgtacggagtagcgcgcggaccacctcaccgccgcgtccaagcccgaggaaggcgacgagaggcttggcacctccgcccccgccgccccgaggcagcggatagtcacatgcgacgaggtcccggtcaaggaggttgccctgggcgacggcccgtccaagaccacacggatcggtggtcttctggacgttaaataggaagacgcgctcgtctctttcctgcgggcaaacgctgacgtcttcgcatggagaccggcggatatgcccggggtccccagggagctgattgagcaccgtctcgccgtgcggtcgggcgcaaggccggtccggcagggtaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcgaatgtgcatcgactacaccgaccttaacaaggtatgtcttaaggacccttaccccctgcctcgcatagatcagattgtcgactccacagcggggtgcgaccttttgtgttttctagatgcatactctggttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgtgtgttcggtgtacctgcgggcaagcttctcgggtttttggtctctgcccgaggcatcgaggccaaccccgagaagatacgagctatagagtggatgcgcccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcaccctcaccctgtgccggctttggcccggagagagcanggaggagaggcccccgagccgaacggtggcccaagggccccgacgaccggagcaggccctctgcccgcttgtcagacggtgcctggtgaccccgacccccagaatggcccgagggccactgcgggaaggccgcacctatcgccctctgacccggaggctaaccctgtgccgactcgacccgaaagagagcaggagaaaaaggcccccgagccgaacggtggcctaaggcccctgacgaccggagttggccctttgccctgcttgtccgacgacgccaggagcccccgacccccaggacggccccgaggccactgtggaaagcccgcccctatcatcctccgaccccgaggtcgtcggcacagaagacgagtgcactccgcgagcccacttggacaaaaagcgccccagggatgtggcccctagcaaagaggatcggccccaccgaaaggtgcagcggcccgtctactttgttagtgaggccctccgggacgccaagacccgataccctcaggcccagaagatgctttacgctattctgatggcttcgaggaaactgcgccattatttccaggcgcatcgggtcacggtggttacgtcttaccccctcggccaaatcttgcataatcgaaagggtactggacgggtggtgaaatgggcaatcgaactttctgagtttgatttgcactttgaaccacgccacgctatcaagagccagg

SEQ ID NO: 87229 - DNA, 714 bp, Oryza sativa
aattcctgcagccccgtagtctttcattttagtatctacatgtgtatatatatatctacgtacgtacgtacctgcatatactatacatacatgcgtgtgtatactccaacctagctagtatgagtgtgaagggagtatactatattatattatttgtgtgaataatgaagctctgcaggcatgctgagcatggctttgctggagctagctagcatatgtaaacatgtacctaaacggattgaaatcctctaacttattttcatctgcacttatgctcaaagtcagatagaaataaattagaggttcctcttccgtacctagacgcgatcatgcacatgtctctccctgcctgcaggctgcagcagatcgataggcaaattaaagtggtcagcgtaaacaaatattgtaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttattgataagtataggtatgaatcaaattattataactaggtatatactcata

SEQ ID NO: 87230 - DNA, 624 bp, Oryza sativa
tgcaggtcgactctagaggatcggtgagggaacacaggtcagtgtggggacaggggtcacggtggacacgggggtggctgtctctccacctcctcacattatgccaacaggaacgcagacacattcagacgcctttgcagaaagagatgccagaggctcttgaagtcacaaaggagaggtgtgaagaaatcctgcatctcagtcccacacaggcagctgtctcaggctttacaggtgatgagagactcatcagagccctgggcactgttgctgcacgcggcctgagagcagctccctccttttccacctgagctcttcctcctacacatcatagcggtgaccacagctccaaggacagctaggacaaccaggacagccaggccagcaacgatgcccatgatggggatggtgggctgggaagatggctcccagctcagggtgaggggctcttgcagcccctcgtgctgcatatggcacgtgtatctctgctcttgtccagaaggcaccaccacagctgcccacttctggaaggttccatctcctgctggcctggtctccacaagctcggtgtcctgggtctggtcctccccatcccgctgccaggtcagtgtgatccccgggtac

SEQ ID NO: 87231 - DNA, 965 bp, Oryza sativa
tcggggtatctttctcgtatttatcttgacatactcacgttcgcattcctcttgatttatcgaaacttggtcctcgattcacaggtttgagcagtagggccgtggagcgccaagtcgggcagttaatgatcagtggaccgacaacggcgagtgacgtccccgtgcccctttgtgaaaagggggcgacggagcgtgatgccgctattaacgtaagtatactcgatggacatcccgcctttcctcttgagatcatcttatgacttgattaagcgtaggctcttcctctgactgacatcatcgggccgctcgcggaccatcaggtggcggcgtctctaaaagagaaggttgtcaaggaggcgtctgatgctgctgcggccactactagtggtggcaatgctccgacaaaggggaggaagttctcctctgtaagcggacatcgtcgcaaagcgccgaccccctcggtaagttatcctatcgccagatcgcgcagccagagggattttgccttacttcgcgttggttgtctttcaggctttggacgcatctcccccgcctccgcgacgacaacgtcttgtgacgatcggcgagaagtaagtagttgggtttttaagttcccatgattctgttcaagcgttgtatgatccgtggtcgtcccatagggaagcgtgggcaaaggccgcgcagagcaagtcaggaggggcttccagcgcctcgcctaccgcggcctcgacggatgtcgtactcgcagctgggagccgggaggtgacgcctagtggcccagtcagcgatcccgcggcaggtcgtggtccgcccactgctatcctcgcctgggaggagctccaagtcgaaatggggcgcctcctagaagctggtgcccgcagcattggccacgaggttgcagaggcaagctcagaagcggcgttggcgaacgcgcgtgctgaccggttggtgcgcgagttggcgga

SEQ ID NO: 87232 - DNA, 723 bp, Oryza sativa
  unsure (1)..(723): unsure at all n locations
tcgccccatgaattcgaatagcgaatgcacnngcncnnnccnnnntnggnccctncacaaaacacaggagcagggtattacgcttttcagcggcccgaacctgtatacatcgcccgtgtcttgtgctttttccattctcgcgaaccttccacacacagactaggagcttagaatctcacccagggcccccggccgaaccggcaaaggggggcctgcgcggtctcccggtgaggagccccacgctccgtcatattcaattactgatttgatgaaactaatttagttttattaatgtaactatatttacctataaacttagttaaactttaaaattgaaactttgatcaaaatcaaaacgttttaaacagtactaagcatgtggtgccgtgacactctggtcacgtcgacacgtccgtaccgtacgtacgtattgcttgcgtgtggttgccacttgccagctcgatcgatcgggacacgagtagaatggagtaatggtaagtgcatgcgccacacgtacttagcccatataacgtaatctgttctgccatgcatgatactcccttcgtccttaaaaaaacaaaccatagttttcatgtataacttttgactgttcgttttatataaattttttttataattagtatttttattattattagatgataaaacatgattaatactttatgcgtgacttatctttttaaattttttcatattttttta

SEQ ID NO: 87233 - DNA, 1288 bp, Oryza sativa
ttacacttgagaaagcaccatgagaatatgcaagtccctccagcctgattggaaattaacatcacaagaaccaacaatgttctgaatcttgaagtcctggtatagtgcaaatgagttaaacatttaggtacaatcttacagaatgaaaatggtaggcatttgcacagatgaaaattaatcaagcctgaaatagttaccttaaacttagcagcaaagccaagcttttggataatacgagcatactggcaataaaaaagtgttagacttcacgtagcaaaataaaatgaaataaaataaatactccccatacctttcttgctgcaagctttgattgttgttcgctctttgccccagtacatacctggtaaaggacaacaaaagatttataaacatgcttttaattccaccacaaatgctagcaggtcatggtgcccacagagaaattttggttaacaagcaaatttgatttttataaaaaagaagcaaagacgcagcaaatcggtgcatcaaacccaagacaaccccttcttaagtccactgcctaatagtcaggccccatacagcgtactagtaagcctaggctgtgaactccttcgttctcatgcttaaaatgtgaatttattatcagaaaaatgtattactttaagtctgtaacacagatattatccctcctgatgagaaccagcaaagcaacttttaatgaagattttatcccaaaaatgctgaccaccaattatccttcaacaagctattcggatcaagacattgatccaaaaggaaaatcaagtgaattttcataaacaagccttttaaaattaagatattgacgcgacatgaagtccatgtgatgtgtcattgctgattatccatcaacaaataaatatgacaggttcaatttattgtcaattctgattatgctttaagacaataaaaaagttaacaaggacaaactatacatttacagaaagagcactacttatctgttattatgtaacagcaatgcaacagcaaacatgtcagaaaatcagagcaaacttaaatttacagattcagcattgaactacaggctgcatggatcaggtatggatgtgatagctgttaaaaaaacaaagaaaaactaaaaagatagtaggctaatagaaagcagttacacatcagcaaaaagagttcatcaatcaatatgcgttataatagctacaagagcaacaaagacaggtgataaagcaattcacaagtcaataagaagatgaacaaacagaatatttgcagtcttagctatacaaagagg

SEQ ID NO: 87234 - DNA, 1227 bp, Oryza sativa
tcggcgtggccccctccgggcgcctgctgctggcacgcgccgccccgcccccttggggaggagatgggggaggggttccttcctgcttcctcttcccccgggcgtcggcagggcggtcgctccccgggcccccgtcgcggggcccagaagcacgaccccctcccggggtagattgttcccccctgcggctcccacccgcgccatcgtggcctcgaggagcccgctccttcaacgccccgactacctgcatgatggtcaggatggaggcgcggtctggatcgctgcagagggggaggactccttgaggaatgagggatgcctccacggagctgagattcagcacccgttggaccactatcttgaagtcctcaggagcccagtcccatctgaccccctggtgggtcctcatacagtcctcggacccggtgtactcccaggcgccccgggcgcgccgctggagcggcgcaatccggcgacgaaggtagtcgccgaacaccatggcccctgtgagcccctgggatcgcaggcccaccaagcggtcgaggacggcgtcatagctgtcacgaccggaaataacccaacgggctttcctgacgtgtgtgcattaatccttgtcccaggaggcaaggtacaccataagttgatacaaatcatagtttaacaagcggaagcgtaaatagttaacttattacatgggcagcgaaagcccagcacacacagagacaaacgagaaacagcgggagactagggcgacgaccacaggcgcttgacggcaggcacgagctatacaccgaaaccttcatcttcaaggaactccttttctggacttgggaaaaattgagcaagactgagtacaaccaccgtactcaacaagacacacccacaaatgcagaataaatgcaaaggagtacaagggaattataatgtaaagggttagggttgcagtaaacagcatttaaagacatttagttgctcagggctattttgtaaacgcgatcctagaactatacaaagttattaatcaaggccgtgaacccacacgaacctgccttaacccaaggcctatgatgattcagaccgaactggcaacccgaccctgggtcccagctcgtcccaagccaacccaggccaaccattccatattttagttgttaagcaagttttaagaattaaaacactaacttgggtacattgctcggcttgcccataaccgagggctcggctatt

SEQ ID NO: 87235 - DNA, 817 bp, Oryza sativa
  unsure (1)..(817): unsure at all n locations
cggcataataggccagccgtgtagncgaaggcaccactcgncgccgacgaagcaagnccggcggtgaagtcgacgatgcccatcaacggtggtgtgaccacccgcccgtataggcggggacaccagtcgccggcgacgaaggcaggccggtggtgaagtcgtagacgcccaacagcggcggcataataggccagccgtgtaggcggaggcaccaatcggcggcgacggaggcaggccggcggtgaagtcgtagacgctcaacagcggcggcataataggccagtcgtgtaggcggcggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgcagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataagaggccag

SEQ ID NO: 87236 - DNA, 1354 bp, Oryza sativa
tttaaggtattgggcacttgatcacgcgcactttggcctaagcaaaaagtgcctaagtccctataagaacgtgacaggccacacctgaaaatatgggctgcagacatattaggcctaggccaaaaaatatgccttcgacaccctttaaaggatgacgcatgtaacatgcttccgagtaataaatttggaacgggtgatatagaccaagtatagctcatatcaatcgcttctgatctgagtgattatcccttatgggatactccaaaatagatgtaacaattgaatcccgactggcgcaagtattcagttgataacccttacggggaataataaatagtccagtctttgagcatagaaaatagacccataatcacgaattcatattgcatatatccagagcaagtccaaattgaaggtatgatacttgtgtctgagctagtaagcccctgagcacgtagtcacaattgttcattgatggtagctgacgcaattggcatagagacaagacgacaaatacagagataatattgaccagcagaggtggcaaaaatattggtggtagtgaagatagtggtaccaatcaaaagtgatgaagttgcacagccgtggaggcgaagaaaccagtcggcagcagtcagatcagccagcaatgaatatgaaggcgctcagcgataaagttgtgtagttgacgacgacaaacgcaaccgacatgatgaagatgacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcagagatgtcagggtcgatgaagcagaagtgctggtgatgatgtcagtgacaatagtccatcaaattaatgttatagctattgtagatgcttcacttggaggagagttgatgttgttgtccaactcgtccaaaccaaaatatttcaagttgttgaagtagaatgtctgctctgaatcaaagatgaagataatgactcctggagttgactcgttggttgatgaattaatttcttcagcttgacataaaatttgtcaaattttgagccttgtatttgtgtagcccccgactctttgattagttgggaaacaactgaacatagagtcgagaactgtagcatcttgtcgtcgaatagttattgcttgatttaagatatgtgttgaagatgtccaagtagaaatcatgaatgttggagagccacttgttgtagtaaaataacacggcatcgcctgccgagatgtcgagattcacaacaacgtcatggttggtgatgtagca

SEQ ID NO: 87237 - DNA, 641 bp, Oryza sativa
ccgccttcgctcttccaagtagtcgaggtcatctatgcgaagctgatcttgatcagcctcgcagtacatggtggcccgaggggacctcaaggtgagctcggatgggagaaccgcttccgcgccgtagacgaggaagaaaggcgtttccccggttgctcggcttggcgtggttcggttcgcccagagcaccgctggcaactcctcgatccacgaatcaccgtgcttcttgaggatgttgaaggtcttggttttaaggtctctgaggatttccgcattggcgcgctccacttggccgttgcttctggggtgggcaggtgaggcgaagtagagcttgatgcccatgtcttcgcagtaatcgccgaaaagttcactagtgaattgggtgccgttatccgtaataatacggttaggcactccataccgggctgtgatgcccttaatgaatttaagtgcggagtgcttatcgatcttgacgaccggataagcctcgggccacttagtgaacttgtcgatcgcgacatacagatactcaaacccgccttgggcccgcctaaacggtcccaggatatcgagcccccagacagcaaatggccatgaaagtggtatgatctgcaaggccttggcccgctgatggatttgct

SEQ ID NO: 87238 - DNA, 1099 bp, Oryza sativa
ttagtgaacttgtcgatcgcgacatacagatactcaaacccgcctggggcccgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgtcgaaaggctttgccaaccaaggtgcgcgaggcggagtgggctccacattcgccttcatggatatcggcaagaagctcgacgccttgttcccgaggaatgcacttcaggaggattccgttagccgcgcgccgatagagggtcccttctaccagcacgtagcgtttggagatgcgctggacgcgttcactctcttcgcggtcctcgggtagagtcttatctgtgaggtatgcttggatctcagcgatccaagcaatcaatctaagggagctgggagcgctcccctcgggtcccgaggcctggactccgacgggcatcgggggcctgtcaggcgcgtccgtctcccctaaggggtcgggtcgcgccgacggctgggcaagcctttcttcaaaggcgcccggtggggtctgggctcgctaggaagcgagccgtgagagttcgtcggcaaccgtgttatcccgtctgggcacgtgccgaagctctatcccgtcaaaatggcgctccatacgccgtacttggcgcacgtaagcgtccatctgcgggtcagagcaccggtactccttacagacctggttaacgaccagctgggagtcgcctaacaccaggaggcggcggatccctagtccagctgccaccttgagtcccgcaaggagtccctcgtactctgccatattattggtcgcccgaaagtcaaggcgaaccaaatatctgaggacgtctccgttcggcgaggtcaacgtgacccccgcaccggcgccctgaagagacagggagccgtcgaactgcatcacccagtgggcggtgtgaggcagctgcgaggggcccgagctggcctcggggactgagacgggctcgggagctggggtccactctgcca

SEQ ID NO: 87239 - DNA, 675 bp, Oryza sativa
cggcataacaggccagccgtgtaggcggaggcaccaatcggcggcgacggaggcaggccggcggcgtgaagtcgtagacgcccaacagcggcggcataataggccagccgtgtaggcggaggcaccactcggcggcgacggaggcaggccggcggtgaagtcgtagacgcccaacagcggcggcataatagaccagccgtgtaggcggaggcaccaatcggcggcgacggaggcaagccagtggtgaagacgatgtcgctatcggcaacggcggcggcacacaccaaccgtggcagcgaggccgcaagcagtgaatgattgtttgatctcgactgccatccaatgcatgcgaacaaccatcgctccagcatacatgtagattaaatcgacgtatacacgtgcttgctcctggtggccgagtatattcctgtgtcctgtgccaatctagcagcacgtccatctgcatggaagggaagagaggagcactcggacacggcaagaggcacccgagtggccgagtaggcgacgatggcggccgtgtcgtgatctcaaccagcatgtgaaaaacaacaaaaattgccaggaaatcaaaacggccggcgattagggattaattaataatcaatctaataaaaattaaattggaacagccaacccaagttgtacggcgtggct

SEQ ID NO: 87240 - DNA, 963 bp, Oryza sativa
tagcatttgctgttgggttcgtgagtcgcttcatggagcggccaactgaagagcacatggtggccctgaaacccattctacgctatgtcgcttgcacgatggagtacggacttcattacaaaagggagaaagaggagcagcggctgattggttacagcgacagcgacctcgccggcgacattgatacaaggagaagcacaagtggcatgttgtttttccttggctcaagcttggtgagttggcaatccatcaagcagagagtggtggctttatcttcctgtgaagcagaatatgttgcagccaccaatgctgccacacaaggaatctggttggctcgattgctcggcgaacttcttgggaagcaacctaaagcgatcgagctaaaggtggacagcaagtctgccttggcgctggcaaagaaccctgtcttccatgagcgcagcaagcatattgatttgcgctatcacttcatcagaagctgcttggaggaaggaagcatcagcgccagcttcatcaccaccatggaccagctcgctgacattctaacgaaggcattggggcgagttcgattccatgagcttgttgcaaggattggagtggtcaagattagttcagaatagaagaacaaggattaaggggagattgttagtataatccttgttctagttagttatttggttttcttagacagtaagctataggctgcagctgttactcggatgtcagactgctgctattagtggtagtagtcaattttgattttacctctagcaggaacatagcagcagcagtattgtcggttcagcaacggacctatccatgtactataaatatagctattgtgctaacataagtaagctttttaagctcattttaagtttcagtttcagctagattattgagtgccctccagaagtgatcctaccaccaataaccatcagcatattgtgttcaattgtgctt

SEQ ID NO: 87241 - DNA, 759 bp, Oryza sativa
  unsure (1)..(759): unsure at all n locations
gctgatgctgcccgcacgcagnagttcatcattggaagaaagactattaggttggatcggaaggtgtacgataaagctcatttcacggtactacagcatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgcctagtgaaacacttcagtggttgtcacagggtcctgaatggagtgccaccacctggcaaggatatgacataaatggatacacctttcacacggtcaagcaagacagcaaatgcacagtgcagaacagtgggttacgcatcgaggctgctagtgacggtggtcgtcgtgatcaatactatggtagagttgagcaaatattggagctagattacttgaagttcaaagtcccgttgtttcgttgtcgatgggtcgatcttcgcaatataaaagttgacaatgaaggtttcaccactgtcaacttggctaacaacgcgttcacggcttaaaccgctcgttttcgccaaacacgttggtaaacggttctaaatgcttcacccaggtaccatagaagttctcgttgttctgtaagccaatagaactatcgttggtctgtccactctcttagcctagttttatatcatcctgtctctccctctgttacgctacgcgatattcttctcttctacaccccg

SEQ ID NO: 87242 - DNA, 660 bp, Oryza sativa
tactttcctttcttccgtacaggtggcttgcaaaaaggaatcgacgatggcccatgtacactaccttcctacaatgttttagatacgtactttcagtttcatccatgtagtgggtgtgttaacaacagaattttgtatcagatccggaaaagaaggaacaagatcgaagcggatttgatgaatgatcaagttgtatttgaagtcggaccgcgcatcggctgggcattgtatcggctggagacagaatagaagtttggcttagccaatatggcaagtggccgatacgatatgacttgggctcgtttcgggtctagattggaataaccgtcattgtcaattagagatagagctcgattaaggcaattgtatatattaattaggatatttaagtcgattgttagagatttggcaacagaccgccatgtggtcttgtttgtatcttatctttaggaaagtttgagtcgtgttcataatggactatgtttgtactcggggtacaaatatgaaccccagagcattgtaataagggaaataatccaatacaacttcggcgcatcgtcatccgtttttgttcttcttttcgtcgagttctctcgacaagaggtaactcgtctcaatggcttgtgctatcggggctactatgtcgttttggatgttata

SEQ ID NO: 87243 - DNA, 533 bp, Oryza sativa
aaaaatttaaaaaatagattaattaatatattttaaggcaacttttctataatgttttatgccaaaaatacatcgtttagcagtttgggaaacttgagtgtggaaaacgagggactaaagttgggaacttgcaccaaagaacacgagggactaatgtgtatgaaatctcactgtgcctgtgattaagttatatgacagtgacaatattgactttgtctgtggtgaacttagtggtaactgaatttgtcacctcagctaaaaattgatcaagcccatgcgaagacaattcagaccgcatcttgatagcaacctcagtactgtcttctaaacaaccgtagtacacatgcccgaagcctccatgcccaattaaatgtttgaagttatcagtaaacttctctagctcttgatacgtgaatcggcgattttcaggttcttgtaaatggtcccaatgatttgtgatatgtccaggagcacccctgagttctggtaccatggcaagatcagttgaagaagctagtgcaaaaaaaaaaagt

SEQ ID NO: 87244 - DNA, 520 bp, Oryza sativa
tgcttcaactgtggagagtatgggcatttcgctaataaatgtcctcatccaaacaagacacccattcgtaccggagctaatgcaacggctattcacggtactgctacccctgctgctggacgaggtctattcaggactccgcagactaacaggaccgctaccggatttggacgcgggcaagtgaaccatgttcgagctgaagaggcccaggaagaccaaggcgtactgatgggtatgttttcactcaactccactccagttaaagttctcttcgattcaggagcatcgcattcatttatatctttgaaagcaagtcaacaacacaatttaaccagagttaaattaagacaaccaatgttagtacattcacctgggggtgagatagcagtggatacagcttgcattgacgtacccatccgccttagggatgtggtatttccctccaatcttatggtgctaataccccaaactcttgatgtcattttgggtatggattggttagcaaagcatagaggagtaa

SEQ ID NO: 87245 - DNA, 536 bp, Oryza sativa
cccgagccgatcgggcggtggcggcagaagtggccgccgggcttggcttggctccaaagccggccggccggccatggctagcggcggcggcacgcggtcgacggcgacggcgaccggcggcacgggaggcggcggtggcggtcgaaagcgacggcgcgcgatttgaagcggcggcttggcactaagagggagaggaaggggaatagaggaaatgaatgcctcaccgcgagtggccggcgctaagggagagaatggctaacggcgacggcgagccacgggaagacggccgcgacgggcggacgagcttcgggatgccctagggaaggaagagagagagattagagggagggagatgaaccccggcggcccgcatccatgggccaaggcggcggtaggggtagggctcacttgagcgcgaggggatgcggttcccgcgacaatctcgaccgaggagcgtcgcacgaggtggagttcggcctcgcgaacccgacggcagcgacggcgcggtgcgtcggcgaccctagcagcggctagcg

SEQ ID NO: 87246 - DNA, 1384 bp, Oryza sativa
atccacagtccaccactaagctatctagagaagaggcctctagccgacgcgagatgtcttaaagtgttttctttgcattatcagataagggagctagagctttgcttgaagtatctttttctgcctcatcaagataatctctgatatcaaaatagaagagatcggctagaacctataggtataagttcagaaagtttgagagctaagccaatatagccgatctaaattcttgcatcaaaggaaaacttactgggatagcaggagcagctggttgttcttcttccacaatatgatgactccctacagccgatggagttcggtcactcaatgattgttgtacaggggaagaaggaggaggaggaagctgtaaaaagacaagtgttagacaaaatcggctagaattgactagtaaaattgagagtgtcttactagtggagctggtttgagaattggtgctgccgatgttttctttatagcagttttcttcttctataatcacaaagcctatgagtagtcggctgaaaaataataattataaaaagggtttgcaaggaaagatgttttactctgaagaagtgagtgggggcagaaggagttggaggtatctgcttaggcgaagccgatggtgttttttcagtatcacttacttcggctgcagcctgatcaacatcatcctcaatattttcttcatccagagctttttcgatggatggatctagagcagacagatcatcagctggtgcggtcttctttgtcttagtcttcttcttggagctggggctgaaatatttacagccgatgatctggtctttcttttcttgccggcatcggctggttctctaataagcccttggagaagagctaaagtcttgggggcattatagccgatgacggggggagatggcccacctctgttggggatcagtcctggggcatactcgatatccctgccgctgttgctttggtgagggggagaggattctgttgtctgcaaatcaggaggaaagttagctaaggactaatcaaccaagtagttattcaaataaaatcaagtgagttaggatttacttgaggaagaatatctggaaagagatctgtcatatacatggaagccgattgatggaataagtgtagcttccattcagtccaccatctgtcaaatgctttgctcctaaaggttgccagctttgtggtgtcaatgctgcctagaggaggtccttggagattgagcagccgatccatcattaaagatgatgagatttctcctcggcattggatcttatcggcaaagaataacccgattaggaggtgcccattccaaattgttggcagaactcatggatgataaaactcgaaagaaacctggatgtttctcccttgatga

SEQ ID NO: 87247 - DNA, 2031 bp, Oryza sativa
ctcaaggggagggagatccatccaacagctacttccataaatcctttgtcttctgtcttagcaacttagacactaccatatcttagctaaggtaagtacctgaattagctaaggattggaaaaatcatatatctggcagtgcgttcatattgatcactctatctttatttttttttttgtggaatgttgttctttgattaccctgctttagaattgaaggagatgatgtttgctgataatataatttctttttaaaaatggctattgaagaacaaaaaaaaatgcatacttatactacttaatttcttctatgctctttgaagaatgtctattttacattgccaatttagcacgtgtatttctttatataagattagtcttgatctgcaggtcatggtggtgaaggagagggtactcttttaattgaggtaaatacagcgaagattttgctcaggccattcatgccctttagtgttgatttttctgagctcctatgaatatacataacatctcttgacttgctgactggaacaacgtaaattgcaattggaatgaagggatggcccactctattgccttactgacaagagagatagtcctcctttgctaccagaatttgtttttccttggatggggttgctgccagaattgttttttttattgccttggatggactcattgcagccctaagctggattctgcatatagtccttcataagttggacaaagtgctgcattgggtgttgtaaaccgtataaaattctcatattttctttctgtttcccccctacacctcgctgattgctttcgtgttttgtcgtgtttataaaatgttgtttttgtacatgatggacacaaagtcttagccatttccgtgcattattcttaaccacttttatattagtcatgtttacgaactgatgctatctgtcaagagccttatgatctagggtaggcggccctcgactacggagttcgtaatctccggccgtggtcttccgatgcggaggttattcccctcactgccgatcgggcttgagagcgagaggtaggagagcaggtaattgatcttgcctccctaatcttttcggtttacagggaatatatggccatcggccctaaccaacggaggaaacaaactcctcgattcaaggaactaatcaaagatagcaaataatatcttaacaactaaaaatagctttccaacttcagccacttgcgctgatcgcttcatcctcggttgcatgcgccgtgcccgcgatcaccgcgcgttctgcgtccatgcgtgcgcccgcacgttctgctgcccggcgcacatctctggctcggtgtctcctggtgtaggtcttcccccacatgacatctcccccctcctcgagactcagctcgtcctcgagctgaagggcagggtacttggcacggagaacttcgatgtcctcccaagttgccgaagccggagactcgcccttccactgaacaagggcctggcgcacgcctcgcgccaaacgaaaccgaacagcacgttccggctcaggggcgatggcgccgtgatggagaggaggcagcgccggtggtgcacccggtggcggcccgtggaacttcttgagcaggccaatgtggaacacgtcatggagacgagcgccggccggtagctccaggcggacggccacgtcgttgatgagctcggtgatgcggtatggcccatagaagcggggcttcagcttgcccgtgccggactgagggagcgacgtggtgggccgctggcgcaggcggaggagcgcccagtcgcccacctggtatgcaacgtggcggtggtgcttgtcatagtgcagcttctggaccgcctgagcttgctcgagccggtagcggatgtcaaagaggaactcagcccgctcctccatgcttttggcgacggcggcgacccgcgtgtcccccgcttcgtaggagcggatggagggtggatccctgccatagacgacccggaacggggtgtcccgaagcgaggactggtacgccgtgttgaagatgaac

SEQ ID NO: 87248 - DNA, 516 bp, Oryza sativa
aacacaacaagaccaatacatgcattataataccatagttcacatttgccacttccaaagcggcaatcatatccatcaaaatccaatttcgatacacttattaaatttctttgaaaagaaggaacataaaaaacatctcgaagtaaaagtgtgaagccattcgtgagctctaggcaaagatctccagcagcttcaactttttcttcaactccattggcgactccaatggagctttcgcttctttgcgtagtcctcatcgaacagaatgcctttaaacaattacatgcatgaatagttgctccagaatcaatcctccatgtggatctagaataaacaacataatgagattcatttacaaatgtaacaatgttcttacctttccttgccatgatcattttcaggaagtcgggacaatcttttgtggaatgtactatcttcttgcagtgaagacaatgatcctttttaacagtgaactgttggtgctaggcagatgctaagacttttttgcttttgagg

SEQ ID NO: 87249 - DNA, 2981 bp, Oryza sativa
caatattacctacatctttggtgcttttcttttgcagcttctaacagggaaatatgggatcacacccagcaagacgcacctgtttcaagttccgtgctcccgcctatgggaaaaatgactcctgaaagggtatatagtacaaacagctctatgtcaaagaagatgaaggtctctgtcacagcgaatccatatacagttgcttctctccaagttgctacaaacagcttctgccaagattcgctcctaggtgagggttcacttggtcgtgtttacaaggccgacttccccaatggaaaggtaaaacatcacttgcagtaatctattgttggtcaatacagaaatattactttgaacttagcatggtattgccttatatatgttcaacaagtgtttatttgcatagctatgacgcagtggaactgaattctgtgcttgatcgcaggtacttgcagtgaagaagatagacagtgcgtcactttccttgtatgaagaagataactttcttgaggttgtgtcgagcatttcacgacttaggcacccaaacattgtgccgcttgcaggctattgtgttgaacatggacaaaggcttcttgtgtatgagcacattggaaatgggacactgcatgatatattgcattttttcgatgatacaagcaagatccttacatggaaccaccgcatgaggatagcactaggcaccgcgcgagctttagagtatgttattatttgagcactctagtgtttttcactctatgaaaaggttatgttaatcaagtataatgctacaatgcaatgccaacctttcttcagatacctgcatgaggtgtgcttgccccctgttgtacatagaaacttaaagtcagcgaatatcctgcttgataaagaatacagtccccatctgtctgactgtgggcttgctgccctgacaccaaatcctgagagagaggtaagtaatgtagtaccacatctctatcaatgtagttatttccaacatttcatctttaggtcctacagtagttctttgggctaaaccatgtgttatgatgcaggtttcaactgaagtgtttggatcttttggatatagcgccccagagtttgccatgtcaggaatatatactgtaaaaagtgacgtgtacagttttggagtagtgatgttagaactattgacagcacgtaaaccgttagacaggtacattaccttattatttcagagctagtaagtagtaagaaaatgagtaatgtatttctttattagtaacttcaaggccgtcattcattcttgtgttgcaatgtgcagctctagagagaggtccgaacagtctcttgtcacatgggctactccacagcttcatgacatcgatgcgcttgccaagatggttgatccagcaatggatgggatgtaccctgcaaaatcactctcccgtttcgctgacataattgcattgtgtgtccaggtaatattcgttatctttcgcacatttctttgtcctgcatatgactacccatttcttgttcgcccaaaattgttcttacagcttctaatatgaacaactcactgagcagacggttcagttctatcaatcttaaagttggttttggataacatatgaactagaaatactcttcagaagcacgctaagatcgatcatcattttcagtttgtaccataatgctgtcaatgctttgtagcccgaaccggagttccgtccaccgatgtccgaggttgtccagcaactggtgcgcctggtgcagagggcaagcatggtgaggcgtcaatcaggagaggatgtggggctttcatacaggggccctgaccgcgagggaggcacagccgacgccatctgagaccaaaatcttctcagtctctcagctatgcagggttacaaaagtttcagagaaagcaagctgggactgtggcaacatcccagtatctccaaagctatggatcagatcacttgttcctgcacaaaatgaaaagagaagagaagaaaagaaagaatgatctgatcacctgttgagtttggcatgagctgttcagtgttcagttttttcactctgttctctctgtggtatctgtccaattgtatactacagtatgtggattttgggccgctactgggactttgtgaatggcatgtatagtgttcaggtggctggtattttggtagttgttaattaatttatagtagataagaaaagaaggtagataaatgtacatttatggacttgtgcactgctactgtcaacagctgaacattccaccttctacggcgagctgtacactacatgcttatagttttaagagatctctagttttaacggtatttacattcttcgagcacttcctcttttttttttttgaaatataagtatttatacgttgtttagcagagattatctttgggaagaaaagactttggtgtcccatattaagtgatagatggttgggaggtaagatgtgaataaatttcagtaggaggtgactgatgggataataagtggagtaatactctgaacaatgctagaagtgtttatattttgctacaaatttcaaatgttagaaatgcttttatattttagaatagagggagtagtttgttgttcttctaatttaatggtattgtactcttgtcctgccataagataccaccgtactctacgactatgtgcatccatgatcatcatgttcatcctctgtcttaaaagataaaactgctgaaaatttctaggatagtgacatgtgcctggttggtaagtcaagcctgagtactacagcatatcgatgacagcaaattgcgatgcaatcatgcaaagtctgcaaacacatggcaattaaattcagtaacaggaggctgacaactccatcatttagtattaggtacaactaaaatttaaattttaaaatcattttaatatatattttttcatctaacttattttttaatcttaccagttgaatcgttaaaaagggctgcaggaat

SEQ ID NO: 87250 - DNA, 549 bp, Oryza sativa
caggcggaaacaccagtcggcagcggcggtcgaggcggccggtcggtgaagacgtagacgcccaacaacggcggcataaaggccagccgtgcaggcgaaaacaccagtcggcggcggcgaaggcaagccggtcggtgaagacgtagacgcccaacaacggcggcataaaggccagccgtgcaggcggaaacaccagtcggcggcggacgaggcgaccggtcggtgaagacgtaacgcccaacaacggcggcataaaggccagccgtgcaggcggaaacaccagtcggcagcggcgaaggcaagccgatcggtgaagacgtagacgcccaacaacagcggcataaagaccagccgtgcaggcgaaaacaccagtcggcggcggacgaggcggccggtcggtgaagacgtagacgcccaacaacggcggcataataggccagccgtgctggcggaaacaccagtcggcggcggcgaaggcaagccggtcggtgaagacgtagacacccaacaacggcggcataaaaggccagccttgcaggcggaaacacc

SEQ ID NO: 87251 - DNA, 1095 bp, Oryza sativa
ctgattatgatgttttggatgaagaatgactattgagtagctacgtgtatagtgtacacaaatatttttctaaaagaacaaaaaattatgtcatctgcagggtacagctgatgaagttgtcgactgttctcatgggagggcactgtgggaactctctaaaataaagtatgagcctctgtgggtcaaaggtggaaatcattgtaatctggaactatatccagaatacatcaagcacctaaaaaagtttgtcatggccattgagaaattaccacctacaaaagatgaatcctcagggagctcaggtccttcagatccttgtgaaataggatcagaaagtatgcagagctcaagaaaaacacggatgtaaaggataaatctaggtcaagcattgatcacaggcatagcgttgataggcgggaaaaaccaagaggaagcatagataggagagataaaagcagaaagagtatagatcatcctgataagccaagggctagtgtggatcaacctgatagaccacggagaagcatcgatcggtgtgtattcttatatgctctcgttttgttttcacggttctttgtggattcctgttaccagatgagatttgactgttgcaacccattgctgtgacagttttggagggatgatgaggtcggtgacatccgtcaagttgtgcaatattgactgtttcaaagtaacctatgcttctgggagctgagaatactgaaaggttagtgtttgtgagtcatctgtatttaccccgtttgcattctttgttcgtttgtggctggctgtggaatgtgtatttttttttcggaaatacgctgtggaaggtatattgatttgggtaaggccttgtcttctcttgagttgtttcttgaaaagaaatagccattctttcccaacccttttgagtttttggagtacattcttttgttgagttcaagaacgacactgccgtggagcactaaggagcaccgttcttacatagatgtcatgtacatattgttgtatcattatactgtccagtttttctttcacacgggaacatttcacagacgtgatctaacaaaactgggaatttttttgtccctctcg

SEQ ID NO: 87252 - DNA, 572 bp, Oryza sativa
ggaaaacgatgatgtttatcagtagtggtagctgtctaaaccagacgtagaggtgagggcactagtcagcagtagacgtagacagcttgcgttgaagatgatgatgcctattagcggtgacggtgatgtagccagccgtgaagaagatagcatcagttggcgtcataacaggccagccgtgcaggcggtgacaccagtcggcggcggacgaggcggccggtcggtgaagacgtagacgcccaacaacggcggcataacaggccagccgtgcaggcggaaacaccagtcgacggcggtcgaggcggccggtcggtgaagacgtagacgcccaacaacggcggcataaaggccagcagtgcaggcggaaacaccagtcagcggcggacaaggcggccggtcagtgaagacgtagacgcccaacaacggcggcataataggccagccgtgcaggcggaaacaccagtcggcagcggcgaaagcaagccggtcagtgaagacgtagacgcccaacaacgggggcataataggccagcccgtgcaggcggaaacaccagtcggcagcggggaaggcc

SEQ ID NO: 87253 - DNA, 1704 bp, Oryza sativa
tcatagaacgatgccatgcctcaccctatggtggccattatggtgcattccgcacccaggccaagatttggcaaagtggtttcttctggccaacaatgtacgaagattcaaaagaatttgccagaagatgcacaagctaccagaggcaaggaggaatcactgctcgcgatgcaatgccccttacatacaatttgcaagtcgagatattcgatgtttggggtatagacttcataggacctttccctaagtctcgcaactgcgagtacattctagtggcagtcgactatgtctccaagtgggatgaggctatgccgtgcagcgcatgcggatgcgaggcatgccaagaagatgttcacagaaatcatcttcccaagatttggtacccccaggatggtcataagtgacggaggctctcacttcattgacaaaaccttctgagacctcctacgagagatgggagccaaacacaatgtggccactccttaccatccacagaccagcggtcaagcagaaacatcaaactaacaaattaagaatattctgcaaaagacagtcaacaaaatgggaacaagatggaaggatagattgccggacgcacgtgggcataccggacagcatacaagacacccattggaatgtccccatatcagatagtctacgggaagtcatgtcgactactcgtagaacttgagcacagagcatactgggccatcaggaattggaacatggattttgagggagcaggagaatggagaaaaatgcagattgctgaacttgaggaatggagagaaagggcttaccacaacgtgaggatatgtaaagaaaggaagaagcgttggcatgacaaaaggataaaaatcaagaaattcaagccaggagacaaagtactgatgttcaactccagggttaagcttttcggccacagaaaattatgcagtaaatgggaaggaccgttcgacgtcatcgacacctcttcgcacggggcaatcacactccgtgacaaattagttaacatatttaaggtaaacggtcaacacctaaagattttccttgagctaaatgaaactttagatgaagtggatgtcattgaattaatcgattatgaaccatgatgatcttatctaatgcatgcttaaaactctgtatagttgtcgtttttgtgcttagaataggttttagtgggcctaggaaaaatttggtggcctgccggacccaccagggttcagccgaaccaaaaccagggcgcgcccgttcagccccatttttgaacagtagtctcccccactcgtcttgagtctgtttagatgcgagttcggaggtagatcagtcgtaccagaacaagagcccctgttcttcctcctatctcccacattttgcaacccttctctccatctcaacccaattcccttgctccatcatctccaattcaccaatggctggcaaatccttgattccattcgtcggcacttcatccaattccacatacaacctcaccggagagccgacaccggtaaaccaattgattccgatcgaataatacacgatggaaggggtgaacactgtatgggctcaaccccttgcagctgtcccaggctcccctgcaattttggagccaatcgacgagctccctggttcggccgaacccttctcggccccattcggccccccggggggcagtaaaaaaggctgcaggaattcgatcag

SEQ ID NO: 87254 - DNA, 851 bp, Oryza sativa
gtctgttcagatggtctactacgaagatgcgttccggtagatgaaggcatgaagatcattgagaagtgtcatgctgccccatatggaggtcactatggagcattcaggacacacgcaaagatctgggagagtggattcctttggccatcaatgtatgatgacacaaaggaattcgttcgaagatgcactagatgccagaagcatggagggatcactgctcgagatgcgatgccactgacatacaatcttcaagtcaagctatttgatgtatggggcatcgacttcatgggacctttcccaaagtccgatgactgcgagtatatcctggtggccgttgactatgtgtcgaagtgggtagagacaatgccatgcagggccacagacgccaagcacgcccgccggatgtttcatgagattatcttcccttgttttggaactccacggatggtgataagtgacggagggtctcatttcatcgataagaccttccgaaattttttgcaagagctcggagctcagcacaacattgccactccgtatcatccccagacaagtggacaagcagaaacgagcaacaaacaaatcaagaacattctgtagaaaactgtcaatgagatggggaagacatggaagaacaagctacctgatgcattttgggcatataggactgcttataagacgcccatcagcatgtcaccacaccaacctgtctacgagaagacttgtcaccttccagtcgagttggaacacagggcgcactgggctatccggacatgaaacatggatttgaagggagccggatagcacaggaagatgtagctctctgagctggaggaatggagggacaaggc

SEQ ID NO: 87255 - DNA, 1068 bp, Oryza sativa
aaaaggtatccctttctgtggaggaatcaaaactggaggataggtaagatattccttaatactatccaaagccttatgttgctctaccccccaagtaaacttttgatcggccttcaatcataacaatggtgtaaaaggctttaaccttccaaacaaattagaaataaaccttctaacaaaatttatcttgccgatcatctcctgtaactctgtcttgttctctggaggctgaattttcttaattgcattaacaatcctttgagttatctcaatccccctctcatgaataagaaatcccaaaaactggccagccgatacaccaaaagcacatttcgttaggttcatcttcaagccatatttcctagttctctcaaaaaccttcctcaaatcggctatgtggtcctctatctctttagacttaacaaccacatcatcaatataaacttcaaccaaccagccgatcagattatgatatatataattcatggctctttgatatgtagctccagcacttttcaagccaaaagtcattacaacccacttgaacaagccgattgcaccaggacacctaaaagccgtcttatggatatcctcttcagccatgaaaatctaattgtatcccgtatttccatccatgaaactcaatatcttatgccctgaagcagcatcaaccagctgatcggctactggcattggatactcatcctttggggtagctttgtttaaatccctgaagtcaatgcacaccctcaccttgccgtttttcttgataacaggaactatactagaaacccactcaccatatcggcaaggacgaataaaaccaacatcatatagacgtttaatcttagccttgataggttcgagcatatcggctttgcatcttctcggaggttgttgatgtggtctaacccctggtttgataggtagccgatgttcaacaatcgatcggctgagtcctggcatctcataatactcccaagcgaagcaatctctgaactcctttaacagctctatcaacttggttctaaattctgaagataaattcttactaataaatgtcggcct

SEQ ID NO: 87256 - DNA, 1479 bp, Oryza sativa
aactctcttctttgaaggctatccgtcaacatcacctggatcatctcgtctaatcttgtatcgtagtgctttgcaaacatggcatgcttctaggttttcgtactcctcaccgcgatagaggatacaattgttcagacatgcgtgtatcttctgtacttccggtcctagagggcacactgccttcttaccttcgtacgttgtttcgggcaattcattcccctccggaagaatgttctttacgaatttcaataactcgccaaatgccttgtcactcacaccatttttagccttccattgctagaattccagcgtggtacccaactttttgtgcctctgctcgcaacctgggtacaacgatgttatgtggtccgctaacatgcgctcttgtttctgcacctccttttcactttcgcggtcctcctgtacgtcccacaacatttgaccaagatcatctgcaccgtcattatcttcaacatccacgtccgcctcgcccgttgtgttttcttcaaatccccaatactgagcccagcccggaatgttctcgtcttctacttcatcttcttctcttgcaacccctagctctctgtgagagatccaacaattatagctacgcatgaacccccactgaaacaggtaggaatgaatagttcgtgctgtggaatactccttctggtttttgcacttgttgcatggacaacatataaaaccgttacgcttgttagcattggccacactcaaaaaataatgcatgccgtcaataaactctttcgaccgccggtccgcgcacatccattgctgatccatctacctgaaatgcatataaatcataaaaataaaatccatgaaagtcaaactaattaaataatcatacaataatttaaaacatcatccttaaaatcaaaaccgacgttcgttacacatttttaatggatttggtatgatacggaagaaggcgccgatttttaaattaacttacatttgtattcttttatcttaattttctatactagttttttactttgtcatttttaatttattgtaattatttctagctgatttaactattttccaattaacttagttttcaattattttatataaataatcatataataattccacatagtattcattttttcattattttaaaatttctaaacatactttcattgtttttcaatatttatatatatttttccttttttcctataacatatttatccaaattattttaacctaattttccctctacaagttttctctctcatcatttcccaccatataccttattggagacaatattgaatacaaacaaagccataaatgtaacatgctaaacatacatcattagatggtgttgctaaccttttcgattcctccgatttgtatattatcaataaaaatttcattaaaaattttggtagcacctccctccctcaaagctccattttgcagcaatggctcgagctagaggaggaa

SEQ ID NO: 87257 - DNA, 1007 bp, Oryza sativa
tagtgttcgaccataggtacatcccgtacctaaaggcggccgggttgctcagggtggccttggtcgtgagcagaggaatgccagtgttcaacgctcctgcgttgacagcacttgtggacagatggaggcctgagacacacagcttccacctccccagtggtgagatgaccatcactctacaagatgtggctatgatcttggccctcccattacaagggcatgcggtgacgggtaggacagagaatcctggatggcgtgcacaagtggagcagctgtttggcattccactcaacattgagcaggggcatgggggcaagaagaagcggaatggaatacccctgtcttggctgagccagaacttctcacatcttgacgacgacgctgagccatggcgtgttgagtgctatgcccgtgcatacatcttgcacttgttgggaggggttctgtttcctgatgttgggggtgacattgcttcggccatatagattcctttggtcaccaacctaactgatctgggccgtttcagttggggcttagcagtgttggcgtggacatatagacagctctgtgaggcctgttgtcgtcaggcaccatcatccaacatgagtggttgtgtgctattgattcagctgtggatgtggttaaaactaccggttggaaggcctaagtggaggcaaagcttcactccttggctctacaatgagccagacatggagaagatagtggcctacttgtttgagagtactgccactgcacatgctcaccgggatgtggcatacaagcattatgtcaatgagatggactgcttacagcctcaacatgtaagtacttccaatatcacttctagtttgacatttacttctttaattgagatactaaccaacgacatctcttcaacttttgcagattgagtggttaccataccacacaaatgaggcttcaagcctgaccctgaactcaatgtgcaatcgagactctgactacttcatgtaccagtgcccattgat

SEQ ID NO: 87258 - DNA, 770 bp, Oryza sativa
atcgcttcgatctcctcttccctcttgttttaatcttcaaatttgggtcagcaataaattcttcaccattgtacggtggccactgtgtggggtcgaggtatggctcaaagcgacttgcccatgtgttcacaacggctcttgaagagaactaatacggcattcggttgggagattcctcatcaattgcatgaatcagatacacgtggatgagatgtgagcaaggcatatggtagagcaatggcctttggcaagaacatgagttcccctcaccttcaactttgaagactcttgcgccgattctaacaccaccacgcgttataccacccctctctgtgacctcgtatgtctttttctgcttatcgaaacaccttgaagtgtgtttgttcgccttacttttttgcatcttcatcttactagtgaccttggtggaccaacgctcccttaactggacttgcttcactgcttcatcatgtctgttcacaaagtaatcattgcacttcatgaaggtaaatgatactatggccgtcattggaagcttacgaacaccaactagcacgctattgaattgttcggccatgttggttgtcatgtaaccccaccgtcggccatttctatcgtatgcacgagaccacttatctttatccaacaactcatcttcaagccatttacgaggaccttcgggaatacgctgtcttagtgcctcaacatccctctcaaatatccacttcttgtcaatctgacatatccttaggagcctctttgtctgatgc

SEQ ID NO: 87259 - DNA, 1690 bp, Oryza sativa
aatgaacttggtatgacactgacaacctcaatgtcacaacatggattttttcagagcagaggaattgtacttgtgtgctcggtctgccatacagattgtgtaatgctattaatgtttggtgtttgatctccttttttttaatcaaagattgatccttctgcacgtcccttttcggacgtcctacgtaccatgtgacatcttctctttgcatctcctgcctttcattgcctttgggtattgcatctattttatgatattgttttatatatatagtgattctttcaacatacttgatcactacatttgttttagagtttatcacttcatgttagtaacctgtagttgtttcttttcttagacgcactacgtcttgctattatgttcgtttaaagagcagctacagcagcatgtccgtgttcatgctatggaagcagtaatggcatgctgggaacttgaacaaaaccttcagagtttgacaggtacaacctttttgttatctctttcaattttcataatttacaaaagtaaaacttttattaggaaaaaaaatccaaacttttcttggtaatgcaatgatagtaaagaattgactaatggtttggaaatggcatattgttggagcagcgaattgtttgttccttgctcttgcttagtctggcacgatatgctcttgctcttgcttagtcttgctcttgctcttgtttgttcaagatttttgcttcagatagaaactccaagtccggtttaatccattttctaaaaaaggaaaaaaaaagaaagaaactccaagtttgtgagcattctctatttctaaagctttgagtgttacagacacgatcagagcgtaaattgagagggttttagtattttgctaagttagtttttggtagactggtatcaatcaaattgattaaagaaaatgacaaactggaaattcatggacaggtgcctcgcccggtgaaggcacgggagcaaccatgtcagacggtgaagatgatcaggcagatagcgaggcaaacatgtatgatccaagcttggatggagcggataacatgggtttcggccttcccacagaaagcgagcgatccctaatggagcgtgtccgtcaagagctaaagcatgaactaaagcaggtttgaaatggattccaataattgcttttcagggggaaaaatggacatgttgatgaatctcagtactaatcacttggcaaattcagggttacaaagagaagctgattgacataagagaagaaattcttcgcaagcgaagagcgggaaagctaccgggagacacgacttctacgttaaaagcttggtggcagtctcatgcaaagtggccatatccaacagtaagtgatgatgagagtgagacaattcacatgcttagcttccttatgactaatatactccctccgtttcacaatataagactttctatcattgactatatttgtttagatgttaatgaatctacacatatgtatgtgtctagattcattaacatttatatgtatgtgggcaatgctagaaagtctcacattatgaaacagagggattatttgcattcacaggttagtctagaaggagtaaaatgcaccaacggtccttaaacttatcgggaggtttcacttaggtccacgaacttgcaaagcgcacatcgagggccctaaacttgatttattgtatca

SEQ ID NO: 87260 - DNA, 969 bp, Oryza sativa
ctacatatcaaagagccatgaattatatatatcataatctgatcggctggttggttgaagtttatattgatgatgtggttgttaagtctaaagagatagaggaccacatagccgatttgaggaaggtttttgagagaactaggaaatatggcttgaagatgaacctaacgaaatgtgcttttggtgtatcggctggccagtttttgggatttcttattcatgagagggggattgagataactcaaaggattgttaatgcaattaagaaaattcagcctccagagaacaagacagagttacaggagatgatcggcaagataaattttgttagaaggtttatttctaatttgtttggaaggttaaagccttttacaccattgttatgattgaaggccgatcaaaagtttacttggggggtagagcaacataaggctttggatagtattaaggaatatcttagctatcctccagttttgattcctccacagaaagggataccttttagattatatctgtcagccggtgagaagtcaatcggctcggtcctaatttagtagttggaagcaaaagagagggttgtattctatctaagtcatcggctcttggatgcagaaacaagatattcccctgtggagaagttgtgcttgtgcttatatttgtcatgtacaaggttgaggcattatctattgtccaacgaatgcactgtcatatgcaaagccgatgtcgtcaagtacatgttatcggctccaattttgaaaggaagggttggaaagtggatattttccttaacggagtttgatcttcggtatgagtcaccgaaggcagtcaaagggcaagctatagccgattttattgttgaccatcatgatgattcaatcggctcggttgaggtagtcccatggactttgttctttgatgggtcaatatcctcttatgggttgaggtatcgggcttggttataatttcccc

SEQ ID NO: 87261 - DNA, 710 bp, Oryza sativa
  unsure (1)..(710): unsure at all n locations
ttactaagtgcagaccaatcgttaatggtaacgaacagcaacgctcgtaggttaaatttctcatgtttgtcctcatcccacacagggacgccctctttcctccacatcactttcagatcatcaaccaatagccttaggtataaataaccaatggtcttaggtacaaatcaatgtcgttaccaggttgctttgggccttgaataataatcggcatcatgatgnacnnnngcttcatgcatagccaaggggggaggttgtagatgcacatggtgaccggccaagtgctatggccgctgctcatctctccaaaaggattaattccatctgtacttaaatcgaacctcacggttcatgcatcctctccgaagtctttaaatgttgtgtcgatatttcaccactgcgacccgtaggtgaggtgtcttagcatcccgccttgtttacgttcttctgcatgccaccgcatcattctagcatgtgatttgttcctgaaaaaccgcttcagccgtggtattatagggaaataccacatcaccttagcaggaactctcttctttgaaggctatccgtcaacatcacctggatcatctcgtctaatcttgtatcgtagtgctttgcaaacatggcatgcttctaggttttcgtactcctcaccgcgatagaggatacaattgttcagacatgcgtgtatcttctgtacttccggtcctaga

SEQ ID NO: 87262 - DNA, 666 bp, Oryza sativa
gggctctccatcttcaattggctgtatatcagagtcggacacttttagaaaatctccatcccaaacttttctagataagcaatcgagaccatccatctcccaaagagctaaatcggcacttgcaacgttgactgacctgtcggctggcacgatttcaattttgtcgccttgccactgaatcaagcattgatgcatggttgaaggaatacaacaattggcatgaatccaatcccttccaagcaacaagctattggaacccttcccatcgatcctttccattgatgacaaagaatgttgtagggatagttttgctgccgactgtcagttctacattcaaaactcctttggtttctgatggattaccaccaaaatctttgagcaccatgtttgtcttgatgagatcctcagcattccttcccagcttcctaaacgtagcataaggcatcaaattcactacaaccccaccatcgaccatcatcttggacatcggcttcccattgacatagctatttatatacaatggtttaagataccgattctctatcccttcaggattctcaaagactgcttgttctggtgatagcatcaatttagccgattcttcttcaacttcatcaacatcggctctgcttgaccccaaactcagcaggtaacgtgaaaaccatg

SEQ ID NO: 87263 - DNA, 1988 bp, Oryza sativa
ttgcagttgaaatacaggcaagtatctgatagatacttttttcactgttcaaacattatgattttggttttaccagtcctcacaatactgatattttcttatgtgtttcaacagtgaaaaagatcaagctgagaacttgatgattgttgacctcctaagaaacgatcttggtaaggtttgtgaacctgggagtgtgcatgttcctcgcctcatggatgtggaatcatataaaactgtacataccatggtaagtaccattcgtggaaccaaaatgtcggacctaagccctgtcgattgtgtaaaggctgcctttccaggaggttcaatgaccggggccccgaaagttagatccatggagattcttgattcacttgaaactagtccgagaggaatatactcaggatcagttggattcttttcatataacaagacttttgacttgaatatcgtgatcagaacagttgtcctgcacaatggagaagcttcgattggggcaggcggggctattgtagcattgtcagatccagaagcagagtacaatgagatgctgcttaaagcaaaagctccaacaaaggtggttgaagagtgcagtcaacaaatatacaacccagatcgttcggattcaatgcagacaaccgtaagttagaatggagggtgaaaacgagtcttcttatgaaaacacaaccagcattacaaggtttggtatacaatgaccatcagtttggatctgaaaaattcgatctccgctgttggtgcacatattaatggctaaactacaaggaagtcgcagcacacctattctataattgggaattctaaaagcaacaaaaggacattttgctgaaagaaaggtgcctatgccaaggtggtgaaaagcacattggagcaaaattcatggtgtactacaatgtagagttagactagattacagctgacatgccttctccacaaaacaacagtgcacatgattttattgattgattgattcccctattgtggtgattgcactgtgtaataataataaactgataaaagaaagaaacccatactgaaatgcatttcatagcagattcatatatatatatattggcatgtatttgcaagattgcacatgtctcacctgagttcaaatatctgaaatttaccatgtactgtttctcaattcatgctagtattgatcctactggtgattgccccatcttgaaatttgagatttgagggcgagatggctgtttgctaatggcagcacttggttgagcatggctggcatgagcactgaacaccagatgtaagcaagggttgtactgcaaccagatcagatttgtgagctgaagaaatcgtctaagattgcatcttttcaactgattccaattccaaattacaatgggcggccggcctggcacgccattattccaatagtgtttatgaatcaattgcgcacgtcgcattatcggattgtgtcgtgccatcatcccagaatgtttctcatacgcaaatacacccctgtgagtttcacaacttttcgtagcctttttatctctgctcatgaatatttgactttaggacaagatttgatcaaatttttaaatgttgataataatgactcatatgtttacttttaaaaaaaacaaaaaaacgtgtggaatttctttgaaaaatgtaaaatttgctagattttacaaatttattttagtataacatcaacggcaaaatcttcaaaagtttcaatctttacttaaacgtcgattatttttggactgatagaacacttgcaattttggatggcttatggttctaagtttgggaataatgaaaaggtgagggagtttagtgtgattttgggaggatgagaaatatatatatggaggcgaaaatttaaaaaatggagccactcgcgagccacgactcgacctcgccgcggcggcgacgacgacgacgaccagcacgcactcgcaccggcggatcgccggcggcggcggaggaggaga

SEQ ID NO: 87264 - DNA, 2207 bp, Oryza sativa
ccgctccgtcgactcaggaacgtttttctctctacctgctgatgttgtgcctgcaatgcctgtcattgaggtaccagcacctgttgttacccctcctgtggcaacaatgaatgagagtgaggaacctgttatacaggattcaacagaaatggttgccacaccagaggaggagctacaacagcctcaaatagataatgtgccagtacaggagactcatcaagagcctcaggtacaggatgtgccaaatgtgcaggcccctagaaggtctgaaagagtcagaagatcggctatccgtgatgactataaagtttataatatagaagagtcgcatatggaggatgatcccacctcatatgaagaggccatgagaagcgctcgctcatctgaatggttggaagccatgaaagatgaaatgaaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtggcacattatgatttggaattacatcagatggatgtaaaaacggcatttctaaatggagatttggaggaaaaagtatacatggcgcaaccgaaaggttttgtcatgaaaggaaacgaaaatatgggatgtcgtctaaagagatccatttatggattaaagcaagcttcgagacagtggtacttgaagtttgatgggacaataaagaaatttgggtttcaagagaatgtcgaggacaactgtatttattcaaagtttaagaatgggagatttattttcctaattctgtatgtggatgacattctactggctagtagtgatgtcagtctactgcaggaaacaaagaaattcttgtcctcaaactttgacatgaaagacctcggtgaggcttcatatgttttgggcatagagattcaccgagatagaacaaagtatgcattgggactttctcaaaagacatatatagaaaaggtgttgaagaaattcaacatgtacagatgcagtgctacacctgctcctataatgaaaggcgaaaagtatggggcatcgcaatgtcccagaaatcagtatgagctcaatgaaatgaaaacaaagccatatgcgtcagctgtaggaagcctacagtacgcgcaagtgtgcacacgacctgacttggcatttgttaccgggttacttggcagatttcagagtaatccaggcctagagcactggaaattggtaaagaaagtcttgcgttatttgcaaggaacaaaaggcctcatgctgtcttacagaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacgctcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcctaccacccaacgtgttcaaggaacatgtagccggcatgggtttaagggaagccttatgaatcctggactacagggcccaaaagtaaagtatctgtttctgaatagagatgtgtatagtggctgtcgaatccatcggcgattgaccgtgacgatgaaacatgctctatttacaaatctgtgatggaatagaaaaagctaaaagaaaaagtgagatcaagggggagaatgttagatagatatctctccccttgagcccaacggctcaagggggccttgaccgcgccctgatcgggggcgcccagcccaatggctggtgggcccccgtcacactgcgccatataaaagaggggtggaggccgg

SEQ ID NO: 87265 - DNA, 4055 bp, Oryza sativa
ctaactcgattgccgtcgccgtcgccgcagagatcatcgccgccgcgtccggcgcccgcccgctcgccgacgtgtcctactgcgtccacgccctcgcccgccgtctctccaagacgcacaactgggtggtacgccgccatcgccaatgttttcctcatcgctcgccgccgcgtgatctgctgacgacgggggtggatggatggtgatgcaggtggcgctcaagacgctggtggtgatacaccgcgcgctgcgggaaggcgacgccgcgttccgggaggagcttctcagctaccggcgcggccgcggcggccattgcctgcagatgtccagcttcaaggacgactccaccccgctgggtcagctcccaatccaatctgaattcctgcataaactgaactggattaacatgaactcaatcggttcaaaaaattttgtcaccgatcgttctcatttctttgtgattgcaaatttgaaatctccaattgctttgctcagcgtgggattgctcggcgtgggtgcgcacgtacgcgctgttcttggaggagaggctcgagtgcttcagagttctgagatacgacattgaagcagagcgtctgaggacagcagagggagctccaaaggtttgtgaaattgtgattatggcttctaaatttcagggaatgattcggtggtgatagttcggcatgagtgatcttgttgcttgtgatgttttgtttgttccatttggtgagaaatatgtaccaattgaaatatgatgttcagggtcagagtagaactagaagcttaggtaaggatgagctcttggagcaacttcctgcactgcagcagctgctctatcggctagtcggctgccaggtaatgtacacacctaactttgtggtatgttatctgcttgatctagattagtttctgactcatttttaccaatgctgtaactgtgtgtgaagcctgaaggagccgcatttggaaactatcttatacagtatgcattagctctggtattgtggctgaccttaattctgatatctgaacttcagatactactagttagaacaatttatccgaattgctcttgctcatgatgaatgaaaatgttactcaggtgctgaaggaaagtttcaagatttattgtgcagtcaatgatggaatcattaatcttgtcgaaatggtaccttttattatttaccagctttctctgcatttgaatcatcgatggatctaatggatatgatcctgatcaaattaaatttctgaactgttgtagttcttcgacatgacaaaaattgatgctatcaaagctttcgacatctacagaagaacaggacatctggtacgcgtaatcacagtgtgctttcattattctgtagagttgcatgcattttgattctctagaaatgtatatggagagctaatgagctttagaatatcaggcaaaaagcctgtccgacttctacgatctctgcaggggtttggaactcgccaggaatttccaatttccagtcctaagagaggcaattacctttatcttagcctatcattgttttgttttcactgagaattctaatgccaaatggacttctctgtactttcttcagccgccgtcatcatttcttggaacaatggaagagtacatcagagaagcccctagaactgctcctgttgcaaataagaccgtagtgagtcattaagctaatgtatttaatcccgaaacaaatcgaacagaagattgagtggcttgatgaaactgtacaggaatatcgacaacttgaattcattccaaacaaggaagaagaacctcctcaaccgttacctgaggtgttagaagaacctgttaaggaggagattttacctgaacctccagaagaaccccatcatcctgcagctgaggttgatgatgaacctgaacctaccacaaccgctgatttattggtaactcctggcaatatgacactgtattcatatcagctatttactgcaataaatggtagcagttgatccaatttatggtggactgcagggtttaaatgaagtgaaccctgctgccgcccagcttgaagagaacaatgcactggctctggccattgtatcaccaggtgattagcatgcatctgcctatactatctcccgattagataattcaagaatcactagtaattctcccaaatccatgcataatcacatccttttggattataacaggtagcaacacatctgctggtgcaggcagtggcttcggtggcatgcttggatcgtcaggttgggagctagcgttggtcactgaacccaccaacagcagcagcaaccaactactgacagagagcaagctggtaagtcaacaactctctattgcttatttcaagaactctctattgctcaatgccattcttttgatcatactgtgactgagagtcatttccaatttttgcactcaatgactcttgtaggctggagggttcgacaagctgctgcttgatagcttatacgatgatgcatcaaggaggcagcaaggagcccagatggatcatcctcgggatccgttcgccatgtcgacaagtgtcgcgccaccgaccaacgtgcagatgtcgatgatggcacagcagcagcaatatttccagcaggagcagcagcagcaaatggtgttagggatgccacagcaattctcagggtggcctcagtatgctggtgtttctcaggcgaatcctttcggtgatacgtattcaggtggtactctccatggaagcagcagcttgatctgaacatttttttttctgattaaaagtagagtagctttgatgtgataatctgagaactgccattaattcagcttgctcttgttagcaaaacgttgtatcttcttcagtcttcacagatctcacttgtgcacagtgcactggcaatttacaagactggaaaacagaaattcatttgttcatttctcaggacatgcttgtatattaccagttaacgatgacattagataaacgagtacagttcaaaggtaaatttgtattttgggtattacacgccgtggaggatgtccaaacatatatggacaagcattgcgcagctttgatagcatagtgccatcatgtagtagctggcgtatacccatcaggatatccccagctgtatcctgtattcagtgcaaacatcacatgaagtacatcgtttctgctagacactgtaacaaaggatccaaacaaaaaacgatcaatccaaagaaaaaaaaaaggaggggaacatcagacaagcgagtagtcgtacatatgtacatggacgtggcaacaaactctcgggtcattttcattctggtataacgagtcaaaaacattttcggccatgccattacacccaacgattctattcctagttcttataaagttctcctgtcatattggccccattatacctgaactcctgttaacccagccctcaccgtatctagtatgcatcgtcttcatcgtgctatttgttcgtcgctttgtgtgacaattagatattgatccaagcctcttcatagtactccaggccttaatcttcatggtattctgggttcttccttaggatcacaaaaccctcaagaactggtgtcagtggaagatatctgcacatagaaagagcataagcataagcataagcaaagatcaactgacaaattagaatattgtactccagatgttatagtttacttttcagttgccagctctgctcgctcccctgcagcaagtaatacaggcgttgaatgtgtctggaatccagtgattgtcttgggtctacctgcctgaccgacgacatcaactgcttggccaacacgtaccggaacagagaggggcttgagatcctcatccacagtcaatagcatcctaggctgttacagtagagagaactgagaatccatgtgactggtttagctatatgcccactaccaagatctttgaacgagatatatacctgcatagctagggtaaggatataaagcatgtaatggtacttccccagaatgatggatttcatgtcaagacaggcatgcagaaccgtcacaagaccagcaagtg

SEQ ID NO: 87266 - DNA, 955 bp, Oryza sativa
aaccaatcacaaccattctttttcacctactttctcttttcaaccaatcacacaccttcttcaatcattctcacatactttcttaatacccgtgccaacctaaaaaatgcttacattttgggacggaggaagtattgcatccccaaaagtgtcagtgtgtagatatcatggatgccatctgtaggcagaacaccatgagtggagtattgaaaagctgcagattctaatgttttttcttttatctggaatgtttttcttttatctggctacgtcttatgtaaacatgaactagaaaaaactatttatgtagcgtagtggattgtatagctcttgtgtaaccatccatctagttttggtgtctgttcagtgcccacaaactattctcgtatagttgtcttcttttttagtcgagctactctcagaaagtcagtcccctagaatgtacatgcttcaagagcagtgacatgaattgtatatgcctgctattgtaggatgacatgataattgaatagtagggaaaacctatgcatgttagttagataatacgttttttttttgatatagtcaggtgacattagttttggttctgtaggatcttatagactactacaactcttctacaataagagattgggcaggaagggccacgaccttccaagcaacagcagctattgcagatggtttggcaccaactctatacaactctgccccccaggttgccttgttctcttctcgaggaccggatgtaaaagattttagctttcaagatgctgatgttctaaagcctgatatactcgctcctggcaatcttatatgggcagcatgggcgcctaatggaactgatgaagccaattatgctggtaagctttgctgtacttttatatcccttgaagcatacaaagctttttaagcatgttatggttgcattgaaattttccttgcatgtttgattgtt

SEQ ID NO: 87267 - DNA, 2250 bp, Oryza sativa
tctaatacaaccaatattaatgccgctgactgggaaaagaaggtggatactttctggcaagaaaggctgagaggtcaggaccccatggtaatattagcagccaaggacaaaatcgatgcagcagctgtggaagttctggaaccttatgtcaggaagataagggatgaaaaatatggttggaaatatggctgtggagctaagggttgtacgaaacttttccatgctcctgagttcgttcacaagcatttgaggctgaagcatccagagcttgtgttagagttgacttccaaagtccgagaggatctctatttccaaaattacatgaagtatgtacatatgattttctgcctgtgctacttttttttaaggaggtgttactgatctggatgtttctttatgaacagtgatcctaatgcacctggtggaactccagttatgcaacagtctgcaccagtaagaacctcatactctattacttgcttaaataaaacagaacaattctacaagtgaattccatgcataattacataccagtatatcacatatgtgctatacacatgttacattataacttcgaataaaagttccctgcaaaaaagaacttcaaataaaatttgcttttgcttttatcccagctgcttcctgtaggttgtttctttttcatttgtcagtaaaccccagctcccttttaagaataatttgtatgcctgtgccttttggttactagtttgtgtacacatggaccatataccattccacccctttgttccttctacagatttttccttttaggtgctaagcctacattagatgaactatacggtatcagtcagacagtcacttatgtggcctaaccggtgacgtgagagttaaaggagggttggcttatttgagggaatgatcaggcctggacagaatcagtggaaggaatctgactaaagcttttagtgatgggtcaataccctactgaagaatttagctgacacttctctaagtatcattaatggataaatacattgagtgcaggtggaaactgcagttacatggattcattgaaatccttgacaaatatttatacttctgatttgcaggacaaatcaagacagagacctggtatggataatcgtctgagatatgaccgtgccaatcgtagagaatatgatagggcagagagagatggaagcagatatggtagaggtgatcgttctccaagtcttgatggcgctgatgatcagatgtttgatgctttccgtgggcgaggtccaaatgctccttttgttcctgaacttcccgctccgccaattttgatgcctattcctggtgctgggtaggtgctgtgagaagatatgatttcaatttttgttctgatagtataaaagactgctaatgagcgtggctggttttattttcagtcctttgggtccatttgttcctgcacctccagaaatagccatgcatatgctgagagagcaagggccgccacctccatttgaaccaaacggacctcctcatgccaacccaggagtgcttggaccaatgatgggtggtcctgcgccaattataaccatgcctccatcttttcgtcaagatcctcgccgtttgcgaaggttagtaattattcattcataccattgaattccatgatgtctattctcctattttgcttggattggcttgattatgccacattctgaccaacaatttggccacctagggcttgccaccaagccttacaccttgctttagtttgtatatgattacttctactcgagggcttaaccatactgtctttattatcatagaggcaaaaatagtatgttgatttactgtgccattgtactatattttacaaccggcaacttaacccatccatgatgacgattcttctgcagttacaatgaccttgatgctccggacgaggaagttaccgttcttgactacagaagtttgtagagcttgccctggtgtaattgtaatttgccaatcacaactctagcatctccggtctagtctaggttggtgatgtattctttttcagacataggggatgtcatgaacaatagagcattttttgaggtgtaatgcgtcagaaactactgttgtaatttcaaatggcaacatctgttattgaactgtgcaccacgtgcacttgtagtcccaagaagtgttgaacgcagtttgataaaatgtaatttttgagactttatatgacaacgttttagctgacaacattttacttctccattggaa

SEQ ID NO: 87268 - DNA, 628 bp, Oryza sativa
gcagtggtgcggttaacccaaaagccgccctggatcctggccttgttctggatgcaagtaagttaaatttttcgtatgcaattttttaataaattcaaactgctccatgttattcagacaataatctgaagaccattctaagtttgaatttttttttgttggtagctcatcaagattacatcacatttttgtgttcgatccccgacgtggaacacagtgaagtatcaaacataactggttcaacttgcagctccagctccaaggtgcagcagcgcccctatgatctcaacatcccctcaatcaccatctcccagcttagaggcacgcagacggtgaagcggacagttacaagcgtggccgccgaggccgaaacctacaccatcatgacaagaatgtcgccggagatcgcgctggaggtctcacctccagcgctgacagtgctccccggcgcatcgagagagataacggcgaccctcacggccaggtcagtgactggcacctacagttttggagagatcaccatgaaaggggaccgaggtcaccttgtgagaatcccagtggtagctatgggatttaagtagactaatgtaagtggctccaggtgagctagagctatgtctgcctctga

SEQ ID NO: 87269 - DNA, 692 bp, Oryza sativa
atgtcctgcttctttgtaataataacttgagaggttccgaagcatcccagctatacgggcattgtttgtaccagcccctatcaagcccagggagatgattgcagcctgcatgtaccagtttgatcaaattaaaatcaatgctcatagaaattaatatggtaggttttgctggtgaggttactaaccatagaaacttccgcatctgcatcatggctcagtctactcattgtgtccataacatttacctaattgacaggcaagtggtagaaatgtagacatcagaaaactagataagatatttatctagccaaatgatacaatctactaattttcctcgaataaccaggatcaaataatagtcatctgacaaagcacattctcaagagtattgaattgaaatagatgatgcagcagagtacaaaactaactgtcacggcatgctattaaatagttctttctcaacaattcaattgaatgattgtgtgcaacggcatgaagatagcacacatttaatgctactagtatacaaaaagaactgttacctttggattggatatgcaaagcaaacccagagctagaggaaccgcccttctaatattctgctcgccatactgtaaaagacgctcaagggaacgtacagccatttccgcccctaattcttcagccatggcaattagggagattccaagaac

SEQ ID NO: 87270 - DNA, 759 bp, Oryza sativa
ggaagattcatcaaaaacaaataggcgctaaaaaaatgtaatcctacaacctatgcacaattcttctgttaattgggaatcaccttaagcacgttccctgtcccagcatatgccagtgacatcaatgtcacgtcacaataattccttatcttctcatcaaaggttttagaaacctctgcagtcgcctccacactttcctgagaacagtagtcaagaatgagtataatagtatattaacataaaactggctaaaaacagacggtgtaggttcatgaagaggttgcatgttacatatgcaagacaattgacagtgcttaatccagagaaaaaagcaattaccaaaagaataaaattgtacttgggatgaatgaactaaaaatacatttgagccagttcaactacttgcatggtgcacgcgaaccaaggccaaaatagtccacgttagcgaatctgagcgttatgctgctgaatgcatgcataaatcttgtgatccagaaaagatagggatagttctcctatgccttttggaaattatcttgctaggggaatttgcagaagattgatagaagtgcctgatgttcctgataatgatgagcagaatgagtcaccatacataccaaattccagtttcctttatcctgattgatctccctcctcactgcgcaaatccctcatctcacaactcagtggcctggttgcactattggtgccgcactgcatgagtgggccccacgtgtcgcatgaaataattcaaagaga

SEQ ID NO: 87271 - DNA, 2718 bp, Oryza sativa
aagctctggttcactacgctccattaagacgcatatgattgtctgtgcaacctcttcattacaggaaccaacgaacaccaaacctaaggagatggcagagaagaccaagacctccagaggtacttgggagtcagtcagaaaagctgtgagattctctctaacctgaaatttttggaaaccatgttaatacaaaataacacatggttaatattttttaaccagtgggatagcaagaccaagaccaaggatttgacctcctctttctgggagccagcataagcaataccaagaccaaggattgctccaattcgtataattgactcatccctgctgaaatactcagaaatgagagcaaatgcctggagaagatgtcacaacatcagtacagagacttgtgcattagaagttttagaagatgtggagagaggtaaaagatggacataccggatcacagtcactcttcacaccacaagaaacaattccaatccctagcaaagccccagcaacaacatgaatatcattgctgtgcaggtacttgtcaagttgggcaagtcctgaatcagaatcccacagaagaatcattccctgaaaatgattgttttatcagcaccatgatcacataataacctaaatgccatgtatatggaaataaaccaagctgttgcagttgcactaccaggctagcggctgcactagctttcccatgttccttgttcttgaataaccagtttccagaagaaccactgcttgaagaatctgatggtgtggtcatgagtttatcctgcaacaagaatgttgagaaccttgcttgccctggaaacctttgatgaaattcgcataactaacctggccaaatccagcattcacgaatgcattgacaaatgttgccgccagattctgtcttgcggaatcaagactggagcttgtagcccctcggccatcaatcaaatgaacctaatgaattagcatgcattttttaatcattaatagcaggtccataaacaaagaaataagtagaaacatgaaatcagcagataacatttgggtaaaaaaaagttaaccttatatatgtcttctggagattttggctccatgacctcaatatctcgtgcaagtgtaaggtacccctcactcaatttaatattagaaattatgtcctgcaaagcctccttctcattttcatcagcagctatgtcatcatcaatctcgatgcttaaacccttcagcaaagagaaaaaaaaccattgaccacataagcaaagaggaaatgtgaacaatgcaggctaccaataatactgaattgtagacaagaacacaaacagaaattttgcttctgttgaatatttgtgtgcatgggatgaggctcacatggcgtgctatgataaacgcgaattgcttcttcagttgaaaatcatcagttgctgtaaaaatcggcttcaactccagggactacaaatcaatgaaatatttgtcagtgccctaatgtactggacagcaaataggacatgacaatattcattcacccaccttgtcataaagcagaagtgcaatacgcaaagcatttgcaaaatctccaaatttcatgtaaatctcaaaagctattttaagtgccgacatgtcatcaggagcaggaagatatctgcaagtttgcatcccaacacaaaagagtaaatgaagttcaattaagtaaaactagataatactaagctttaatcaagtgagaccaaattcagtggcatacttagaagaactagtgaggtacaagcaggtccttttgtagttcgtggagtcaacgtgcttaactagcaaatcaagcttttcgacctatgaagcaatttgatatcacacatcagttgtgaaccaatgaacaaataatgaaaactcttaatacaaagaacgaacaatttttcatatgtttaaaaatagaagtttcacttacctccattagaagatccacagcttcaggttcagcattatgctgcaatataaataataatcaatatcatcagtccatccattgatactagttgtttattggctactacctccatcccgcaatagttgtcgctttgacttttttctttcaatgtttgcccattcgttttatttgaaaaatttgtgtaaatatgaaaaaggataagtaatacttaaagtacttttgataataaagaaagtcacaaataaaataaatgataattttaaaaaattttgaataagacgaatgatcaaattttacaaacaaaaactcaaagcgacaagtaatatgggacggaggtagtaatatttaatgcattacacagagtgtaacaagacatctgtgatgaaataagaaaaacaaatgacacccatggactagactcagaattgaccttcatgtggaatgaaacgatttgctccaccagttccttcagggaatcagttggcatgccatcatcctgcaaagtggaaaaaaaaagttaggattataaaaatgaggtccacacacctaaactttgtgttgtcttagtccatgcacgtgtgataacataattgacagaagaaatcatgtgtgtggcttctaacagaacaaaaaaaaaattatatagcaatcatgctatctcaattcttgccaaataacaatcagtacggtatagatgtgggatacaaaagtcaaaagggtctcagggaagatcacttaaaacacttgttattgaaatcaacagcagctagacaagacat

SEQ ID NO: 87272 - DNA, 1187 bp, Oryza sativa
acactttgcaggaaaccgtccgacatagatccaactggaaaagatcctgatccggctgtgacagagccaaatttatccaaagacgctgagccgtctgccgaaaaccagccgactgccaaagccagccgactgccgaaagccagccgactggcgcccatgcttcggatgacaaagccgatccgagtgaccagccgccaactggagaccagtcggcaacagctgaaactgcaacaacacaagagcccccgactggaaaccagtcggatgtaggtcccgatgaagaaatccctgaagttgaagcgcaaacgacaacttcccaaggaccagaggctggtaaagactcaatgattgggtctctaaataaagaacaaggaccacctcatgttcagccaggaacatcctcaggtaacacatcttctcaagtgatgccgatttaaataacttcagcttactcgtctaatgtcttggaaatacatcaggaacactaggcgatgacgaagaaacaattcctcgcataaaggcggctgatgactcccgtcctcctatcttgctcaaatggtgggacgagaactcgcaagttgccggcattgttataaatcgtcaaaaagaagatgaggaagtgtgccagctgaagaaagcacttggagaagccactcgcattgtgaatgtaaatcttccgggtgactgcctttaataactttgttctctctttagcagaactgaaccatgatccatcatgcagagaatccatcttcgcaatgaggccaagactacaactttggaaaagctggttcctcatttgggaactcttgaagcagttagggaccaactgcatgaggccaaggagtatgctaaaaagacagagaaggagttaagggaccgaattgcccagctccaggattcaaacttcgagctaagtggttcatcaaaaggtaaccttccagatctattccattgatttatgctgtcataactgtatcctcaaatatttggatttcaaacagcacaagctaccaggatggcacaaatggagaaacagattgaagccttgaaaagagacaaagtagaactagctgtgcaaagggactcagccttgaaggaggttgaaggtactgccagctgacaatttgaactttcctctctttaatgcagcaaattcttattataaatgtgttttgtagaccgta

SEQ ID NO: 87273 - DNA, 3611 bp, Oryza sativa
gaccggctaaaacctatgccggcaaatgggtgcaacaactgccatcggtacttgggtctttgcgaactacacccagtcgggccacaggccagtcaccttttttccttgtctatggggcaaaggcaatgttgccgagtgaagtcgaatttgagtctttgcgctttcgtaatttccgtgaagaacgctacgaagaagaccgagtggatgacttgcaccgattggaagaagcccgcgaagcagctttgattcggtcggctcgatatttacaagggttgcggcgctatcataatcgcaatgttcgatctcgtgcctttttagtcggtgacctggttttgaggaaaattcaaactacacgagatcggcacaagttatctcctctatgggaagggccatttattatctctgaagtcacccggccaggttcttatcgactcaagcgcgaagacggtactcttgtcgacaactcttggaacattgaacatcttcgtcgtttctacgcttaagtttatcattgtacttccctatcttgactgtcaacatcaagttttcttcttgccgttgtcagtcgggggctatcatcataataatggagtgtgattttttatcaatttaatttgcttacttggtatatcattgccttgtttgattttttctacttagtctgcgaggactgaaagtttttaatagcttctttgggttttaggctcaacaaagcttgataaaagcttttaagaaatcaaagacttggctagaactatcaagcacagcataaatacaccagtattgtacaaattgagcctccatttgctacatttacactcagtcagaatcagtcctttcatcatcagagttattattgctcggctgaaggtcgttgttgcggaattgctctacaacatcacttgcaatcttgtcagccgcactttgagcattactgataagatcaagagcagcttcttcacttgtcccgtctgcaaagccatcaatggtatcaatttcaattctcgggtacaaggatttggtcattgccaatgccatgctagctcccatacttccagctttcttgatgttcttgaagtacacatccggtgcaactcttagcttgtcaaagatctcggttgcgtcaagtgcactcggaccactgttattaagaaacatagcttggacaagtggtgtagcgacattggtgacttcgtttcttgctccttcaagcttcttgatcttaccaaccaggacatcaaactgagcttgagatttgattttacggtctacaaaacacatttataataagaatctgctgcattaaagagaggacagttcaaattgtcagctggcagtaccttcaacctccttcaaggctgagtccctttccgcagccagttctaccttgtcttttttcaaggcttctatttgcttctccatctgagccattctggtggcttgcgctgtttgaaatccaaatgttcgaggatacagttatgacagcataaatcaatggaacagatctggaagattaccttttgatgaaccactcagctcgaagtttgaatcctggagctgagcaattcgctcccttaattctttctccgtcttttttgcgtgctccttggcctcgtgtagctggctcctaacggcttcaagagttcccaaatgagggaccagcttttctaaggttgcagtcttggcctcattgcgaagatggattctctgcacggtgattcatgggttagttttgctaacgagaaaacaaagtcatcaaaggcagtcacctagaagacttacattcacaatgcgagtggcttctccaagtactttcttcagctggcacacttcctcgtcttctttttggcgatttataacaatgccggaaacttgagagttctcgtcccaccatttgagtaagataggaggacgagagtcatcagctgcctttatgcggagaatttcttcttcgtcgccgcctagtggacctgatgtattcccaagacattagacgaacaagctggagttattcagaacggcatcacttgagaagatgagttacctgaggatgtgcctggctgagcgtgaggtgatccttgctctttatctggagacccaatcactgagtcattaccagcttctggtcctcgagaagttgtctgcgcttcagcttcaggagtctcttgatttagatctacatccgactggtttccagtcgggggctctctggttgttgcagtttcagttgttgccgactggtttccagtcggcggctggtcactcggattggccttgtcatccgaagcatgggcgccagtcggctgactttcggcagtcggctggctttcagcagtcggttcagcatccttggatatatttggttctgtcacagccggatcaggatcttttccggttggatctatgtcggatggtttcctgcaaagtgttctttcgatattcagcgtaatctctatgagagaagcatatcaaagggagatggtaccgagaagtttatacctggaagatgttctaatctttggcatttgacggccggccagttttttcctgggcatggtatgctttgggagtttgttgggcgtgcccttgtccccagatttgttgctgtcatcgccctcgtcgtcattaagcaccagctttctcttgcgaggacctgtctgaccagccggtttggaggtttgaggttgtgagtctgacctgattgtcggccctccacttccctgaatggtgtgctggcgaggagatcggcgctgagcaattgggggatcagatttcatcaatacgtattcctgaatgagatgcttccacagttagctaactcaacatgaagacaagatactattttggtcataagttgaagatttcagatacatacctgcggaggcggattgaatgcattatatggcacaactggcagctggtgtgagtagctaacgacaatggcatttgagaagattttatacattctctccttcatgattttgaaatccagagagtctggttcttcgcgattaggatcatgcttgccgtcaaactcaaaagctgtacgggatctttctttaattggcgctagtcggcatttgatgaaatgccgagtgatctgctctccttgcaagccttgttctttgagttttaacatgcgatccaacaattccaaggcttgggcagcttcatctccgattggaagagagttccaagtatcttggtacaccgggggaagacaagagtattcgggaagagcaggctcaggattctgaacataaaaccagttcgcatgccatcctttgtttgaagtcttgaagggcattgagaagtatttctggctcagagttcccctcagctgaaatccggcccctccgactacacatggcttactcttgtttggttggggtttgagaaagaagattcggcggaacagggcgaagtggggtttaattcctaagaaggcttcacagacatggatgaaattggcaatgtggactatggaattcgggtttaggtgatgcaagctgattccataaaagcttaatatcccgcggaagaatttcgaggtcggaagagcgaagccgccatagaagaaatgcgagaagactacgatctcatgtgtatca

SEQ ID NO: 87274 - DNA, 1003 bp, Oryza sativa
caaaagaagagggaattccgggcgctccatcagggcaacaggactgtgacagagtacctccacgagttcaatcgcctcgcgcgatatgcaccagaggatgtccgcaccgacgccgagaagcaggagaagttcatggcgggtttggatgatgagctgaccaaccaactgatatctggggactacgctgactttgagaggctggtcgacaaggcaatccgtcaggaggaccaacgcaacaagatggacaggaagaggaaggccgctcagttcagggcacatcagggaagtcaccagaggccgcgcttcactcccgggcagcagggtggacctaccaccatgatcgtccgccagcaccgcccgttcaaccctagcaacttccaccagggcaccagtggcagtcaaaactaccatggaagtcagcccaaccgcggtacagctccacgcccaccaatggcaccggcacagtcaggccagcccgcgcaagccaagaaggagacgggagcaaaaccagggtcctgcttcaattgtggcgagcttggccacttcgctgacaaatgcccgaagcccaggcgtgccgggccaaggtttatccaggctcgtgtcaaccacgcatctgcggaggaggcacaaacagcaccggaggtcgtactgggtacgttccctgttaactcaatccctgcaacagtactttttgattctggtgcaacgcattctttcatttcaaagaaatttgtggggaggtatgggttaaggaaagaagagcttagcacaccaatgagggttcataccccgggaaatagttcaacctcagtcagttttagcccctcagtgctaatagaaatccaaagatcaccatttctagccaacctcattcttctcgaatccaaagacctagatgtcattcttgggatggattggctgaccaagtttaagggagtcatcgattgtgcgagtcgcacagtcaccttgaccaacgagaaggaagaaacagtggtgtacaaat

SEQ ID NO: 87275 - DNA, 978 bp, Oryza sativa
tggtggttccgcctgcacggcttgcctattaatccgccgttgttgggcgtttaagtcttatgccgccgttgttgggcgttacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggccgccttgtccgccgccgactggtgtttccgcctgcacggctggcctattatgccgccgttgttgggcgtctacgtcttcaccgaccggcttgcctttgccgccgccgactggtgtttccgcctgcacggctggcctttatgccgccgttgttgggcgtctacgtcttcaccgaccggccgcctcgtccgccgccgactggtgcttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgttttcaccgaccggccgcctcgtccgcccccgaccggtgcttccgcctgcacggctgccctttatgccgccgttgttgggcgtctacgtcttcaccgaccggccgactcgtccgccgccgactggtggcttcgcctgcacgggtggcccttatgcccccgttgttgggcggttacgtcttcacc

SEQ ID NO: 87276 - DNA, 701 bp, Oryza sativa
ctaagattggcatgtaagaggcagtggaagtggtgcatggccatctccactgatggtgcatatcttcccacactgtaggctggtgattccaggccccgctgaactccttcgcaaagtgcaatgtcttccatctgcagatagagcgcacaatgttcagggaataaacttaaaatatcaacagcaactggcgaaattatcaccgtgcagtctctgctttgtttgtctggcttatgatattgcatgtctacaaaatatagtattgtagcatgcatctatgagatgtcaacatggctgatgtgtataaaagatgtagaagtcagcatataaacatcagacatagagagcaatcatgtttctgccttcagacatggctctaataagacaaaagcatgaagtgcatctgaaagcaacttaatcagggtaatgctgttagaagaccatggaatttacactgatgtagtgctgtgaacctgtagtcacaagtttaaagaatgtgtctgccttaatatgaacttggtcattactgccaacaatagattgaactaccttgcaaccaaacatcagttttatggtaatatacctgtacttgttcgctgtcttttaagctgctctcaataaaattctggtcgtcctgcatattcaatgtggattaagtcattgaccacaattacagcacacagcaacataccaaatcattactt

SEQ ID NO: 87277 - DNA, 586 bp, Oryza sativa
cctaggcagctttcagtatcagattctgcttatctaactgacgacactgaaattgtgggaaatgctagtgtaactagaagattgacacagtgggtactagaggagagacaagatcgatctgtcatgtccatcttcggcatgggtggggtaggcaaaacaactatagcaagcagtatatttaaaaaccaacaatttatgatggcctttgcttgcaatgcttggattactctatcccagagttatgaaattgaagacttgctaaggcaaatcagcaagcaattgatggaccaacaggtgtacttggctagtaatgtcgaggctatgaatcgaataaaattaattgaggaacttcagatctacctaaagcgcaggaaatatctaattgtcttggatgatgtatgggataaagatgtttgattattcttgaattatgcatttgtcagaaacaatcttggaggcagggtactgatcaccactcgcaaaaaggatgttgctttcttagcagatcacaattgtgtagttgagcttgaagctcttccccatactgaagcatggcatctattctgtaagaaggcgttccgtagat

SEQ ID NO: 87278 - DNA, 2499 bp, Oryza sativa
tccacccccactaatggcaccagctcagtcaggtccgccagctgtgtcagctcagtcagaacaacccaagaagggggctgtaggaaagccaggaccctgcttcaactgtggcaagcacggccactttgctggcaagtgtccgaagctgaatcgcactggacccaggttcatccaggcccgcgccaatcatgtgtctgcagaggaagcacaggcagcaccagaggtcgtgttgggcacgtttccagtgaactcatatccagcaacagttctctttgattcaggtgcctcgcattctttcatttccaaaagatttgctgggacacatggattatcggtagtggaacttaaaataccgatgcaggttcatacccctggaaatgatatgaggacagcacactactgcccctcggtgactatagagatcaaaagatcaccgtttctatccaacctcatccttctcgaatctaaagacctggatgtcattcttggaatggattggttgaccagaaacaagggagtgattgactgcgcaagccgcaccatcaccctaaccaacgacaaaggggagaagatcaccttccgttccccagcgtcgcagaagtccgtagcgagtctgaatcaggctgctattgagggtcagacagaaacagtggagaaaagttccaggaagttggaggatattcctatagtacaagagtatcctgaggtgttcccagaagacctcactacaatgccaccgaagagagaaatcgagttccggatcgatttggcacccgggactgctccaatttacaagaggccgtacagaatggcagctaatgagctagcagaggtcaagaagcaggttgacgaacagctgcagaaagggtacatccgaccgagtacttcaccttggggtgctccggttatctttgtggagaagaaagacaagaccaagaggatgtgcgtggattatcgcgcccttaatgaggtcacaatcaagaacaaatatccgttgccaagaattgatgacctgtttgatcagctaaaaggagctaaggtgttttccaagatagacctacgatcaggctatcatcagttgagaattcgggaagaggatattcccaagacagccttcaccactcggtatgggttgtttgagtgcacggttatgtcctttggactcaccaatgcaccggctttcttcatgaacttgatgaacaaagtgtttatggagtttcttgacaagtttgtcgtggtattcattgacgacatacttatttattcaaaatcagaagaggaacatgagcaacatcttcgtctggtacttgagaaattgaaggagcaccagttatatgccaagtttagcaagtgtgacttctggttatcggaggtcaaatttctgggtcacgtcatttctgctcaaggcgtggtagtggacccatcaaatgtggaatcagttacaaagtggaccccaccaaagacagtttctcagatccggagttttcttggacttgcgggctattaccgtcggttcatcgaaaatttctctaagattgccaggcccatgacacagttgctaaagaaagatgaaaaattcaaatggtcagctgagtgcaaccaaagttttgaagaactcaagaagaagttagtctctgcaccagttctaattctgccagatcagacaaaagacttccaggtctactgtgatgcatctcgccaaggattgggatgtgtgttgatgcaagaaggcagagtggttgcatatgcttcgcgacagttgcgtccacatgaggccaattatcccactcatgaccttgagttggcagcagtggttcatgctctgaaaatctggcggcactatcttattggcaaccgctgtgaagtttacactgatcataagagcctgaagtacatcttcacccagcccgacttaaatctccggcaacgaagatggctggagctgattaaagattatgacatggggatacactatcatccaggcaaagcaaatgtggtagcagatgctctgagcagaaagagctattgcaatgcagtatgtaccgaaggcatgtgtgacaaattgcagcaagatcttgagcacctaaatttgggcatcgtagaacacgggtacgtagctgccctagaggcccggcctacgtgtcacgtcctgataaattcatcccgaaataaaaatcattctctaaaaggaataatagaattaattaaaattcgaaaagaaattagcaaacactaaaatacgtacaagaaaaattcaaatgtagcccggagaatttttgttaaattctccttggtctaaaaagagccctcaaattttagtggaattttcagagcacaaataataattgagaagaaataaacaaagttgaaaaggtttataaaaagaaaaatctctaaaagtcttcttttccccccccttcctctcttgggccggatcggcccaactctccctccctctctctcctctccccggagcccataggccctctccccgcgcgc

SEQ ID NO: 87279 - DNA, 564 bp, Oryza sativa
tcagtcgggggctatcatcataataatggagtgtgattttttatcaatttaatttgcttacttggtctatcattgccttgtttgattttttctacttagtctgcgaggactgaaagtttttaatagcttctttgggttttaggctcaacaaagcttgataaaagcttttaagaaatcaaagacttggctagaactatcaagcacagcataaatacaccagtattgtacaaattgagcctccatttgctacatttactcagtcagaatcagtcctttcatcatcagagttattattgctcggctgaaggtcgttgttgcggaattgctctacaacatcacttgcaatcttgtcagccgcactttgagcattgctgataagatcaagagcagcttcctcgcttgtcccgtctgcaaagccatcaatggtatcaatttcaattctcgggtacaaggatttggtcattgccaatgccatactagctcccatacttccagctttcttgatgttcttgaagtacacatccggtgcaactctcagcttgtcaaagatctcggttgcgtcaa

SEQ ID NO: 87280 - DNA, 713 bp, Oryza sativa
tcaacccgcccataaccgcgggcacggctattcgaatagttttactctgatcagaggtgtaccactgtacccacaagacacagccccacatcatatcaccatgtccctcaataccaccacggtacctcgaaaaggagctgtgacaataccccttgcacaacacaatccaccatagcgcacctttcctggatcataatcacccccttataaaacaaggcatggactccccagcgacccccgtgggcttatctccgccacttctcagtctagtgctccgcaatgaaccatgttatacaaaaggtaaagccgttgcccacgctggcttgtggttggcatggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataataatgagtcataagtaatcccaatagtgtgctaatgtttctaagcatggtaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacag

SEQ ID NO: 87281 - DNA, 3864 bp, Oryza sativa
ggagaaaaatctgaaagattagcttgcgtttattttgccgaggagttaaaaaacacgttagaaaataaaatcacaaaagaaaacgaaatcgttgactgagaagacattgtttctcataacagttcagctaacacgtattgacaacaattggcctatagaactagctaaatttttctcactgtcctaaatgtaaaaacgaaatgtcattgggggaagaacataaatgaaaatagcccttggctaccatcaaaccatggaccgattgtttacacgcggtcatcactgataccagtaaaaaacgaaatgcctacctattcactctcaaggcagagcagcagctatattttgtgactttaggtgaaaacagtgacatcaatatgtatcgacagtgtgatggccatcaaatgaaactaataagcattgctgaattttattaaggcaataattcttaatattttaaaactataagttgatatttccacgaccatgtgacatcccggcctagagcttaataggatcactagaatactcatatcaacaagttgcaacttcttttcctaaagccgatctcaaaagaactccgaggttaagcatgcttggcctggagcaatttcatgcttaacctggagcaatttcgggataggtgacccaccgggaaattctttacgggtgcgtacgagtgaggacaaagtgtgcagaaaagggttgtgttggtctgtgagagcagtctatgacctatgaaagctgtcagatgtaagcggggagaggcgggacgttacaaagtggtaccagagccgactctcgtggtttcacgggcgcgtgtgtcgcagttacgcgggcccagcctgggagaggtgggacgttacaaagtggtatcagagccgactcttgcggtttcacgggcgcgtgtgtcgtagttacgcaggcatggtgcgcatggctggtgtggaccaggatggtcacacagcatggcacatgagctggcactggacacacggacgtggccaaaaggggacgttcctggcccggggtgaccgacgaggtcgtcgatgtcttaagggggtgaggatgtgacttcccggcggtgtcttaagggggtgaggatgtgacttctcggcctagggcttaatagaattactagaatactcatatcaaagccgatctcgaaagaactctgaggttaagcgtgcttagcctgaagcaatttcgggatgggtgaccgaaaggcttgtgttggtttgtgagggcaatctatgacctatgaaagctgccagatgtaaccgggctcagcctgggagaagcgggacgttacagaccatgcctttaaatttgaaaattatcaaacatcacaatggcgtttctctcccttctatatttgggcaccgtccccgagtataggaatcctggaccttctcaatttctattgacgagatgatccaggtcaataaacttttctctatgatggttgatctgaaaagaatggtctaacatgtgttcatatcgcctgcatcatcgtcctccgtgtcacgcctagaaattcactagtaatttacgaacttatttgtgcataaaatcctcgtccaggaatcagccgaggattttatatacaaatccattataataacatcgttacatacttacaaaagaatagaaaaacagcagcggaattaacggtctaacgatggcttaagctccactcccacaggcagctcaactggggtataagccaaacgtcttctccttctggatcattttcttcaactgaggttgattgattatttcaaagtgagcatatgacatactcaacaagccacacagctaatatgtaagtgtacaaggataccaaaggatggaataatataggctcatttgcaaaagtagcatttagcaaacatttaagagtagtaaaacagtagagttattaattatcaattttaatcaacactgcacaggcccaaccatcctgtacaaccatacccggttgtacagatctaactccaaaccaggagctaaacaaattattactagttatagcatcaataattattgtgataggtgtgagactaatcacgaaaaacattgctcaacccgctcatgaccgcgggcacggctattcgaatagttttactctggctagaggtgtaccactgtacccacaagacacagcaccacaacatgttaccatgcacctcaataccaccatgatacctcggaaaggaactgtggcaatacccctcgcacaacacaactcaccacagtgcattatacctggattataatcaccgaggcatggactccccagcgacccccacggatttctcgccacttttcagtctggcaccccataatgaactatgctatacaaaaggtaaagtcgttgcccacgctggcttgtggttggcacggttaatgtctcataacagtagctcgcgaactggtccttaattgttatgagcacgaccttcaaaaccatgtgctcacaacccaccattgtcaagttttaattatcaattaattatcataacacgattaaccatcgtgagctacattaaatatacccataaataataatgtagtatgatccattccattaatgagctaatgtttctaagcatggctaagcaattacatatatatagcttttagctgaaccaaaccaatatataaggttcaagctaatcaatttgttacccaaggaatcaaggaatatggtattcaatgcaaattggccataacaaatgaataggttcacaccacccggtgacattcgaaaataaatgcacagttgaaataaatagagaatttaaatataggatcaacatgctcaaaggattgtgtttgggatctgtgtgacttgccttgcaacaatcggtcttcaaatagtcttctaaaccacttctgacgcactcacggaccttcgcaacgacagaaacgacaagctaacacgcaaaacgaataaaaaggactaataaaaaccaaatgaacaatacataaaaagtaaaaaaaaaacatgtagatcatgattttagatgaatttagagacttgaacggcctcattccgagttcatatgaattagttacgaattttacaagattaaactgattttagccttataaaaaaaggattaatgatttattttagaaaagaaaagggctttatgacatcattgatgacgtcatcgccggaacaaggcacgggaccacactgtcgccggcgctagaggactcggccggaccaaccgagggcatctacgcgaagaggacgacgagacgaactcaccaaggggcggcacgacgacgaaggacgacctacgacgagctccgaacggcggcgaagtcgggacgacgaggacggcggctttccggcgacgagcagcggcaacgaaggggtggacgggcttctcctcggtgctgcgatgccgagggaggtggcggcacaggtcggggacgaccgaggcgacggcacggcgcggatggaggcgaagcagatcggcttgacggcgtcggcagcgctccggcgggcttcggcttcggccaagtggtggacggtgtgcagctccttctcgcgaacccgatggtggcgacggcgaccggagaaggcggctgcaaaggcggcgcggcttgaaactcggcggctacgacggcgctaggacagacgcgggtagggcgctacggccgacggcgagctcgggcgagggtggcaaacaaaagaggagagggaggggactttatttaaaaccacgggaaaaaaatcgggcgtggaacgcagggaatcgccccgggaaaacttagggtttggtggagagataaactcaaaaacgaatccaaattcgcgccgaattcaaagggataaaataggatttt

SEQ ID NO: 87282 - DNA, 613 bp, Oryza sativa
atcaaatctcaagctcagtttgacgtcctggttggtaagatcaagaagcttgaaggagcaagagacgaagtcgccaatgtcgctacaccactcgtccaagctatgtttcttaataacagtggtccgagtgcacttgacgcaaccgagatctttgacaagctaagagttgcaccggatgtgtacttcaagaacatcaagaaagctggaagtatgggagctagcatggcattggcaatgaccaaatccttgtacccgagaattgaaattgacaccattgatggctttgcagacgggacaagcgaggaggctgcccttgatcttatcagcaatgctcaaatgcggctgacaaaattgcaagtgacattgtagagcaattccgtaacaacgaccttcagccgagtagtaataactctgatgatgaaaggactgattctgactgagtatgaatgtagcaaatggaggctcaatttgtacaatactggtgtatttatgctgtgcttgatagttctagccaagtctttgatttcttaaaagtttttatcaaagctttgtgagcctaaaacccaaaggagctattaaaaactttcagtcctcgcagactaagtagaaaaaa

SEQ ID NO: 87283 - DNA, 591 bp, Oryza sativa
aatcttctctctaggaccatcgatccccacaagcttctctgcttccacatagagcactgggagtcgaggatcaatttgaatatggctaaatttttcagcaacttcatcaaaattatacctcgagcggcgataactttcttctataacacgagccttaagttcttcaattaggttcgcgattttgtggcgccaccgcgccaccataactttctaattttagctgccatcttccggacaaggcccgctttagcattagaactgctcaccttgtgcaggaaaaggtcgatgcagtcttcaatatcatagctaagctcacgcaccttgttcctccaatccttcacctgctcatccaacttctcctcgttgttcgccagcttcaccagcagggtatgcatgctgctcagctcatccttcagaaaggagatcccacctttcacgcctttgagaagcttgtactccccttgtatcaacagggagagcttaggaagcagggtgctcagggcaccagttgaaacactcactatagctccagccatgttgacctctttgtctaaccctagtcaagatgtggttcactagtaaatgagaggg

SEQ ID NO: 87284 - DNA, 650 bp, Oryza sativa
atgaaacgtggataatggcgttcgatggtgcactcaacagccaaggagcaggggcaggattcatcttgacatctccttccggagatcaattcaagcacgcaatccacctcaacttcagggcaaccaacaacacagccaagtacgaaggactactcgccgggataaagctgcagccgcacttggagtcaacgactgatcgtgaaaggggactccgaactagtcgcaaaccaggtgcacaaagattataaatgctctaaccctgagttatccaagtatctcgcagaagtcaggaagctggagaaaaggttcgatgggatcgaagtccgacacgtataccgcaaggacaacatcgagccaaacgatctatcacggcgcgcgtccagacgagaaccgctcgaacccggcacttttctggacgtcctgacaaaaccatcagtaaaagaggtcagcggcgacgttaacctagacgcccccgacatcagctcggaggccacagaggcagaacgcgtcgttgccgatattgaaaccacagacgattggcgcaccccactgatcaaattcatcaacagcgatgagttgcccgaggatgacgcataggctgagaaaataacccgtaaaacaaaaatctattgcataatcggcaacgatct

SEQ ID NO: 87285 - DNA, 792 bp, Oryza sativa
acgatgctcctgaatagtatcaacgtccttagtgatacttgcctctgtaaagcatcccactcgacttgcttgtttgaaatacagagccgacgaaacttcagagtaccaagtgcatcacctatggtctgtttctgcatctcgttaatggacaatccctcgtccttcgctacatgttgggcaaaagaccggacaacatcatgcatggtgcatcctagttgatcatagtacccatcacttgggtccaaaaggttccttaagactaactctttgtagtactgagctgctacagcctctggcaatcctgaacccgtgctatcttgcacgaacccttcagcgatccacattcggacaatggttcttgattcgatcacctcacctcgtgggaaaagtgagcagtacacaaagcattgcttcaaatgagaaggcaactctccatagctcaagcagaccactttgttaatttcatcattcacttcatgtttacaccatgcagaatgtctagaaacctccatccaggcacctcttgttctgctcttactaagtaagaggcccccaatcatcttaatcgcgagcggtaaaccatcacacctgtccacaatttgcatcccaatatcctccaactcatccaattcagcttcatcactcttgttcaaaactatctgttggaatagtaaaaagctatcttacttaaaaatgaagtgtatacctaataacatccattgaatataagctattctcaaatacagtaaacaacaacaaaaaaaaaaacctgcaacattcatttttacctaa

SEQ ID NO: 87286 - DNA, 1040 bp, Oryza sativa
cgacccgcggtgcgcgctcgcctcctccctcgccgcgcaccacgtcgccccgcgggaccccgcccgggccgccgccttcctcgccgccgccgccgacaacctcgtaagcgtcgtcgcccctcacgttgtcgctcgccgccttaattttttcccccctcctcgaatcctccatttactcggtgagcttgcgctttcgtgttgctctaaacttccaccagggtgcagcgacggagtacgagagggcggtgttccgcgcgctgtcggcgctgatcggggaggagagggacgagcaggtggcgatcgagcggcacttcgaggtttgggggtagcttgtctccattttttgtaaattgagagtatgtgctgctggataaattgattaatggcaagaattgattggtggtgtgtgctttacatgtggcagttgctgaaggaattccccagggatctcatgtctctaaagagagctcagctcatctgcttctacatgggacgccctgatacatcgctcaaatttgttgaacaggtaagttcactacaaaggctcgtgtatgtttatatgcttacaaagtggaaatatcgtatataactaatgaaaccgaagttgaatctaacactgtttgttattatttaaaggaacacccatggtagcaactttattgaatcatcacttcaaaactttggataaaaataaaatattttacaacagttgatcaaaaaagcatcacttttagtgctgggattttgtgtgcatgcgcgtgtgtgtggaatagaagaatgcaggattttctggatgtgcttcaaaacacttcctcttatcaatgtaccatagttctaggtactattcttttcattagctttgttgtactcattcttgatcaggttttgccagagaatcaagaccagaactacatttacggcatgcttgctttcccattactagaacttggaaggatggatgacgctgaaaaagctgctcggaaaggcttggccataaacaagaacgactgctggtcacagcataatgtatgcgggtggtt

SEQ ID NO: 87287 - DNA, 693 bp, Oryza sativa
tcctgcagcccagccttgagaagacagctcaagatgactaccaaaagcttgcatctgctgtatatcttcaagttagcaccatcagccaagctcttatctttgtcacaaggtctcgcagctggtcatttatcgaacgccctggctttctacttgtctttgctttcttcgttgcacagctggtatgctctctccctattaccgcaaactgataaattctttctgggtagaattgtgttaatctaactttcttccccttcaaatgcagatagctacattgatagctgtttatgctaactgggcattcacttcaatcaaaggcattggatggggctgggccggtatcgtgtggctctacaatctcgttttctacttcccgctcgatatcatcaagttcctcatccgatatgctctgagtgggaaagcatgggatcttgtcattgagcagagagtaatgctaatgcaccctgcatagttgtcttggctccttacctatttcgactgaatttccatgcatttgtgactaatggcccatcgatttcgacagattgcgtttacaaggaagaaggattttggcaaggaagagagggaactcaagtgggcacatgcacataggacactccatggcctgcagccaccggatgcgaagcccttcccagagaagaccggctacagtgagctgaatcagatggcgga

SEQ ID NO: 87288 - DNA, 654 bp, Oryza sativa
gaacttctctccattctcattaaacccaacccttcttattacttcatcaaactttaagtaccactgtctggaggcctgttttaatccataaatggatttctttagatggcaccccatttgttcttttccttccacaacaaaacccttgggttgtgccatgtaaacgttatcatatagatccccgttaagaaatgccatctttatatccattcaatgtagctctagatcataatgtgcaacaagtgccattacgatcctgaagatatctttacatggcaccagagaaaaggtctcattataatcgattccttctctttgagtaaacccttttgccacaagtcatgctttatatctttctacattccctttggagtcacattttgttttgtagacccatttgcagcctactgttttggctcctttaggaatttcttctaagtcccaaactttgttagtactcattgatctcatttcatctttcatggcttcaagccacttcgatgaatgagcacttctcatgacttcttcaaaagaggtgggatctccctctgtttgaacttctttactagcatagacttggtagtcactagtaatagttgtccttctctctctttcagatcttctgagttgtggtacttcatcgggctgcaggaa

SEQ ID NO: 87289 - DNA, 1258 bp, Oryza sativa
agccatgggacagggcaatcaagggagaatctctcaagctctttgaacccttctttctcaatcactattggattttcaggaatgaactccaagcctagtaccaggcgctgtaatttgatcaagcccgcgaggatcttgacatcatctgccacttgtttgcagaccgtgatctgcaagaaagtaagacggtcgagcctttcgatccattggggaacacgggaaaattttccagctattaccttaaatttctcaagattttcaggtggttctgttagagaaccgaggaactccatggaacaaccgagcccacaatgaatagtcatggacttaagctcccaccatccttctatggatgatcgtagggcttgttggtagtctttgtcactgcactggtgaaaggaccatgttattgtgaggacctccaactgcttcagatcaccaagagactgtactgattttacagagaattcacttaaatcgatagttgctagcgtctttagatatcttaattggtggatcgtctcgggtatctttgttagcactgtttggtcggaatcaatcattccagatccagctccagcagcaccaacaataagatttctcaaccactttatccgcacaatttgatctggcaactggcttattagtgtgcctcttaggtctagcgtctccagattaggtagccggcacactccagaggggagatcacttatcttggtgtggcttatatccaatctctctaggctagtcaattccttgactttctctggaagatgtcttatccatgtgcctcttaggtccagcatcttcaaatgctttagctcccacacttctgatgggatctcacttatggtggtgtggctgacgtccaatgtccccaggatgtgcagctccttgatctgaggtgggagcttgctgacccttgtgttcctgacgctcagatacctcagcataaacattttgcatatttgcagtaggtcctcatccttcaaattctcccagcttgaagatccaacaacaccagataggcaaacttgtctagagggactgttgttctgtcgactgcaccagatatgagtagtgaacgagtctgagacaaatccatttgctgcagcatagctggaagctgcggatcaggatggtggagagctagacggcgtgctatccgagtggtgttgccaccaccgctccgggctaaggtgagcgttgagctggtaaaaacaagacccatctctgctgctctggaggcaagaaacct

SEQ ID NO: 87290 - DNA, 670 bp, Oryza sativa
tcctgcagccctgatgttgatttactattggagacgaaaaaggttttgtcctcgaatttcgatatgaaagatcttggggaaccccatttgttctaggaatagagattcaccgggatagaaaaaaagggttttagaattatcgcaaaaggcgtatctggaaaaagttctaaataaatacagtatgcatgagagtaagcctacacctgctcccatagtcaagggcaatagatttgaaaaattttaatgtgatgaaaaagttgaaagtttgaagaaaaaatttcaaactaaactcggccttaatttaaattttaggggttcaaaaattccaaattgcgttcggtataaaatactattcatggtttattatctaataataacaaaaatacaaatcaaacaaatatttcaaataaaacacacgatcaaacttggaaaaaagaacttttgactatggttaagggccctttgaatcgcaggattggaaaaacgtaggaataggaaaaacgtaggattttgataagaatgtaagtgtaaaacagaggattgcaaaacgcatgaaaaacccaggaatgaccgtttgattgaaccgcaggaaaaacgcaggaattagatgggagagatagactcaaagaaaagttagcaagaggttgaagctcttgcttaatttcttcca

SEQ ID NO: 87291 - DNA, 728 bp, Oryza sativa
attcctgcagcccgtttaagttttcccaggagtctatttgtaaaataagttttcaaaaaggaccaaaatgtaaatatttcaggagaatttcatcactgtagttggtggtcactggctcacagcaatgccgggtaacaaggttcgacggttatccctacacagtagcaatccagagcatgcgaaggatgccatagaaagaatgaactcgtcacatgtacgatcgttgacagcattcgagagtttagaacaatttcagtcttttacattcaagtttgggatactgcaggtgttggatcttgaaggttgcaagggcttgactaccagccatctggacaaaatatgcaagatgtttcatttgaagttcttgagcctgcgcaaggcacacgtcaagaagctcccgtcagacattggaaagctgcagtatttggaaacgttggacataagggagaccaatgtgcaggagctgccaccatcagttgcagatctcaaacaaatggcacatctacttggtgggaattagagatggcaacgggtgcatacccatcgggttctcttgccccatacccacacccacgatgtctaaatactcccacttaaatacccacaccaatcgcgggtacaaaattgtccccatacccacacccatgcgggtaacgggtttccaacgggtacccatacccatataattgacttgtaatatttatagttttgtactataattagccata

SEQ ID NO: 87292 - DNA, 3284 bp, Oryza sativa
ataccagaccctgcaagttccgtaattcaaactgcatcctaaaaagaattagaaacaggcgagtagcttcagatcaagctcagctcaacagggaaaataatacaaatgaggatgaaattgttcagaaaattcccattggtaatcatgtgcccaagccaaactgacatagcgatacacggttatcccatagtctttcaaaggacaaagtaccatgcatacagatcacacgaccacagatttgttgacattttaaaaagatgataaaccaggctgataacatcagcttgtaccgtcggaatacaaacatgtatctgatatagagtatttcattattgtaactgaatgagatagtccaaaaaataagcttagataaagacaaaaatatcttttacttgagaatctgagcattgaatctgaggcagactgctaggattcagagatgaagctatcagatgattagtcaccatgcacaaatgcggcacgataaaaatacacacaagggtatagcaagagtttgaacttcagaaagtcaataagcaaagggagagcattttgagtggtttctatcagagcatgatcctaagctctaatccaatgtcttccgattccagttcaagggtagagagcattattccaaagaataaaaaaacaatgtataagatttgttcacatattatatgcatggtatgcgaaataaagtaacatcctagggtgaacagatactagtattagtaacaattcaaattaagcatacaaaattactatatccaagaaatggtattctcatgtgaaagaacagcaagcagttatatatcttcaagcagcaagaaatggtatagtttcatagttaccttcttggtcactatatctttttgttacaaaaaagaaagttgtagtgctgattcagttaaaatataacagggggtaaaaatgagggaaaacctaatatgagaaaaggaactagtttgcacaagagaagcaattaagatatagttacaacactattatactgtgccaattccaactgttataggtttatgtggatggtacctaaaacaaagtgtgtatcagactatcagcgaaccacattgaacgaatgatcttgaaaaattctggttgccataattgtttggcatttttttaacatactgaataagcacaagctagaacttaaaaaaatgctgcaagcgccagatgtgcaactccaggaaaaaatgatatcgattgattttttttctctttgaaaccaggtgttgattattaactcaatacgaaagctgcaaagcagcggactgcagcaattcttgaacttgttcgatagcacgagcaaacaaagaaaaacttataaacttgttgctggatttaaccactgaaatctgaataggatggccttggcgtttcttgcaaaggcacagtcttcacaattgcatttccacgactgcccagcataaacgacgcaataagtaggaaaagatttaagattcagagaagagaggagtgtgaatagcatcaaggctgaatctttgaaaccgatgaacacgatttacacgcgaatctgcagagcctagaaggccagagaatgtagcagcgggttagatctgtggctcgcgatcagacgatggtgcaggagtaaccggggtggtcgtcgacggcgacgtagtagggccggcacgccctgcagcacttcgtcagctcggcgcacttcttcttcttctccgagggcgtcacggcggtggcgccgttagtgagggcgatgggcggcggcggcggcggtggcggcggagtggatgcgctacgaccgggagcgagatggcggcgacgacgggaaagggagaagagaaggaaacctaaccctagatttggaagaggaggggagagggggaaaggcagcgtgctcaccggagagaaggtggcggccggaggagagagccgtgccgtcgccgtcgcgtcttcgttgcgccgcctcctcctctcgcggcttgtttggaaactccagggaggggactggattttacgcgagggaattaatgatgggattaaaatggggatttaatttttaatctcaatatcaatatcttgtttgtttggtaggggtgatggaaattgttagggagtttagttggagattagatcattaataaaaacggatagctgatatttgcttagacaaagtaaaggggaattccctcccaattaccttcccctgccaggtattgaaaaggagggagttccttccataattccccatcaccatcccactaaaatgcgcccaggtattaaaaaagagggagttcctttctcaattccccatcaccatcccaccaaaattaacatatctctcaaccaaacaaaacaattaatagcctcatccctctaaactctcaatccctcttaaaaactccatgcaaccaaacggtctgttgtagaaattttccacgccctacgaggagtagattctttcccgggcctagagaaagggaaacctcgtggtgggccaggctaaaatccacactagagcttaaccgaaggaaaaagtacatcgaatgtctctcaacttgtcattgagttaaaaaaaaccacaaaaccggatacaacacatcctccaacttacataaccagagcaaattagatcccttagcggtttttgactctatttttgtccgatgtggtagctaactctgcgtgggacccacgtgggccccacgtttcagcatattcttcctctcacctctcttccatctccacggtcggcgggtgcaagcgagtggtggaacagcgcgtgggcgggcgtcagcggcgggggaagtagctgcacgggggacggctggtgggcgcaagctgcaggggaggagctgcgtgcaggcggcgtgcgagcgggcgccggcagtggggaaagcagcggcacgggcggcgccgcttcgctgccttctccatcctcctcgagttcgtcctttctcgccctgcccttgcaccgacggccattctcgccttcgctgcctccagcgacatccccgtggcatagacatccggatggacacggtggctggaggccatctcgccgtagaagcggacgatgtcttctgtggcggcggaggcgggcggtagcggaacaacgcaaaggagatgggcagcaccagcgcaaaggagatgaggtgctcgtgtcgatgcatcgatgtggcacccgcagctcctcccctcgccgccggcgctccgctcctcccccccgggcagcgtcaccgccatcaccgttgccacgttggtgcctcgcactgggctgcaggaat

SEQ ID NO: 87293 - DNA, 1337 bp, Oryza sativa
cctgcagcccgagagtgacatatcaggtgatgttatgaaggttctcaggttgagttaccaacacttgcccatccacttgcaactatgcttcagcttctgcagcttattcccgaagaactggcgttttgatcccaggaggcttacagacatgtggatttcacagggttttgttcagaaggaggatgagtctgacaatgacatgaatgttgaagatgttgcgaagggctactttaatgatcttgtacaaagatcattcttcgagagatctttgttagaccttccaatagagtatgtcatgcatgacttgatcaatgaccttgccaggaatgtttcaaaggacgagtataccagaattgagagtgagaagcaaaaggagatcccaccaaacattcgccatttatctatatctgcacatttgtgggccggtatgaagaaaacagagatgaaaaacctgcgcacgttacttgtttggagcaaatcatggccttgctggaaattgtcccttccaaatgatgtgttcaagaaatccaaatacatccgagtgctagatttgactgttgttgcctggagaggttgccaacatcagtgaaaaatttgaagcatttgcgctatcttgcttttagggttcctgaaaaaccattgcccacagcattggtccaactttatcacctagaggttctagtcacaagaggtcactcttgtcggggaagtgaatgtttccaacttccaacaaacatgaagaagaacctactcaaattgagaaaagcttaccttttcaatgtagggggtgccacaatatctggttttggtggacaaactcttctgcatggcccaggggaattccatgtcaagaaggagagtgggcacagacttggagagttaaaggagatgaacaatatccgaggaagattaagtgttaggtttcttgagaacgtggaacatcagcaacaggctgttgatgcgcacctagattgtaaagagcacgtcaaacacttgcagctagagtggagtgaccttccaaggcctattacttctgagttggattctgatgtgcttgaggcccttcgacctcaccctgatcttgaccggctgaatatcacaggttacaagggactgaggtcacctacttggtttgagaccaattggatgaaagcactgacttctgtaatccttgagaattgcatgggttgggtgcaattgcctcctcttggacagcttcctctactggaggatcttgtactgaggaacatgcatgctgttgggcagataggtgaagaattctatgggaacggtgaaatgaagggctttccaaagttggaagaaatagtatttgatgg

SEQ ID NO: 87294 - DNA, 1168 bp, Oryza sativa
cagtatggcagtaccagataatggttgaaacaaattgcttaacaccaataattagcatagttctgaagaaactaattgtagctgtggtgattatagcttgtgtattgctatgcacatctaaggacgatgagcataaaacatatctcctatttctatgaaggaatcattctactattgatgtaaattatggaaacagcacagaaggtacgaaacaactcgtggcctacttagcaatccaaccctgcgctgttaagagacacggtgtccaagataatgctatcaggctacagcacataaaattgttaatactgttacatacctagatgaatcaattccttcgggagttgtgaagaactcaaatcgaagagaccattgcacagaaacttttgaagtggaaaatgacattggtccatcaattggaactgaaaagagaaagcttgtctggtgaagatccgcaacaacttcatagtgctcactgtgtacctttgcagagagtccagagaaaaatgagtgaatcattaaaatcaatttgctgattttacagtgtaaatgactaaatgttttttagaccaaaaggcaagcaaagtaaccctgcttcccgtcgaaagcaaacagtgtaagtacataaagacaaaaggtggtctttttggtgaaaaagaagctagcagaatacacaacatttgatattggcatgttactagaatgcactagatttatcaatagcaggtaaaagtctaagactcagaggtgcttatagattcttgatggccatgactaatattttgtgtttgagggcaattagcacatgccctttcctcgacaaataaaagtgttaagcacatccctactgttcgaatggcattgtccatcatgcttattgttccatagttactgtttgctgcaattgctgttcatgcacaggtagtttgtttttccaaaggttaggttattttttcttttggaagctttactactaatgtactccatgtgttttctaaagactatttctacatttcctaggtagagtcatcaccacagaagggcattgcaccttctttagtcgagcaaagatgagtaaacaagttcctaatccctaaagtcccattgtggtctcccttggccagtgattgtactcccgacactccttccccacggtaaaaagaaaaaa

SEQ ID NO: 87295 - DNA, 3151 bp, Oryza sativa
  unsure (1)..(3151): unsure at all n locations
aggtcctggtgccccggctgggcgcaacaggggcatcctcgggccttccccgcaggcccacaccgcctttgctccactccaggcgtcctccagcggctccaacacctccaccagcacntgggatgcagccggcctcatcgctgccctgcagaacatgcaactgcagggcaactcgccctaggtcgttgactccggcgcctctacgcacatgacgtcctcggatggtatgcttacccaacgccttcccccctccatctcctcaataacagtaggtaatggcactagtattcatgttacgtctagaggtcattccatccttcctacacctaccacaaatttcgctcttaataatattcttgtcgcaccatccatagtccgcaacctgttatccgttcaccaattcactcgcgacaatagttgttcctttgaatttgacgcccatggtttttctgttaaggatctcaggatgggacgcgtgattctccgctgtaactgcgacggggacctatacaccatgcctccctccacacctggcgccccacctcatgctctcctggctgcttcgtcgactctgtggcatcaacgtctcggtcatccagcccccgccgcattagagcgtcttaataaacttcatgctgtttcctgtcataaagtagaccactcgctatgtcactcatgtcagataggcaagcatacgcgtctacccttcagttcttcgcattccataactcatgcaccctttgaacttgttcactgtgatgtatggacttcccccatcaatagtctgtctggtttttcctattacctggtctgtttggattcactcactactgttgggtttttccgctccgaaaaaaatctgatgcccaccaacacttagttgagcttgctgcctttgccaaaacacaattcagcctccccgtcaaaagttttcaggctaataacggcactgaattcgtaaacaccgccaccatcaaattcctcgctgctcaaggtactcaccttcgcctctcctgcccctacacatcaccccaaaatggcaaggctgaacgcatcatccgcacactcaacaattccattcgtaccaagctcctccatgcctccctgccacccacatattgggccgaggggctcatgaccgcctgctacctccataataggcacccatcctcctccattcagcatgaaattccctacactcgtctgcacaaccagccgccaacctatagccatctgcgtgtttttgggtgcctctgttaccccaacatgcaagcaacctccaaacataagctcgcccctcgctccacggcatgcgtcttcctcggatatcccccctcgcacaaaggttaccgctgccttgacctatcgacccgtcgcatcatcatctctcgccacgttacatttgacgaaaccacctttcccttttcagccaccttagccgcctcaccctcctccgcttccctagacttcctcctcgacgacgatatggtttcggtgccttgtcctactgttgttgcaggtgggcttccatcctcgacgcccgtggtcgctccatcccactcggatgttgagcaaccgccctcagatgctgcggcctcacacggatcgccttcttcgacaccgggcaggcgcggtcccgtgcccccgcctggacccagcgtggtccccttcccacgagtctacgtccgccgctcccgtacggcgtctacgtccgagccggcaactgccccagcagcccctgtggctcctgacgccccggcgccacntacggcgcccacaccagcaccggcggcattccccgttccggcaccgccaccgccgccaccgccgcgcgccactcgcaccatgacgaactaccgcagtgccctggccgacgccaactggcgtgccgcgatgatggatgagtaccaggccctcgtcgacaacaacacctggcagctcgttccgcggccccctggagccaacgtcgtgacggggaagtggatcttccggcacaagtttcatgccgatgggtccctcgcccgccacaaggctcgctgggttgtccgcggcttctcccagcgcgagggcgtcgactacgacgagaccttcagcccggttgtcaaaccggccaccattcggtctgtactcaccatcgccgcgtcccgcgcctggcccattcaccagctggacgtgaagaacgcctttcttcacggccacctcgaggagaccgtctactgccagcagccgccaggattcatcgaccctggcgccccagagcatgtctgccgactgcagaagtccttgtatggactgaagcaggctccgcgggcctggtaccagcgcttcgccaccttcgtccggaagctcggcttcgtcgcctccacctccgacacgtcccttttcattttacgagaggggacgagtctcgcctacctactgctgtacgtcgacgacatcgttctcaccgcctcgtcctcggccctcctacagcgcatcatgactcggctgagctccgagttcgccatgacagaccttggcgctcttcaccacttcctcggcatcgctgtcacgcgctcctccgatggtctcttcctctcccagcgacagtacgccgtcgagcttctccagcgcgcgggcatggctgagtgtcatccgacatcgacacctgttgacactcacgccaagctatccgcgaccgacggggatctactgtcagaaaaggatgcatctgagtacaggagcttggcgggagctctccagtacctgacgctgactcgtcctgatctggcatacgctgttcagcaagtgtgcctcttcatgcacgccccacgcgagcctcaccgtgcgctcatcaagcgcatcctacgcttcgtccaggggactctctcctcgggtcttcacattggcaccgggtctgtcgacaaactgactgcctactctgatgctgactgggcaggatgcccagactctcgacgatccacctctggcttctgcgtctatctcggcgacactctggtttcctggtcttccaagcgccagaccacggtgtcccgctccagcgccgaggcagagtatcgggctgtggctcacgttgtggctgagtgctgctggcttcgacagttactccaggagctccacatccagctgccctccgccaccgttgtcttct

SEQ ID NO: 87296 - DNA, 639 bp, Oryza sativa
ccgagtattgtgtgcgtatgggatgcggagtcgaatttggaaggagtccaaatttgatatgagtggttatgtaaagtttatttcttgtacgagagggtttcctaaggtgtttaggacttctagtatgagtttggttcgtgcctttagactgcctacctcgggtataaatagagggggagcgtgagtcttcccggtatcgcttttgagagcaattgagttgatagttgagttagggtttcaagtttagtcgaaatttttgtaaggagcactatttgtgcactttgtaacaaagagagaatcaataaagtcatcatccactttaatagttcttcgatttgtgtttcaccgggtttcggtggtctaactggcgacacactagcggtcagactggcggcatcacagctgtcagaccggcgggtgaccttcggtcagacaagcgtcggcaacaagcaacaggagctgacctctgcggtcagaccggagatctaatcttggtcagaccgacggcaacctggcggtcagaccggcaggacaacttctgtcagaccgcgatccgtcgaattcgagggtacttttatttccgctaaaagtttccgggctttgggtataccaactattcatccctctctgggtggctta

SEQ ID NO: 87297 - DNA, 2414 bp, Oryza sativa
tgtcatgcgtgttggaactcatgaagcttaaggctagtaatggctggtcggacaagagttttacagaactccttgagttgttaaaggatctgttgccagaggggaacaatttacctcagacgacatatgaagcgaagcaagtattatgtccgttgggcctggaggtcagaagaattcatgcatgtccgaacgactgcattttgtattacaaggaatacactgacttggatgtctgccctatctgtggggcatcaagatacaaacgagcaaagagtgaaggtgaaggaagtaagtcaaagaggggaggcccagcaaaggtggtgtggtatctcccaattgcggagcgcatgaagagaatgtttgcgaacaaggaacaagctaagcttgtgcgctggcatgccgaagaacggaaagtcgatactatgctgaggcacctagcagattcagtccagtggaggacaatcgataggatttaccaggaattctcaaatgacccaagaaacatgcgtttcgcaatgtgtacggacggcattaatccttttggtgatttgagcagtcgtcacagtacatggccagttctgcttgttaactataacctttctccctggttgtgtttcaaaagaaagtacattatgcttgccatgctcattcaaggaccgagacaacctggcaacgatatcgatgtgttccttgaaccgataatcgatgacttcgaaaggctatggaatgagggcacacgaacataggacgcatatgcacaagagtatttcaacctccatgcgatgctgttttgtaccatcaacgattatccggcccttggcaacctttctggccaaactgtgaaagggaaatgggcgtgttcggagtgtatggaggaaacaagaagcaaatggttgaagcattcacacaagacggtctacatgggttacaggagatttctcccaaggtatcacccgtataggaatatgagaaagaatttcagtggacacagagatacagccggacccccgacagagctaacagggacagaggtgcacaacttagtgatgggaataaccaacgagtttggaaaaaagaggaaagttggaaagcgaaaagagaagagcacatcgaaggaaaaaacagaggagcatgtggaaaaacaaaagacaaaagagaggagcatgtggaaaaagaagtcaatattttggagactaccatactggaaggatcttgaagttcgccactgcatagatttaatgcatgtcgagaagaatgtatgcgagagtttaatgggattactgcttaacccaggtactacaaaggatggtctcaacgcccgacgagatctggaagatatgggtgttcggtcggagctacatcccataaccacggaatccggcagggtttaccttcctccagcctgctacactctctcaaaagaagagaagatcgatttgctaatatgtttgagtggtataaaggttccatctggttactcatcaagaatcagtaggctcgtttcactgcaagatcttaagttggttggaatgaagtcgcatgattgccacgttcttatcacacagctgttgcccgttgcaataaggaatattttgcctcctaaggtgcgacacacgatccagcggttgtgttccttcttccatgcaatcggccagaagatcattgatcccgagggactagatgaactacaggcagaacttgtgagaaccctatgtcatcttgagatgtactttcctccaactttctttgacataatggaacatcttccggtgcaccttgtgaggcaaacaaagtgctgtggtccagcattcatgacgcagatgtatccttgcgaaaggtacctagggatccttaagggttatgtacggaaccgttcacaccccgaggggagtatcatcgagagttacaccaccgaagaggccatcgaattttgtgtggactacatgtcagaaacatcttcaattggattaccacgatctcatcacgaagggaggcttgacggtgttggtactgttggaagaaagactattaggttggatcggaaggtgtacgataaagctcattttacggtactacagcatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgtctagtgaaacacttcagtggttgtcacagggtcctgaatggagtgccaccacctggcaaagatatgacataaatggatacacctttcacacggtaaagcaagacagcaaatgcacagtgcagaacagtgggttacgcatcgaggctgctagtgacggtggtcgtcgtgatcaatactatggtaaa

SEQ ID NO: 87298 - DNA, 2651 bp, Oryza sativa
acggaaagtctccaaggaagagagggacgctcgtttgaaggccgaacttaaggttgaggtcattcaagaactagaagctagcatgaatgcaagggtggaagaaagggttaacaaggtgctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattgttgttatccgatccatatctaataaaagacatttacacattccaatattaaattcaaactttcaccttatgcagggcgcagcacagtgtgtcctactagcgagagtccacccaactttcgctcctgaagtcgctgagggcatggctttcaacccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacgttcatacaatggcccaaagaagacatagttgtgaagatgactcctcgtccaagtcgaccgatggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaaggaccagaagcgtgaacgcggcaaggggaaggtcggggagttggcgccggagccaaaaaggggcaaggctgcgacgtcgatgccagtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttacgacagagcttcactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggcccatatgtggaaaagggtggtaggcacaaggagggcaagaacgaactttatcatgacaccaagtttgcatgcgcacaacagatcggagaccaatgtggtttccatgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacctatcaacccccctgctatcagaggcgaagtgtgcgcctttattcttgcagaaataatgaacaagaaaggacgttttcatgccaaatagactaatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctccttttttttcccttattgataggttgtggaggttcacaacgaacagaatacaagaaattttggtaatcatttgaggactttcatggggtatgaattgtgtgctataataaattaaattgttgcatatgtgatgttgtaaattgttgctttgtgatggatctgtgatatgtgatgcatctgtgatgttgggcagttggggaatatgtgatatggaggggggggtgactggcacctgtgatgtttctgtttttcagagggcatggctagcaattcctgaggctagccaatatttagcatttattttttttctggaattaactcatcagtgacggttcggaagaaacatccgtcacaggtaacctcacctgtgacggactcgcaaacgtcggaccctaacagctggccctcgtgtgccggccgcccaggggccgtcacaggtgggtcacc

SEQ ID NO: 87299 - DNA, 715 bp, Oryza sativa
catcctgtgtttacttgggtaagcgcgtagtaggtactgataagttccggaggaagctaaccgatatgttgaaaaaattggatgaggttaaaacaactgcggataccttgttcaaattggttagttttgatagtgctactgcaaagctgctcccagtcacacaggcacgtgtaacgtctcctttgaaggaagagaaccacatatatggtagaaaagatgatcttgataggctgagagatttgttgcttatgcaaagtgatagtagtgcacctggacctagtaactcatgtgttcctgttatatccatcattggtgttggtgggattgggaagacaagcctagcacaattagctttcagagatgaaaggatacgtgcgagctttggtctcaggatctgggtttgtgtatccgatatttatgatgagataacattggcaagggatattttagaatctgtaacaggtgaaaattatcgcagtgttactaaattggatgaattgaagaatgttcttcaagaaaagataagtcaaaagaacttttttcttgtattggatgatgtatggtatgatgagaacaggacaaattgggagaatgaattagttgggacggagttttatcaacattggatactggactcggaggatccaaaattctggtgacgactcgaaccaacaaagccagtgaactcctacgtgctggagccgggctgcaggaa

SEQ ID NO: 87300 - DNA, 707 bp, Oryza sativa
cgggtgaggtaacctctggttcccctaacattggtcactgtcgtgtgtatctattggtcgccaagtagcttggcgatcccaaagtcggtgatcttggggttgttcttgtcatccaacagtatgttgtcgggcttgatgtcacagtggatgataggagaggtgcacccttcgtgcaggtactcaatccccttggcaatgccaagtgcggcctcggtgcgccagctccatggtggacgtggagtctggaagaggatgcttcggagggaaccacccggcatgaactcgaataccagcatccgctgctcccgctccttgcagtatccaaccatgcggactaggttccggtggtggatccgcccgatggactgcacctcgttcaggaattccctctcgctgtactcgttggaggtgatgagcttcttcaccgcgatgtcaggtggttgcagtgacttggccatgccatggtagacctcgccgaagcctcccccttcccagcgacctttggaacccattggtggctcggtggagctcctttctggtgaaaaccctcacagtgtcatggttggtgatgttaattcttctgatgcgccagtgcaccagaaggatggtcgccgcggccgataggagaagcgccgagcatgcgaggatatgtacggcagcggcggcgctcttctccgagggctgctcgtccggaccttgatcagcgc

SEQ ID NO: 87301 - DNA, 3259 bp, Oryza sativa
ctttagcttttaggtgctgaaatgtgtacagtagcctgtcggcaagctaggcgcgacagtttcgatagcatgattgttgtgtgatgatcatcaccagtatgactagaaaacttcttcactgcactagcgtgtgctttactgctactctcttcgtagtttttcgtcactgtgcctgtggtgagtgtgaaacccagtgccatttgcatgttcacccaatgattcattcactccaggcctcgcgaattgattcaagaatactatgccacatgacatgtcctaccacaaagcagtgttttccctgttatttattgtgtactctacatgcacttttttatgtagtttatgcacctctattatgtcaccaaccaaaaaaatggtactccgtactcaattgttttttcttcagatgatgctactccaacactggaccactgatagcacataactgctctgattagccaaacattttttttgtcaatccttcattaactgattaactctataataatttcgtttgccatgctgagcagatcaaacaacaacatccaaaccaaaaccaaaccaaaacagttgtttttcacctgtataatataattataaccataataattacaatcattccaagaatgacacccacatcgtcgacacctactcgacgaactgcttgccttcgaaggtctgcgcgaacatccagtccggcggcgcgacgctgtaggcgacgaccgtgcggcccctcccgccggtgacctcgaacgacagcggctggccgcggaggtcggcgtctcactgtcagttctgggcccccttccttctcctttggagtcacccggggttttaaactttttactttaccggcggcaactttccgttcgccgccacgttttttaataaccaccttcaggaaactggggccgccggggatagtgaaactcatcccccctggcctgtcacagttcaccctgcaccaccaccactcattttgttcattcattagatggaacccgatatgagcaatgtgccgatgtgttctggggcggagctagagtattaaggtggcatgcccaggaacctggtcaaaaaaaaattatagctatacctaacctattttcaccgtgtgcaccattctcaatacaaatttagacatccgcattagcttaaacttaatataagacagagtaaattaaacaagtagcacccccctcaatctcactctagctccgccgcccatggatgtgtttgatgctttgattcacgcagagctgatcagtagttgcagctaaatttttggttctcttattggagttgtagtactatctagagttcatccatcaatggctaatgtcatgaaaacccaaattgcggtagtttgttataaaacttcatactgtttaatacgagtcgttaaaaaaagtgatgctttgactcatgcggaattcagcagattggcagtaagatttaaccttatcttgttagagttgtagtactactacagttctagaaaaatggaatacttggagtgtactcctgcatcagcagttggggcaatgggacacactcatggcaattgtctgaaactgtggaggtgctcataattaacaaagcacaagtcagatttaaaaagggggaagctagcagcagtgattaaagatttaaagctgctctttgctccatgcaaagcagcaggaaacacgcactgtccgcatattctgtgttccatctccaatgatcaaacatcattctgaactttcgcaaaagcagcactggttcagcctagagaaacacactccaaatgcactactcaagaatgatagcgccatgccctttttgcatggtcagaattcacacatcagctagttgcagaatgatacgctacaagtgatcaatgaccagcgagcaaatcatgaacatgatgtgtgcagtactaagagcaagtttaatagtagctcactactaactccaaattatttatagccaatgtaatagctaattcatacaatagttgcttactatactattaatacttggtcccatctgtcatacacatattacgtcttgaagtccgtgttgcagctagctacagatctatagcccactgctcttctctctcttcctttatctctttaaaatatgtttatagctggcttatagcctgctattgtacctgctctaagagcaagtttaatagtatagcccactactagctccaattcatctatagtcaatctaatagcagttgcttactatactattaatatatggtcccacatgtcatacacacactgcgtcttggagtccgtgttgcagctggctacagatctatagcccgctgctcttctctctcatcttttatctcattaaaatatatttatagctggctaatagtctgctattgtacctgctctaatactccctctgatagatgaagttccagaatacgggcaatcaaacttaaaactgcttggactactcaatcgtactaagatagtactctctccgtcctaaaatacagtaatctagtagtattagattagacacaacctagtactacaaatctgaacacaactaattgagtccaatctagtacttttttttgccgcgccggcttttccgaccaaacattgtaccaagaaggagaacattcagaacagtacagggaaaaaaaacaagagtcaaaactctcacaccaataggatcgataaacaacccatactagcagagccgaagctaacacacactagatctaatctagtattagcttgctatattttgagacgaagcaagtagtgaatttgtcctaaaaatgtatatctccatgtcgctctactcgtttcacttcactaacatataactataagtaacaaaaacatgtattggagactatggtgatgtaaaagaaaagtgtgggagaagcttattgttttacctccggaactgcaccggcacaatgtcggccttggccttggcgacgcggaggaacgcggcctccgacatctcgaagtgctccttggggaagttgcaccagccgccgtagtcgtcggagagtccgaggttgggcgcgcagaagtcggtggccgtcaccaccaccgtcgggctgccgcggaggcaccacagcacgtggttcacgcaccgcacctcgtagcagccgccgcagcgctgccgcgcccgaacagcgcgccgctcacgccggcggtgtacctcccgtacctgaagatgtccaggtcgccgtacccacaggctccaccaccttgcatttgcaggt

SEQ ID NO: 87302 - DNA, 1963 bp, Oryza sativa
tgcgtatacttgtaatcttattccacctatctatgaatttcaagtttagactcatactgcaaaagttggaatgactttggtactttggttctagatattccttattcatatctaatacattgatgcaggtacatgttcagtcagatcctgctggccgtttgatagttactggagagcctgagcaactagacaatccttggggtgttactccattcaagaaggtctgtcaagtgttaaccttttgaatttatttgatgtttcattttataattgtattctttggcattgaaaacggtacacttacttcaggttattagtttgccctcccgcattgatcctcatcaaacttcggcagttgtcactctccatggacagctatttgtccgtgcaccattcgagcagtcaaagtaaatggtgctctacaagatgaagcgcaacatgcaagtatgcccttgttccctaaagatgcgctgcaaacttacgtgttctgaagttgtcgtctgtatgaaagtaatgaaaatgaaagcatgttagtgaactggtaaaattttaagatgggcgcagaggatgttagtgaactgtaaatcttgtgtagtcgtttagatagtttcttgtggttgaatgccattgaactgttgtaatctgtttgtttcctgagtcataaatggtagaactcaacattgttgttgctggacagtagtaagtcgcaatgggtttatgatttgcattctttagtgttattttcgagttaaattaagcacatgttttgagactaggacacacctgaactaatccacttcctttcttgcagggttgcttttgtaggtgggggtttatgtgattgacttgggcctgttcatcctgatcttcgttgcaaactagttactttctgcttcattactcctgccatgttgtctattctgtattgattaattctagttaactagatggtctagttatgtatcttgtagttcgttaattgtgatatgtagcttaagttcagctctattagtttagaatgttaatagcctgatgctaaacatgttcatggtttctttcttccttttttttttctcaactaaagaaaaggtgataatttgtagcatgtagcttgtgaggttattcctaatactcagttctcatactactcagaacatgaagacaagatagattcttggatgtaactgttgccttgtgcattgctgttgtatctgtataactgaattgacaactgtgcctgaccatcccttgaaactattactgatggtgtatcaattgtttttagtgttatcttgaaacgagtcttagttctaattggctaactacgtgaagtgaaatatcacagcgttgtcaagtcagttaaaagatgagaacaatgctgttctctcttttcttggggattggccttggtgcttgcagaggattcagaacctcgttgctttactagtactacattgcttataatatatcttcaaaattattgcagaaattttgtttcattattgtgttattcatgccagtgatagcaaatgaaattaccctttcagggctcttcttgtcctatcagtctatcacaatacaagagctactatttaactacaaggtgctgaatgtactagcaaacgacaaacacaaaaccatggtacaaatatatgatgttgaaaacaatcttaagaaattctgcaattgcaacgtagaacacgaggtacacggttcgttattcacccatgatacgctgataggcactacgtactgacagagacagacaccaccagaatcacacacaaactttaaacttgttacgtggagcaactttgtttagccactatgcttacgtacggcttgattagatttagatcacgtgacaatttcgcataattacgagatggatattattttggtcatcctcatggctccccttttggttttgtgacgccgctgctgccgtggttgccaccggttg

SEQ ID NO: 87303 - DNA, 1107 bp, Oryza sativa
ttatgtcagcttaaaagcatttccactaaagatctgtaattgtctccttgcttcatccagatgttttgcacagcatcaggactaagacaaagttatcatggactaacaaaatcaatcaagtagatgtgttgctttaacatctattaattactttcagtaaagcacatttgcagagttccattttggcatttggtccaaaatatcattcacttgctgggcataaaaagacgaaccatgcttggggagatagtcgatcaatagaaacaagatcttgagcaaggtaacttagccgcatttcctcattcaaatgctgcaaaagagaaacaaagctggtgaaatttgaggcaaaaggtgggaataaagtactctcaagtacaagagcagttagtccacttacataaagaacagtggagtaaatgtccattccctccaacgtgcatggtgatagtcgatgcgctaactcaaaaaaatgatcggcttctaaataattgacgagttcaaaatatgtcttcccaacctgcaccgttgaccaaaatgaaaacaatttttaattgtgaaaaggaacaaaattacagggtactgttaatatctgtacagtgaaaaaaatattatggcgtgactttttattattaagttgagtatatagaagtggaaatgaaataccagatgtagagtggctcatgtgcaagtaaacatggttatgctgagtgactggaaattccaacaatcagcattcagggccaatgttcaactacagttcaagttatcattttactaatgtcaattctccagattgacccaactaacatatatacaattaccataatgaattcatcacattatcacgtatcagattaatttaaataaactcgtagtttcttttagaaaacgaaggaaacaaatatgctatacattacgatacagaccctgaatcattactatacagtccctatgcctcatgccctcatgaataacgtagatacactcatacaaaaccagttttccaaaagttagccctaggagcagagtaaccaccccaattaggcattagattgtcaattaggcggcaaactatccatgaaggttctggtgtagctattttagtgt

SEQ ID NO: 87304 - DNA, 2129 bp, Oryza sativa
caccaagataagttctttaaaataatatgtagtgcaggaaacaaaatgggggtggagggaggcaggtggagctttgggagtgggataagcaaagatagtgtactataccttgattatagcaacgtcagcagcaggaggtttcaaatccagggcaatgccaaagcaaaatacagccttgtcaagaatgttaagttgcttgtaaatctttcccatcagtgcatacatactactttcatgaggtgcaatttcctttagccgttccaactcatccagagcatcagggtatttttgtaggcctagaaggattaaagccttttgatacttggggagtggattcttcttatcagcaaatatagcgttctccatcatttccaaggcttcctcattcctctgaaagtttcgattcagaaagaaggttcatagttaatcattgtccagatgatgatgaaaattctagttttgagggtaagtggaaaccaaaaattagtatatggtactccctccgtttcgaaatgtttgacgccgttgactttatagcacatgtttgatcgttcgtcttattcaaaaaatttaagtaattattaattctttgcctatcatttgattcattgctaaatatatttttatgtaggcatacaattttacatatttcacaaaatttttttaataagacgaacggtcaaatatgtgctaaaaagtcaacggtgtcaaacattttgaaacggagggagtatcttgcaacgtggactactggagtgtgtggatttagctgctttagctttaacaattcgagtaggactatgtttgggcagaccaaatattacttttttcatgtgttcaatcttcttttgtatatgactttaattgtttggcagttattgagatgaagctagatagtgagtaaactgaatccgatacttgtttgctgtaataagagtcttttcagttttctcatcgctgatagcgtgtagttttgttctcttagttcgtatatgaccaggatcacatgttgtactaaatgtatactactcatgtgcacagacaaatgtccagttgctagcgacttgctaccttcacaacaaccagccatatgctgcataccacatcttgaaaggtaataacatatgctcaccacgtgaccacttattattgtgtagaagtgaaatcacattatttaaaaatcaaagaaatgtgaatatagtatctgtccatctttttgggcacatttctatcctgttttgtgatttcagtatattttattctgtggtcgcaaagtgctttggtctttggagcgatttctgatttttatttctgatataacataaaggaaagaagctgccagagtcccggtacttgtttgctatgtcatgcttccgaatgaacctcttacgggaagctgaagaagccttgtgtcctgtcaatgaaccaaatattgaggtatatagcatgtttttaaacattatttgttcattgtgttcctgaaatatatttcatccaacgctcttaattttttcgtaagtgcttgaactcaagttttgttctggacaaggggtcgcatgatgtatcatttgttccatggtgtcttctggattccaaatcagaagtagaaaatgggatgtgcagcatgtttgattattcatgaattaagagttccaaaactggtgatataccatttgaaaacattaagattggttgcctgtcaatgaaatcgtatcaacaatgttatcaatgtgaaaacaagaagtgtatcatgtcttaaaagaaaatatgcatgtatgattaagtgatgtacacgagaaacattgtcactacaagttgatgttttgcttgcatagaaacgtctgcagacatcttttttttctttgggtgcatgacagcattttgaggttgtccactaactgtttgattccacacgggtgaagtaatgatgtggaaaaaaaatcagtttgcatctttgcttactgttatacttcctcccttttttgcaaggcttcttcaatacttttccaaaatataaggatgcatgtgagtttattgcttttattccttgtttaccctcatttttgacataatacctcttaaattaatgcgaatgaactcactaaccatcagctctatatttcgaattt

SEQ ID NO: 87305 - DNA, 1246 bp, Oryza sativa
cctgcagccccacgctgctcgcgcgtgcgagagtcgccccgagcgcctctctccccgcttcccctccgtcctgcccgcgcgccgcgcgcgcgtgcgcgggagtcgcccgcgctgagcgcccctcccctcgcgcgagctccccgctcgcaaagccgcttcccgcgcgccgtgttcgcgggcgcgcgcccgcgcggacgccgcccgttgtttcccgcgcgcgcgcgccgagtggccgaccgcccagtcgccgccgtcgtcagcgcctgccgcgcctgtcgcccgtgtcgtcgcgccgctccaaaccatctcaccgtcatcgccgtcgtcatcccccggccccgccactccgcgcgcaagccgccaagaggcggaggccgagctctcccttccctctgccgcgtcgccccgccccctcctccttttcccgaatcggcaaaggggcgagccccctttctctccctccttttcttctttttctcccctttttcccttctcgccggcgtcatcctcttgtcgccgttttggccgctagccggagcgccagctcgcgcccttgaccgcgcaagtcgattcccaaactgacattgccgccccctataaaccccagcctcccctttcccctcctctcccattcgcctccgcgccattgccgccgctcccgtgctctgcctcgcctccgccgtccatcgccaagcgccgggagagccggtgcgttcgtggacgcggaaggggactccgggcgcgccctcttcaccctctttgtcacgtcctgataaattcatcccaaaataaaaatcattttctaaaaggaataatagaattaattaaaatacgaaaagaaattggcaaacactaaaatacgtgcaagaaaaattcaaatgtggcccggagaatttttgttaaattctccttggtctaaatggagctctcaaattttacttgaattttcagagcaccggaaataattattaagcaacaaaaacaattaacaaagtttattaaaaagaaaatctaaaaataatcctccttttcttttgggccaattttggcccaaagtcctccctctctcccctcggcccgcggccgaagtctccctttcctccctctctttctctccctctccttctctccctctccttctctccctccttctcttgggctccccttcccctcggcccagctccctcctccctctctcccgggctgcctctttcccccccccctcccctcccggcctgcccggccc

SEQ ID NO: 87306 - DNA, 2766 bp, Oryza sativa
cacagtaatgtccttcggactcaccaatgctccagcattcttcatgaacttaatgaacaaaatctttatggaatacctggaccagtttgtcgtggtattcatcgatgacatcctgatatactccaaaaatgaggaagaacatgctgaacacctgaggctgataatggaaaagctcagagatcatcaactattcgctaaattcacgaaatgcgaattctggttagaccgagtagcatttcttggacacgtgatctcctccaacggtgtcgaagtagatcccagcaaggttgaagctgtacttgcttggaacccgcccaagaatgtgtcagagattcgcagcttccttggcttagctggatattatcgaagattcattgaaggattctctaagctagccagacctatgaccgaactgttaaagaaggaaaagaaatttcaatggtctacagcctgtgaagacagctttcaagaaatgaagaaaaagttgaccactgccccagttctcaccttgccagatatccgaaaagatttcgagatcttctgtgacgcatcaagacaaggcttaggatgtgtcctaatgcaagaacgaaaggttgtggcctatgcattcaggcagctcaagcctcatgaagtcaattatcccacccatgatctcgagtggcagccgtggttcatgctcttaagatctggaggcactatttaatcgggaacagatgtgaagtatacccgatcacaaaagttttaagtatatcttcactcagaccgagttaaatatgagacagagaagatggttggaactaatcaaggattacgatcttggaatccactatcatcctggtaaagccaacgtggtcgctgatgcactaagtcgcaaggcctattgcaatgtagctcaaatacggcctgaccaagatcacctgtgcagagaattggagaagttaaggctgaccgtggtacagtcaggagtccatgccagcttgacagtacagcctaccctagaatcgcaaatccgggaggcacagaaagacgacgaagggataaaagagttaataaaaagaatacaggagaagaaagacaccaatttctccatagacgatcaaggcacagtttggtgcggtccacgcatctgtgtaccggccaagaaggagttaagagatctcatcctaaaggaagctcatgagtccgcttactccattcatccaggaagtacgaagatgtaccaagatatcaaggcatacttctggtgggctggaataaagcgagatgtcgcagaatacgtagccttgtgtgacatttgccaaagagtcaaggcagagcatcagaggccagctggtctgctgcaacccctaccgattcccgagtggaaatgggaagagatcggaatggatttcatcaccggtttgccaagaacccccagcgggtacgactccatttgggtaatcgtggaccgactcacgaaatcagctcatttcgtgccagtaaaaaccacctatgatggaaagaaactagcagaactctacatgacccatatcgtatgtagatttggctgtcccaagaaaattgtgtcagaccgaggcactcagttcacctcaaggttctggaagcagttgcatgaagccctcggaactgatctgaattttagtacggcctaccatccacagaccgatggtcagacagaaagggtaaaccaaatcctagaagacatgctgcgtgcgtgtgccttggatttcgaaggcacttgggatcgttgtttgccgtatgctgagttctcatacaacaacagttatcaggccagcattcagatgtcgccgaatgaggcaatgttcggaagaaagtgccgcacccccttgtgctggaatgaggtgggcgaagccctggtattcggtcctgacatactcaagtcagcagaagaacaagttaagctgatccgagaacgtctgaagacagcgcagaaccgccaaaagaattacgctgacaatcggagacgtgaccttgagttcgaaaagggagatcatgtgtacctgcgggtatcaccactccgaggtatgagaaggtttgggatgtccggcaagttagcaccccgctacatcggcccctacctcataaccgccagacgtggcgaagtggcttatcagcttgagctacctgaaggtctcgcaaatgtgcacaacgtgttccacgtatcccagctaaagaaatgtcttcgagttccagaagagcaagtccccttgggtaacatcgagctgaaaaagaatctgacctacaaggaaagaccgatcaaggttcttgaagaggcagaacgtcagactcgaaggaagaccatcaagttctacaaagtccaatggagcaatcattccgaagatgaggcaacatgggaacgagaagatcttctccgcgccgagtttccggagctgctcccttaggtgctgaatctcggggtcgagattcttgttagggggggttggtctgtagcgcccgttccgtcgtggtgcctagcgggaaaataatctccgaaaaaccctaattgcgaaatttgtttctttgattgttgtctagtgtccgtgccatctcaagatctcaatccccgatctatcgtcgagttcaattccgaatccaaatccttccaatcaaattcctccgcaaaagtctattttgcctcccccgaggtcgatgggccgaatctcgctcggcccatctctctctcccccggccctctctcccgggcgctctctctctctctctctctctccccccggcgcgctcctc

SEQ ID NO: 87307 - DNA, 2908 bp, Oryza sativa
acaccttggcatactcagctagcaggtctgcgccggggaccttgtctgtaaccgagggcttgaaagccatgccctcagcgacttcaggagcgaaagttgggtggactctcgctagtaggacacactgtgctgcgccctgcataaggtgaaagtttgaatttaatattggaatgtgtaaatgtcttttattagatatggatcggataacaacaattacctcgatgtggtccactgcagctagtggtgcgatcgggagaccaggggccggcacctctgtggatgcacaactactcctatgctgtgacggactcgcgtcgtgttgtacactcctattcatgtcggcgaggaccttgttaaccctttcttccacccttgcattcatgctagcttctagttcttgaatgacctcaaccttaagttcggccttcaaacgagcgtccctctcttccttggagactttccatttcctgtattgggagctgtactgagggagtccatgcttccagggcacatcgctaccaattccccgagttcggccaggatgttctttggttccgagcgcctttgtgaggatgtcatcttcgcgcctcttcggcgcggactcaacctcgctttgtgaagcttgttcagcaaccaagcccaactagaaaagaagatagtcgtttatacgaacttgtactttatacgaacggaaattagttaggttaagtagtgaactcaccagttcctgatagacgacggcatcacttttgttctcaaatgtgacagagccgtccgggttgaccttaccccttgcccgcgcccagttgcgagctatttgttcagggatgtctgaaaacagggcagggacattcgctgctgtagcggctgcatcttcttgggcccatattgcctccttgccgatgtaccctgcggtgcccagccgatgcgggtgctcattccgctgttgcagtacgcgatgtgcctcgcttgattccctaaactcttgggtggtcttgagagagcagaattcctcccacaccgcttcggttatttgagggtattcatcgaacgacgtatgattgccgggcgggttgacaaactcggtgaagagcttcgacttccaattcttccaagctttgcccatcttttggaatgccttccgcttgagcctatcctttgcttcggctggaaatgtgaaccatttctccattgccgtccaagctcgctctttctcggcttctgtgaccttcctgatatctttatggaggatcccgaagttctcacgtgccgctagcccgcagcagttagaccatcttccaatgacagtcctgggcgccgtgggcctaccactagcgtcaacctctcttataacttgcactgtggtcggccatatattttgtgaccgcggatttctactagacctacttgcacttgtccctcccgacatcgacgtatgttgttcctgctgcaattctgcagcacaaacagaaggcaatatttgctaaggggtgctagctaaaatttatgtggtcatgtggtgaaaatttatcctataaattaccatgaatttcgggttgttggtttgccgttgtcgcgggatgaccttcggcaactgcctctgtggctgggtttgcttcttcctggatcctcgcaggtgttggggagggcgggtttgcgccgggcgttgacatggtttaactttcgcgaaaaagattataaatttcctaccattagactaaatagcattagatccaatgtaatacggggtatactatgaaagatatggcctcagttttgctgagaaatatgcatcaattacaatcatttgcatgaagggataaaaagaggaaatcataacatcaaaagagcaagtgcagaaaatctgttcttatgcataaaaaaagaacaagtgtagaggtatataaccactgaatcaatcatgcaaatttaaaaaacagcagcagcaagggtacagaatttgcatgattgacataaaacagcagtaggaggagtatatatgccacaggggtagcaacagcaggggcaaataacttaaaccaccttgtctaaatttactcctttaatcattccaaaagaaaagagcaagtgcagaaatctgttcttatgcataaaaaagaccaggtggcccaaattctggtcttatgcataaaaaaagaaacaagtgtagaggtatataaccactctacactggccatttaataaggaacaagtgaacaagtgtaggggaaaaaaatgaacaagtgtagataatctgttcttattgagcaattcatcactagccatttaataaggaacacattgggcagcagcagcaagggtatataaatcatcaaagaatgacagaaaacaaaatgcatggagaactttggtgtctaggtcggttccgtccatggactacactgacctatcctttttcagctaaatgtaaacatgatccacaaaattcaataggtctagcaacatatatagcagtacacactccatgaatggttatatgtccaaatggcacttaaatccacattcaagttgcacttaactaacagttgcaaccataggcagcagcatgggcaaacatagacagcaagggcaaacatagacagcagcaaaatcatgtatataaaatctagcccctacattcatccaaaacatccacagacaacaaatcacatttaattcatctatacagcagcaccaataatcgaaacaacaaatcacatttcattcatctaaacaatgcaattcatccatcgaaaaaaaggaggaatgggggagggtggcggcatacttggaaaagcggcgtacctggagacggcggcgcaggccgtagtcatcctgaatcctggtggcggcggcggaaaggcagtggcgaagaggtcgaggcggtcggtggtggtcggggatcccg

SEQ ID NO: 87308 - DNA, 2617 bp, Oryza sativa
tcacctgtgacgggcgccagctatgtggccgtcacaggtggcctcacctgtcacgggcgccaaccgtggagccgtcacaggtaagaccacctgtgacgggcccaacactctgggccgtcacaggtgatgtcacctgtgacggccctacagatagagcccgtcacaggtgagtttgcctagagcaattttattttattttatttcacttagttcttttattttccttaacatattttcacatacactacatatttttttatacttaattattttatttcactatcagtagtaattgcacttcattattatactactttaattattttatttccaatgcttatacttgcttaattattttatttcacttctagtgggtgcttcacttaattattttatttgactatttcataagcaatatactattgatcattgcgaacatattagagtcatacagataacagacatgtagacataaactacgtacataaattacaaaaataatccttcctcatggtcgacacgtgcatattgaacttcatcttcttcttcctcctcttctagaggtatttcttgacctatgccgtggacgtgctggttgtaatcatcctcgtctgcaatgttgtccaatccaacaattctccttttcccttcacgaacaacatgtagtttcttgttacacgggtcaactatgtagaacacttgaacaacttgtttggcgagaacgaacggttcatccttgtacgcgttgttagccaagttgacagtggtgaaaccttcattgtcaacttttacattgcgaagatcgacccatcgacaacgaaacaacgggactttgaacttcaagtaatctagctccaatatttgctcaactttaccatagtattgatcacgacgaccaccgtcactagcagcctcgatgcgtaacccactgttctgcactgtgcatttgctgtcttgctttaccgtgtgaaaggtgtatccatttatgtcatatccttgccaggtggtggcactccattcaggaccctgtgacaaccactgaagtgtttcactagacaagttctgcaacctggcattcggttcttcagccactcgttgaaagaagacatgtgcttattcctgacccaactctttgatcggcctgggttctcttgtcggataactgcaaggtgttcgtcaacgtacggcaccacctcagtcatatgctgtagtaccgtgaaatgagctttatcgtacaccttccgatccaacctaatagtctttcttccaacagtaccaacaccgtcaagcctcccttcgtgatgagatcgtggtaatccaattgaagatgtttctgacatgtagtccacacaaaattcgatggcctttcggtggtttactctcgatgatactcccctcggggtgtgaacggttccatacataacccttaaggatccccaggtacctttcgcaggatacatttgcgtcatgaacgttggaccacagcactttgtttgcctcacaaggtgcacggaaagatgttccattatgtcaaagaaagttgggggaaagtacatctcaagatgacatagggttctcacaagttctgcctgtagttcatctagtccctcgggatcaatgatcttctggccgattgcatggaagaaggaacacaaccgctggatcgtgtgtcgcaccttaggaggcaaaatattccttattgcaacgggcaacagctgtgtgataagaacgtggcaatcatgcgacttcattccaaccaacttaagatcttgcagtggaacgagcctactgattcttgatgagtaacagatggaacctttataccactcaaacatgttagcaaatcaatcttctcttctttcgagagagtgtagcaggctgaagaaaggtaaaccctgccgaattccgtggttatgggatgtagctccgaccgaacacccatatcttccagatctcgtcgggcgttgagaccatcctttgtagtacctgggttaagcagtaatcccattaaactctcgcatacattcttctcgacatgcatcaaatctatgcagtggcgaacttcaagatccttccagtatggtagtctccaaaatattgacttctttttccacatgctcctctcttttgtcttttgtttttccacatgctcatctgttttttccttcgatgtgctcttctcttttcgctttccaactttcctcttttttccaaactcgttggttattcccatcactaagttgtgcacctctgtccctgttagctctgtcgggggtccggctgtatctctgtgtccattgaaattctttctcatattcctatacgggtgataccttgggagaaatctcctgtgacccatgtagaccatcttgtgtgaatgcttcaaccatttgcttcttgtttcctccatacactccgaacacgcccatttccctttcacagtttggccagaaaggttgccaagggccggataatcgttgatggtacaaaacagcatcgcatggaggttgaaatacttttgtgcatatgcgtcccatgttcgtgtgccctcattccatagcctttcgaagtcatcgattatcggttcaaggaacacatcgatatcggggctgcagga

SEQ ID NO: 87309 - DNA, 979 bp, Oryza sativa
cgccctcgctacggtcaacccatgcaataccatcagtcggtcactcaggctaaccgccagccaggtacgcccttcgtcctcagataaaccgtccggcacctccgccacagcagcgtgcccctagtggcaatacagcgcctaacagtgttacctctttcaagtcaccgcagggaccatcagcagttcagtgtttccggtgcaaccagatgggtcactatgctagacagtgtcctcagaatcctaccaacaccaactcagggcatgctaatggcagcaccgccagaactcctactccagcggcagctcagtctcgtcctagctctcaggcaagtggacaaggttctcgtgcttccaaccactttggtcgaggacgtgtgaatcacattcaagctgaaaccgctcaggatgctccagacgttgtgatgggtatgttctctgtcaactccgtacccgcaatagtcctgtttgattcgggagcttcccattccttcatatcgcaagcttttgtgaaaagaaatggttggaaaacccaaaatttgcgtgtaccaatgatagtacattcctctggaaggaatataagggcaactcaaatatgcccggaagttaaccttagaattgaggaagttgacttcctagccaaaccgatagtcctagactcgcaaagcttggacatcatcctagggatggattggttggctaagcacaaaggacagatagattgtgccgaaaagtccatcaccttgcaaggacctggaggaaagcaagtccgctttacccctaacaaccctaccgcaagtcggtccatcctaacctgtttacaagtcacctccttggagtcggtgcccatagtctgtgaatatcccgacgtatttccggaagaattaacaagaatgccaccagaccgagagatcgagttcgccatagaactggcaccaggcacagctccaattgcaaaaagaccctaccgaatggcagctaa

SEQ ID NO: 87310 - DNA, 787 bp, Oryza sativa
gtgcgccatccgcccgcggcccgtcacaggtatcccctcacctgtgacgggccgaaaggaaaacccgtcagaggtataccagtgacgagttttgcttccaacccgtcactggtatcccctcacctgtgacgggccgatacattagaagccgtcagaggtgatgggccgccacctgtgacggctttcatttctggcccgtcacaggtaagcggataccagtgacgggcagttggcagttggtggaagattgccagatgccgttgtatgatggatgcaagtcgaagcacagcaagttgtcatgcgtgttggaactcatgaagcttaaggctagtaatggctggtcggacaagagttttacagaactccttgagctgttaaaggatctgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctgccctatctgtggggcatcaaggtacaaacgagcaaagagtgaaggtgaaggaagtaagtcaaagaggggaggcccagcaaaggtggtgtggtatctcccaattgcggagcgcatgaagagaatgtttgcgaacaaggaacaagctaagcttgtgcgctggcatgccgaagaacggaaagtcgatactatgctgaggcacccagcagattcagtacagtggaggacaatcgataggatttaccaggaattctcaaatga

SEQ ID NO: 87311 - DNA, 1116 bp, Oryza sativa
ctctataaaaacataattttttacatcgccagaaattataaaaacatcttttttacatcacaataaattatctagccaagttcatgagtctatttggcatgaaaacgtcctttcttgttcattatttctgcaagaataaaggcgcacacttcgcctctgatagcgggggggttgatgggtgagatcttgaagccagctctacctttctgtttaataaataagaggttaattagcacgttttgaatagtaatgtagatattgaaatgagcttattcgccattagcaacaacctcagggtcgaaatctttcacctctcttagaagtgttgacatgttgtggcacacgtggaaaccacattggtctccgatctgttgtgcgcatgcaaacttggtgtcatgataaagttcgttcttgccctccttgtgcctaccacccttttccacatatgggccccaagccatatttaaggccttggtgatttcactgaaatcataatctttggacttattggagttaaggtaggtaaccctactccacttaggtacgatgactaggagaatccaatgtcgcctgtgcagtggttatgtagcattagtactaagaaccttaacttcaaaaacaatatacacgaagggtattgtcctcttactcttggttgtgtgcgcacatgatgtactccttgtcttgatgggcccataaacaccggttgacatagtcaaccacctcagtgaagctctgtcgtaaattaacctcattcaccatggatggatcaaggaacccaacctgattaccatggcgacgactctcgatccaacacaaccttaaaatatttacgtattagaactaatttaattaggagatatagtccagtcatatcacaagtatagaaggtatgcacttacaaggagtagcattttagaagaccagtgtccaacttccggatcctgaaaaggtcgaagaggtcatcaaagcctatagttatataggcaggcgacgataggaacggctggtggtcgtgatgtccaactatggatgactccctcattttccgcttggcattgcttagttccatgtattgcttatgtagctctcggcaagcaatacccatcacagcta

SEQ ID NO: 87312 - DNA, 745 bp, Oryza sativa
  unsure (1)..(745): unsure at all n locations
aggcaagccggtcggtgaagacgtagacgcccaacaacggcggcataataggccagccgtgcaggcgaaagcaccagtcggcagcggcgaaggcaagccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcagcggcgaaggcaagccggtcggtgaagacgtagacgcccaacaacggcggcataataggccagccgtgcaggcggaagcaccagtcggcagcggcgaaggcaagccggtcggtgaagacgtagacgcccaacaacggcggcataaaggccagccgtgcaggcggaagcaccagtcggcagcggcgaaggcatgccggtcggtgacgacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccaatcggcagcggcgaaagcaagccggtcggtgaagacgtagacgcccaacaacggtggcatataggccagccgtgcaggcggaaacaccantcggcggcggcgaagcaaacccgtcggtgaagactaaacgccca

SEQ ID NO: 87313 - DNA, 711 bp, Oryza sativa
tagatgtctctccaactattatcagctagtgctctatctagacgcaccttgacatttgatctaccttctcttcggttatcataagtataggggacccctgagaagcccaagtcaaccagctcacatatttgtaacacatctcggaaagctctcatttgagcctcacctcttttagaaacagaaaaatgttcaaattgccaaagagtctcattgaaatctccaataatcatccaagggaggggggaggactgtttgagatccaggagccgagaccataaacgatgtctattctccactctcggttctccgtacacaaaggttacatgacatagaggatcttccggagacaaacgcatatacgcatcaacatatctttcattcacactcttaacatccataaagatagactcatgccaaagagagcaagaccaccactcaaaccatcactattacatccaacaaaaccttttaaacctaatctagaacgaagtctgcggattctttcaatcttctgtctcgtttcactgaggaaaaccacctgggaatttgcctctttcaccaaggcaatgagatcacgaactgtcgtggcattcccaataccacgacaattccatgccaagcaattcattgctcctgacgagaccctatcataggtcccgtcagtttaccagcggccccatggctggttgcctccgaattagacacctccga

SEQ ID NO: 87314 - DNA, 1914 bp, Oryza sativa
tcctccccagacttcccctcctcccaccccaccctccccggcgagcgcgtcgacctctccgcctcgccgatgcgggtcggcgccgcggcggtcacgcggcccgacgcggtggtgcgccccgacggcgtcatccacgggatcgagcggctgctggtcccgcgctccgtgcaggaggatttcaaccgccgccgcagcctcgccgcgatctcggcggtgctcccgacgggggcgcccgaggtggatccgaggacgcaccgcctcaagaagcccgcgccgcccgtcccccccggcgcgccgccggtgctgccgatctgggacgcgatggcgccgggcccatccatcgcgccggcccccgcgccggggcccgggtccgggaaacaccacttcgacgggcacagccaggtgaaggacttcatccagacgctcctcctctacggcggctacaacgagctcgccgacatcctcgtcaacctcacctcgctcgccaccgagatgggccgcctcgtctccgaggggtacgtgctcaccgtgctggcgcccaacgacgaggccatggcgcggctcaccaccgaccagctcagcgagccggggtcgccggagaacatcctctactaccacatgatcccggagtaccagacggaggagagcatgtacaacgcggtgcgccgcttcgggaaggtgaggtacgacacgctgcggctgcccaacaaggtgacggcgagggaggccgacgggtcggtcaagttcggccatggcgagggctccgcctacctgttcgacccggacatctacaccgacgggaggatctccgtgcagggcatcgacgccgtgctcttccctcccaaggacaccgccaccggcggcgaaggctcaggctccggctcgtcgggcgccgctcccgccaggaaggcccccgccgtcaccgcccactccaagtccaagctccgacgaggtcagtaaaaaaatataattagcaatgctggttaattaatttgttgtgattactgattagtacacttgagagggtaaaaacggaagtgagtgtcggtgcggggtgtttttactgttggaggtagtgggtcgctgtcgcgggcagtttgccgggaatcgaagcaaaagacgcatccagctagccaagcatctcaccaacatttttttttggagttaattagtatagcaaagtactcttattaaataatgataaatattactccacttaatcatggcccggcctccatcttaatcgattcatttagctcagcttagctgtgtcacgttgaagtctttaggacagtcagctagtgtgggacccgcagcacagcgaccataaattggcggcacgttattccgttgggtgggggagcgaggtaaataaatgcaagctaggtgccgtggttaattattgctcccatctattctttatagtaatatttcatcttggcacatgcataattaattgtacttatcatccatttaaacatgctactaatcattcctcgtaaacaagcgattcattaatatttatatttctagatacccatatagccaatcttgagtagagaaatagagagtcacgcattaatttcgagaaagtcattaagatgatagtcatatttttaaatctgaaaattttatttttaatagtcatatttcaatccaacaacttatcatcttaatggctttattggatttaatgcatgactcttcatttttccacacaagattggctacataggcatcgagaaatgtaaatattaatgaatcgcttgtttacgaggaatagtagcatgtttaaatagatgataagtacaatcacttatccttggtctgtgtgccaagataaaatataactatcataaatagatggaggaagtaaaatttttagatttaaaaatatgactaataaaagtaata

SEQ ID NO: 87315 - DNA, 3158 bp, Oryza sativa
tactgaaccaggtcgttagcttgacgtatgcacggtcaaatattttgatttgattgttacaataacattatcggcgatggatgaataataatgccgctctccgcgtttgtgtttagcaataattaaagatcatctatctgatgatagtagctgtcatgatgacaattaattaggtcaattgcgtaaatttcttgtcaaccggtggcttctagtccaatcgtagaacaggtgtggcttgtggttaacgttaacatgcatggctcacactaacctatctcatctgggtagtattcccttgctaggatttcagtgtttggttctaatctctctatcaaaacttggttaatactgccaatactgcatagtgccaaaatgttggtaaggacagaaatgaagtgattgtgtttggtactttggtttggtggttggtgccaaatagtgttaattaatgtgagatgaatatatcagctagcccagcccaatcttactagagtaagctgtttatcaaatgtttgtctttattactttaccaaaattttgaggggtaaatgaatcaaccaaactagctagctagccttgaatctctcgaaacactactatgagaaccaggtgacccaactatacccttttgtctttgccaagaaagaaagagaattacctctctggttcttgcctccaaagggctggaattaaataaactggaatggtacttgttgctccaacaccgtgcagggatctacagcatcataactagtaccctgtagctctcactgcaaggccacaacttctctatcagaacaccgtacaagatgctccagatcagttgctagctagctcgatcacctatctagtagctggtaactgtagaaaaaagtttactgaaacacacaagacagtgttgtttaccttgaaggagcaagcaccgtatcaatcgtgaccaccatcaatgttaggatactgtagacgctgatagattgtacttggagcttgggccccggacagcgatgcaggcgtagtagcagagcagcaaatgcaatgctttggtcttcttccatcagaggggaggagagggggggggaggggggtctcgcttcatcaggtgcccaatcctatcatggatctgaccattcatgtgggtctctctcccttcactctacagctcacacaccaatctcttcattgattgtattttgtcatccttatcagggcttgttcatcttttttttcaatctgttcttccctgcgaaaacggggaaaaaaagatctcaaatacgaatagaattcgtgcaggctacaagtaggtactatcagatatggccgcgtccgaaagttttcttccattatctcagaaaaaaggtacgtggaccataagataaccagacaccagtactctttggatcgaaactaagataataaagtagcaaaaatgaatcacttaagagattatcagccctacctgaacagttgccgactgcagctagtgagtggaaacatcgtccctcagatgacaaccttgacaacacaagcacaaacgaacgcacaaagtttcagagagagaaaaaacatgggtaaaaggagggaattagcatattagcttgcacatgaagatcagctgttcactgtacctggggtatggagttgtcattcagaacacagtttgtccaggacaccttgttgcacataaagctctgatgcccatccaacctggtctggtcctgtggtatgtcaaggcagaaaagatgttgttgagatatgtcagaatatttgtccaaggcaatcaggccaaacagcactgaggacagcaataatcttctgttatttgtcaaacagcagagttctggagataggtcggaatcagagatgatcatgtatatattttcctggtccataaagcaaagctacagaatggggttttcagaccttcaatgatcatcatgtcagtgccatctgactctcaggaattggcaaatagccattcatggatggagcaacacaggagtagctatggcgtcgcactcgcgacaggaacagatcgatcacacgagttaattaaaaaggagaggttacatcgttttaaaaattattggcaacaattcggtgacaaaaagaattttgtagaacccaggctaatcactagcaggcaattacattgtaggacccccaagccatgtacaaaaagaatctggaaaagaatagttcattagctaggtcttttgttctcctgtcggcaattgaatctgtacatgctattgtataggttagtgacttgagagattcaagtgccccatatgttgaatatgtaggaagatctagacttggcaaaacatcccgaaaaaatatttgatgtattgcagctgtatcttgatcattctcgtctgtagaacagcacataagcagcaggtgtctttatactgtcttcagttataggtctcacgcactcatcatcaaacttataccatcccttcccttcttcatgctgcagaaaccaaccagccttgctcgttatcaagacattgaaaaagatggtttaaaggctgggtgtaatgagaatacatgaaagaggaaactcacgtagatgctggcggtgtagtgtccacctcccatatttccatagtgattgctaatagcatacaagcgatagtggcagtctgatagttcactcttgtcaatgatatatgatgacagatccaaatcactaatggggaaatccacaaatgtctcaagcttatttcttgtgaattgggtgtacgagaaccttttgagatgaatgacaagaacttccggtagcctccacagatctaatttcttcatcgcttgttgatgctttttgcagcatgggcagtacctgaatgcaaagcagagaaaaaaagtgggtatcagtaatgcaacaacagtacaacagtacacttccaattcagaatccaaagcaagctagccatgtattgaggtaatattttgcaaaggtaatcaatctatttcagttcatacatacgcacatcaacctattttgggttaacaaaagaaatgaagattgcaaagaaggctattcaataagcagtgaagccaaaagcataacagttgttcctcaggggggcactcatgactcaccacatgtcttctgggcccaacggttcctcttttagaaaggcttccagaca

SEQ ID NO: 87316 - DNA, 717 bp, Oryza sativa
gaaaaccagtttcacccacatcactttaaggcaaagattgcttgttttgcccctcagttcagtggcttcaatcagcatgattcacaggagcttcttgctttcttattggatggcctccatgaagatcttaaccaggtcaagtgcaagccatatgaagaagctaaggatgcaagtgggcgccctgacaaagaagtggctgatgagtactggagtaatcatttagctcgaaatgactctgtaatagttgatacttaccatgtaagttctttaaatttttcatgtgttaaagcaattacactattattttctcctgcttctcctgccattgacccttttctgacatctacttgcaggggcagtacaaatctacattaacttgccctacttgcagtaaaacatctgtcacttttgacccatttatgtacttgtctttgcctgtaccttccacggcaaagaggacaatgactgttacagttttcagcactgatggtagtatagagccaatctcatatgatgtcactgtgccacaatttgggagtcttaatgatcttgttcaggctttaagttctgcttgttcactgggagatgatgaaatcctgctgattacagaggtatgcttttatctccattgagctttggcccttttgcgtttttgccactttctatctcaggttaaacagtatgagtcatattaggccttttacttactggaagtga

SEQ ID NO: 87317 - DNA, 621 bp, Oryza sativa
cccctttttccctagtggattattccctttctgcatcattgttacaaattcattgtagtcgatccggccatcctgcagagacgaaacaagagagaagcagacatttgatgtgattcttagtcttctaggctttcagatctcataatgaatgaaatgtccacttacattgtcctgatcaatatctttgatgatatcctccagatgtgcatctcctatgccaaattcctcacaggctttttgtagctcatcttgagtaatgtaaccactgctgtctttatcaaagtatgaaaaccctgcaaaaagattatcttctctctcaactttgttcagatgcatagttgcagcaatgaactccccataatctattgaaccactattatcaatatcagcctgcaagtcgaagaacatatgcatttattatatcttggcccaaaaatatatcatatattacagctaacgtgcctcacaacaatactttcttagaacataaaaggtccattctcacgtactgggaaacttatcagaaccacaaaatttggatgagatacaatagatttacaaataaccactaccaacgtcagaaaatctttgcaagctgctaaaaaaggatgtcaaatacac

SEQ ID NO: 87318 - DNA, 1280 bp, Oryza sativa
gaagtgccatgttcaatctaatctgttggagtctgtctcggtcaaggactctgtcgttcagtgctataaattgaagagcttagggcaaggatctgcaccctgtacaagttccctgaagacaatcttgcaaagccgcaattccaatctgcgtctctcctgcttgtttggcgttctcatggcgtcctctgccggtgggggtgataaagggatcatcactgcgatggttgcccacccgaagccggccgggggaggtgagatcgtcatggcgaatcaaagggaggaggttctgaataaaggtactttagcaatcggggtagcaacaccagatgaaaaccaaaccacgatggaaggtgcgggtactgctgttgaggtggacagtacgactcatcaggggccagcagctttcattgagggggaggttgtggaggaggatgaggacgcaatcgaagtggttatagaggaagaggaagtgcagaaggctggccaatggactatattagcaagattctattccttgaagtctccaaatcttgccgctctctttgaagacatgcgtcgtgcttggcggctgcgatcagacatgacttacaaatcgctgagggataatttgtttatcatatcttttggtgctgagggggattataggtttgttatccaaggtggtccatggattcataggggggatgccctgttggtggcagagtttgatggcatcacctgtccgtcaaaggttactctggatgtgattccagtatgggtgcggatttatgatcttccactggggctaatgacaaaagcaaggggtgagatatatggtagcaaactgggcagagtacaggaggtggatgttggggacgatggccgcaataaacatgacttcttcagtattcgtgttgatctctcagtcaaggggccactaaaggataagttaaccatcaaaatctctgcacaaggtagagtggaaacaagaagttttgcacttcgatatgaaagagtgccacacttctgtttcatatgtggcttcatggggcatgctgataaggactgcgataagagaggtgcaaatgtggagaatccctttcgcttttcagctgatttgagatgctcacccttaaaaccgtttgagcgaaaagttaacaaggtcagagcaatgcagaacactggagcagctcgcaatctgttcttccgtggagctggaagtgctggctcatcgtcttcaaagcagagagatgtggaacaatgggatgaagccattccacccagagtggatgctcatgata

SEQ ID NO: 87319 - DNA, 601 bp, Oryza sativa
gctaacacaaaatactatcatcttctggcaaatggccgtcacaggaagactcgtattttccaattgcaggacgggaacgaggtcattactggtgatgctcaacttaaggagcacatcaccaagtactttaagaccctgttcggcccatcacagacttcatctatttttttagatgagtctcaggtcgacgacatacgacaagtctctgcagaagaaaatgagtctttaacggcagattttacagaagaagagataaaatgtgctatattccaaatgaaacataatactgcacctggtccggatggtttcccaccagagttttatcaggccttctggacaattataaaggacgacctgttagctctgttttcggatttccagcagggatcgttgcctcttaatagcctaaactttggtacgattattctactgcccaagcagaaggatgttaggactattcagcaatacagaccaatctgtctcctgaacgtctcctttaaaatctttaccaaagtggctactaacaggcttacatcagtagctcagaaagtgattaaacctactcaaacggcttttttaccgggtagaaatataatggagg

SEQ ID NO: 87320 - DNA, 1676 bp, Oryza sativa
tctgttcccctgctggggtttcatggatttcttttttagtgaacttttttttttggtgtcccttttgcagcggatattgacctggccaccatcacggatcggatggaggtgaagagagcggtgcaatcagggaatgttcaggaggccatcgagaagattaacgatcttaatcccacggttcgattccattacttactctagcaatttttgtgccacctcgaaatctcgaatgttgaactgcctttggtggtgacggtggaggggcagcaatggtgttgcagaattgggttctacctgagataagaatgtcatagtagcctttgttgttgtttagtaatgctagttttggtgcttccctggggtatgagaattggacaacgagaaggatggttgtttctttctgaaatttagagggccagctagttttggaatcgagggcaaagtccttgaccttgtccgtgttttctgtgcttggcgtctttcgatgattaatgaatactgtttatttattgtattgtgggaattaagtagagatgatggaccacttgatttgtcaaattggattttgccaactggttatttgttcttgcctcttgtcaataactaggttagtgctcctcttgtcaataactaggttagtgctgtctagttaaacacatgcccaaattttagtttccttttctgggtctaaggattattgtggtgtattttatttgacaagttgtttatattttggaatcatgaagcttattcaattttcaaacatgccaaattttttttattcaattggacggggagaaattggaaaagtgaataaccttgaactatgcgaactattcttccctgttttttttttttttttttttttttttttttttttgctttacatgctagttttctgcgataagtttgggaacatttaacttaattggaactgattttggtgagctcctgacataaatcataaagttcagacttgagcactatagtgttattgttcagagtactgacgtgatccccaaggatctaacatattttcataaatatcctgtaacacattggaacaaaatgtctcttgctctattcaccgttaaaatcttcacagtttcttttttcaatgtcccttttaagttcatcaatccaatgatgttgctccattgactcctcggtaccgaggtgtgtctactgtggtaaatggcagctctgatcatgttatttgggaaaaaaagactcaacagattggtcataaatactttttttagtattttactcctttctttaaacaactcagaaatatctacgggaatccagaaattacatacgtggttgattgacgaactgttcatatcgacagtattggccatcatgtgatgtgcaatcaaatcttctccaagtttgacagtttatgtaccttaaaagagcacctagaagccttgtgaaacaacaccttaaatcaaaagtcattctcttaatgctgtatgttctgctgcgatgaattttgtaaattaacaggaagagttctttaacttctgattcttcatcctgacttaacttcccatgtgcagattctggacacaaatccccaactgtactttcatctgcaacaacagaagctaatagaattgattcgtgcgggaaaaataaatgaagctttggagtttgcacaagaagaactc

SEQ ID NO: 87321 - DNA, 1079 bp, Oryza sativa
gtaatcattttgagatgctcggtgagagagtttccgtgtgagtttggagtgtgtttgcccgagaggcttttgtattaggattagtttggagtgtgtttgtccgagagattttaagtttgtgttaatgttcctctgaaggtgtatgtttgctcctagttgagcggttattttgcatcacctataaatgaaatgatttgaaggatttcatttttgccttgtccatttaaattccgcaatttaaattccgcttgcaatttgaactttgcgatgatgagttttgctctctctttctcacctcacttctagtttcgggaattccttttctcttcctcctctagtttcgggaattccttttctcttctttttctctcttcttttctagatccggcttctctaatagccgcgattctagtaaggattttgagaaatccggcttgatgagtattttcgggggcaagatttgaattgctatattcaccccccctctatagctgttcttggtctttcaattggtatcagagcccggttaagttcgttgtaacctaaccgtggcaacgaacgcagctatggaggaaaaatactctgcgaaaccatttgttttcgatggacacaattttgtcatttggaaggcacgaatggaggcctacctccagtcgcaagggcataatgtgtggaataaggttaaatctccttatactgtgcccgatgatgctgacatcacgcctgcaaatatggctcaggttgattttaattatcgtgcaagaaatgcaatcattggtggaatttcttctggtgaatttaatcgtgttcaacaccacaagtccgctcatgacatgtggactgctctgtgcaatttccatgagggaaacaatgatattcaattggttcgtcagaatcaatttcataaagaatatcaaagatttgagatgcacccaggagagtccattgattcttatttcaaacgttttggagaaattatttcgaagttgagatctgttggaaaagaattttctgataatgataatgctcgccatcttttgaattgtcttgattatggtgtttgggaaatgaaagttact

SEQ ID NO: 87322 - DNA, 844 bp, Oryza sativa
ataatattcatattgtcccctgataaaaaatgaacttcaaaaaaagaattcttttgattcaaccatctttttctcaactcagcaacgtgaagtattaatcttatatttaggatatcaagaaatcacatcagatgataatatatatcaataccctctaatatatatcaatattccccgtcttttttctatgcaaaacaaaaaagaatagtaagtgattccataaatctacgcagttgcccaagaattaactattcttcttaatcaatgatttcttatatagagagaacggccctcacaaattgcaaatactaatttgttaagaatcaatcgaattgaagtcatagtgtcatcgttggctggaatcgatatattcgcgagatctgggtcacaatttgtatcggctaaagaaatagtaggaatccccaaaatggcacattcccgaagagctatatactctttttgctgatcgaggacgatcacaatgtcaggcaacctcgtcatatatttgatcccgccgagatatctttgcaaggtagataattttctcttcaagattgccacatctctttttgggagatggtggaatttttccatcttttcttctgctcttaagtctctaaattgagaaagtctagttttagtaatcgaccaattcgttaacataccactgaaccactttttattaacataatgacaacgagcccttattgcagctgatgctactaaatccgctgctctttttttggtaccaacaattaagaagccttttccctgacttgctgcatcaaaaactaaatcacaagcttctgataaaaaacgggtggttctgatgaactacttgcag

SEQ ID NO: 87323 - DNA, 2512 bp, Oryza sativa
cccccccccccccccccccgccgcttccacaactcgcgtgacgcgtgagtgaggccagcctgcagagtgacgtggccggagggaaagtaattcccctctacttcacatacccccgggcccatatctccgacaaccggattgcaagagcttgaagtatcgcgttaggaataatgttaatctttccctagacacggtttctcaccaataaatcctcactatcctagcctatcctttgcttggtgtccttggatgaaccggaggaagaattaatcacacgtgttcccttggattcgatacccttggaatactccgtaggggaagtgctacatcggtatatccgtgcgcttgcggtttctatctgtaattgtaagaaataccaacactaatgctaaaaaaatcaaatgaaattatgagattggaccgtgatggtaaacagtatatgaagcttgctcacctcataagctattaaaattaagcattcatctaaatgattttcaaaccatgtaagatcaattaagaatgtgagtcaaaacaaaataaagaatttaatagaagtttctagatgagtcaaaatagttggccatttgatgggtagataaaattgaagctagactctaatggaaatttcaaacaattcaagtgaggttgaggtggaaaactacatgaaaactaaaggtgggaaaattcattcaccagtactctatgttgatattcgcaagcagtgcatattgttgttagatactaaagaaaattttttcattaaattttgttctaagggagtactaggcttaataagtcatatattgatataaattaaagataatcaattatgatttagctaacgaaagcttaatattaggtcaaactagaaaagtgggcgcgccgttggcacgccatgttaaaaattaatactcctattttgaatatgtttatttagagtatttttatgtgtaggtagacaaactttagtaacttgaaaattgaaatttagactatgagcagtctctctcttttttttctgggtgtttgttcttagacacaaacaaatgctatggtcacaaccctgagttaaaaaataaggcctaggtaagttgctggatagtaagagctagcaatattgcactgtcataaatatatagtatattttaaaccttgaattatattatggtatcttgtactactacataacacaatataagtgtataggtataagcattactactaacactatattagatgtacgcaagagatcttgtactactacataacacaatataagtgtataggtataagcattactactaacactatattagatgtatgcaatagacatcatactgatactgatgtgctaccctgatttctagtcatattttggaatggagggtgtagattctttctagaagtaaaaatcattgaagagacttgctaataggggttgtttggaactctttttattgtcagcttgtcacagtagatggtattttcacaaactccgattcagacgaatgttatttcgcaagtactatttgaagactgaacttttagcgagcttatgcagacaagtgaacgaactaaaaacactgcaaccattataccattacatatggtactacattaggagtattttctagcagcaattgatatgctttcttgggacagtttgtacaaatgccaactacaaaacttcctgcattttcattatgataacaataaatactcaactttcttgggacagtttctgcaaatgccaactacaaaacttcatgcattttcattatgacaacaataaatactcagccacaccatttgcatatcattctctagcataggattaggggctagcaacaaaattgaccaacgcacacccaagtatatacaatggatttgggagtggcttcaactacaccactcccattcatatgggcacttttctcaagctcaaatgtcagccacagccactctccaagagtctgaatggcaacactaactcctttataaatgatagactggggactataatcaatttatacatcacgaaagcagtcctaggccctagctagagtcttgtaaagcatgagctcagctcatctcagaaaatggaagcccgcaagacttattcggcctgtgcttgtttgcaggataagcagacaagcagtacccactgttgaatctgcggcctcacagaaagtaatctggagctggcctctttgcaggaacccctcttgattcctgaatgcacatataggaaaattagatgctaatcaataatgtgtcacagacgtaatgatcaaagtggctaacacatatatgtggggcagcttcaaatacacagaaactcccggttgctcattcatttactcactataattcttaaggctctaaatatcaaacactcgtagcaagagatataagaacaaaaaatggagggtatatgaaatttcttcttgatgaaaacaccagaaccaattaattcttatgatctactccctccgttccataaataaaggga

SEQ ID NO: 87324 - DNA, 3394 bp, Oryza sativa
aattcctaagttttccattgtcaaaggttctaagtgacatagttgtgtgcaatcgaagcaacctcgcaagcctcacaaggctgccgaggagagaaacttggcaccactagaactcctacattcagatctttgtgaaatgaatggggtgttgacgaaggggtggaaaacgatatttcatgacgttgattgatgatgctaccagattttgctatgtgtacttgttgaaaacgaaagacgaggctctagactattttaaaatttataaggcagaaattgaaaatcaacttgacagaaagataaaaaggcttaggtctgatcgtgatggagagtttttctcaaacgagtttgacttattctatgaggaacatggcatcatacatgagaggacgcctccctattctcccgagtctaatgggattgctgaaaagaagaaccgcacactgactgacttggtgaatgccatgttggacaccgcgggactacctaaggcatggtggggggaggcattgttgacctcgaatcatgtgttaaacagagctcctaacagaaataaggacaaaacaccatataagatatggattgggagaaaaccatcactttcttatttgcgcacatgggggtgcttggcgaaagtcaatgtaccaataacgaagaagcgcaaactgggatctaagactgtggactgtgtctttctgggatatgctcatcacaacattgcctatagatttttaatagttaaatctaaggtacctaacatgcatgttggtacaattatggagtctcgtgatgctaccttctttgagagctttttcccaatgaaggatacacatagtagttcgagccaaccctctgaagtaattcccagttcaatcacaccaccagaacaaactgaacatacacatgaacatgtcactgaggaggatgaaagtgaagctcctcgaagtagtaagagacaaaggacggctaagtcctttggtgatgatttcactgtgtacctcgtggatgacactcctaagtcaatttcagaagcatatgcatcttctgatgtagactactggaaggaggctgtccgtagtgaaatggactccattatcgctaacgggacttgggaggtgacagagcgaccctatgggtgtaaacctgtggggtgcaagtgggtgttcaagaagaagcttaggcctaacggtactattgaaaagtacaaggcacgacttgttgctaagggctatactcagaaagaaggcgaaaatttctttcacacttactcacctgttgctagattgaccacaattcgtgtgctactttccctagcaacctcacatggtcttctcgttcatcaaatggacgttaagatagcttttcttaatggagagctagatgaggagatctatatggatcaacctgatgggtttgtagttaaaggtcaagaaggcaaagtgtgcaaattgttgaagtctttgtatggtctgaaacaagctcctaagcaatagcatgagaaatttgacaaaacattgacatctgcaggctttgcagtcaatgaggcagataaatgtgtgtactatcgccatggtgggggtgagggagttattctgggcttgtatgttgatgacatactgatatttgggacaagccttgaggtgataaatgaggttaaatcattcttgtctcaaaattttgatatgaaggatttgggagtagctgatgttatcttaaacattaagctaattagaggcgagaatgggatcacactcttgcagtcccattatctggagaagatcttgaatcgctttggctacattgatagtaagccttctccaacaccttatgatcctagcttgttgcttcgcaagaacaagagaattgctaggaatcaactagaatactcccaaatcattggctcgctgatgtacctggctagtgcaactaggcctgatatctcctttgctgtgagcaagttgagccggtttacctctaattcgggagatgatcactggcatgcgcttgagcgagtaatgcactatctgaaaggtactatggaattggagcttcactattctgggtatcctgcggtactggagggatatagtgattctaattggatctctgatgtggatgagatcaaagccactagtggatatgtcttcacactaggtggtggtgctgtttcgtggaggtcttgcaaacagacaattttgacgaggtcaaccatggaagcagagctgacggcactggatactgctactgttgaggcagaatggctgcgtgatctattaatggatctgcctattgttgaaaaaccagtgccggctatccttatgaactgtggcaatcaaacggtaattgtcaaagtgaatagttctaaggataatatgaaatcgtctagacatgtgaaaagacgattaaagtctgtcaggaaattgagaaactctggagttataacgttggattacatccaaacagctagaaacctggcagatcccttcacgaaaggactatcacaaaatgtgatagacaatgcatcgaaggagatgggtttgagacccatgtgagttatactatggtggtaacccagtctatgtaatcggagatcccgtgaattagaacctgggaagaacaaaccattagtaaactagaggagagtaccaatctataccctctctaagtgaagatgcatgtactctcgtgagctgcaaggcaggttggctatgccttaatgagttctgttggctttaattagcgaagatgctatcctgcagagcattcttgaaagaactcacatttgtaagcttgactgttggttgcattctatggagattttgggtgaatcttctaggaagcttactaaagacctatgagtatgacttatacacttcacctgaggggtagtttacagacggtctagtaccagataagactctgagtgaaacttgcttgcacaagacttgcaattcaaggcgtagtccattgttcaagttgtgagtaagtgtagcttggagttctaggtggatgttcaaccttaatcggtctccatcgaaccgctggtatataaacagtacattggaaaaggcaaatctcaatgggattttgagatttggtgggggattgttggaattaatagatgggctaaggctcattcgaagattaattctttggaaatcacaaaagcccacctcatgggatggcatgcatgtggagtttggtaacaccttgcttattctaggagagggggacctccttaaaagggaagatgccctcctagccacttgaagcatgtgtggtggagagaagaggagaaacacacacgcacgctcgctcgcctcgcctggcctggcaggcggcacgcgtgcacgacgtacgcatcgaatggtccacaaaattggctactcacccttgc

SEQ ID NO: 87325 - DNA, 566 bp, Oryza sativa
tgatccacacccacacatgggtcaggtagcggccatacaagcggcctttagggacgctggcgtcatacaccggtgcgccacaaatcatggcctgcggatgctggcgggccaaggccaaaaaaacggggatatccgtaacagcatgctggccatcggcgtcgatctgcagcacatggctgtaaccctgcgcgtagacctggcgcatgccggccatcaccgccccccctttgccctggttctgcgccaagcgcagcagttgcacccggggtgcatgctgcgctgccagcgcctgcagcacggccgcacagcgcggctcactgccatcatccaccagcaagcagggcaagcctgcttgcaacacgccctgcaccatcaggccaatggtgtccgggtggttatagacgggaatcaccgcaatgggacgaaagtccatcacagcgtccactccagcaacttgccgctggcgtgcgcaccacgcgctgacgtcagtgcgaattgcaagcaacctttttcggcatgccactgcagttgcaactggaccgtatcgcctggcaagatgggttgct

SEQ ID NO: 87326 - DNA, 700 bp, Oryza sativa
ttatatcttctaaatatatagaatagaggaatcccgatttgtcaagtctcatgatcgtatcgaaatggatttaaactcggctcaatcttttttcagattgagccgagtttaattgcaatcaattagaagaaaaaagaagaattactgcattttcttactgatttttgatcttttctatttctcttcttttttatttagaccttttttctatctaattttatccacttagtctagctatctagtttatctaccggctcgaactcgaatttgatcgctttccatatttcacaagctgcggctagttcaggactccatttgcaagctgatcggataatttcattaccttcacgagcaagatcgcgcccttcgttacgagcttgtacacaggcttctaaagccacccgattagctgctgcaccaggtgcattaccccaaggatgtcctaaagttcctccaccaaattgcaatacagaatcatctccaaagatttcggtcagagctggcatatgccaaacatgaataccccctgaagccaccggtataacacctggcatggatacccagtcctgagtgaaaaagataccgcgagcacgatctttttcaataaaatcatcgcgcaataaatcaacaaaacctaaagtcatttcgcgttccccttctaacttacctactactggaccagcgtggatatgatctcccc

SEQ ID NO: 87327 - DNA, 689 bp, Oryza sativa
ctttgcgcagtttcataatgttcgttgccaacgatccgaggttgtaacatagttgaggttgaatctaaaggatctactgcaggataaatccctttggaagctaatcctctggaaagtacggtagtagcatccaaatgtgcaaatgttgtagcaggagcagggtcggtcaaatcgtccgcaggtacataaaccgcttggatcgaagttatagatccctttttagtagaagtaattctttcttgcaaagaacccatttctgtactaagagtaggttgataacccactgcagagggcattctccctaataaggcagatacctccgatcctgcttgaacaaaacgaaagatattatcgatgaatagaagcacgtcttgcttattaacatctcggaaatattctgccatagttagggcagtcaaaccaactctcatacgagctcctggcggttcattcatttggccatagactagagctacctttgattcctcaagatttttttcattaattactccagattccttcatttccatataaagatcatttccttcacgagtccgttcccctactccgccaaatacggatacgcccccgtgagctttagcaatattgttgattaattccatgatgagtactgttttacctactccagctcccccaaatagtccgatttttcctccacgccgataagg

SEQ ID NO: 87328 - DNA, 744 bp, Oryza sativa
tgcatccacttaatttcaatcaagtcaaaatgaaaaaatccatggagggagagaaaaataatatgagaatagactatagtaaaagaaaaaaagtaaaaggaaaaaaccagcgaatctttcatgcttaaacatgtcgcgaaatgtttcaaaagagcataaaatttattttaagaactaagaataagaaaagaatataaaacaaatggaaaatgtgcgatatgttgggaatagctccgcggaagaaaatctaaagttcttatgtatagaacttttttaaccatgggtcgcttctagtagcgattatgaattgctctcaccgctctttctatttctattttctattctttctatttctattctactatatagaaatagaaatagaaagaatagaaagactctttcttacaagagtttcttacaggagtgaaacaaaattaaagaaagagagaaagaataaagttcggcaaaatgattaatgcaaaacggtcaattaaagaaaagagttgatacaacaattcgactactcaatcaattagtagtatccctagagtccactcctcccccatactactagtgaaagagaaaatgtaaagactaccattaaagcagcccaagcgagacttactatatccatgtaaattatgtctcctatttctatgaaggaattattctactattgatgaataatcatagtagaatcaagggtacagagtcaaaaaggggttctgacctaaggctatggat

SEQ ID NO: 87329 - DNA, 631 bp, Oryza sativa
aagattcaaagggttaggtttttctttttttttctagggtaaaaaattcaaagttctaaaattcaaacaaagagacttattttttccaaaagagtaaattcatagtttaagaaaggaatacggaaatatgaaaataagagcttctgttcgtaaaatttgtacaaaatgtcgactgattcgtaggcgtggacgaattagagtcatttgttccaatccgaagcataaacaaagacaggggtaatctttcgaaaaaagaacttgactttctaaaaagtaaaaaaaaaagtacccgcgaaaatgtccaaattccaaataaaaaaattcaagtaaaggatatattttaccctgaaacggatatctttgtatctttttttctttttgttatttctaactcatatttatgagataataaaatatgacaaaagctataccaaaaattggttcacgtaggaaagtacgtattggtttgcgtaggaatgcgcgttttagtttacggaagagtgcacgtagaataacaaaaggagttattcatgttcaagctagtttcaacaatactattataactgttacagatccgcaaggtcgggtggttttctggtcctccgcgggtacttgtggattcaaaagctca

SEQ ID NO: 87330 - DNA, 656 bp, Oryza sativa
ttgattgatattgccgtaaagttgaaacttttttaggcttttttattaaactgtaatttcctctctgcaaacgtgctcttctagaagcatatacaataatgcgcggtaaaggagggaaaatagcatactcaatcaagggacaaattcttttacctactacagatctcatactaccccttagactttgtaaggccatataccacccccaaagggtatgaaaataccggatgaccttagcttttcgacgaatcctcgtctcgtgcagcgaagtcctgttagtaagaccccgcgcaaaaatggattatataagaatataattccgaatattcctccgggtgcgtatagtagcattgcgattccgaatcttttttctttgtgaatagaaaaaattcattgtatcgttgggtcggaggtttgctccagaaaaattcggaacaaaacgtctaccgcgttgaagcccatagccccatggagttccgcgaaagtatgattcttatcatcaggagccttttgaacgtctctacgatgggtccagattctatagcagtccaatctgaaatgaaagacttctcgctcttgatcggagtcgtaaactaaaactacctcttcatcaaggttatagaaaacttcgtcatctagttctaccattttgaaaa

SEQ ID NO: 87331 - DNA, 1249 bp, Oryza sativa
ataaaagtgttgactgcatccgtcttttgtcattaaagcataaaggtttcccggtaagttatatttttctaaaaagaaaaatcaaatattgtcaacagagtacgtttcattgatcaatctcttgacaggactgcatgctcctttcaggttgatgtcaatgtagctcgcatagtcacaggctaggatgggtcaaacttcaacccttacccttttctgcagagttccatttagttggcttgtaagattggcctcacccaaatttataaataatgattacaattctctgcttatacatacatatatatttatatatttcccttttggtgaaggtatccaatcatgcgtgatgtgcagaaatatttatggcctcggttgtgtaccatttctaaggaaaaattgtaagtcatttggtcctctaagaaaagtttgtcatacctttggttttcggcatcccatctgatgaacctgatacgataggtatgaactacactgcctcatgataacttttggaaaggtatgcatatatatcgcagtgatcagcatgattctgcatcattttaggcacataaatgtttacattgtcaatattgattgtgtattgtttccattacataggcaatctgcacaaaagtaagtccaaattgcagggcttgccctttcagtgcgaaatgcaaatactacaacagttcacttgccaggtatttttcatagattgtgaagttattgcttaaattgattatcagaatgatctaaaatattgctatggtctgtaacatcctttgttagagcttaagtagtatcctttgcatgatcaaattaatcggtactgtagcatatgttgtaaactctgttaagagcatgttaatgagttgtccctgtgtactctagtctatgtgtatcttcaattgttatttcttttatacggaactatgagcattccataaaatctgcaacacaactaaattgcagaccacccttaggctaaaccaatcacataatgcaactagtgaggttagaagtccccctgaatgttgttatatttgctgcagtgtaataacaagagtagtcttagttatcatagtatatttattatgtctattttagggcataatatgttgcgatttgtagatctttttttatttggtctcatttaaattagagtactgtatcatgacactgggttgttaccagattatcactccctcctgcagaggggcatgggcatgaatatggtgaagagcaagcaagc

SEQ ID NO: 87332 - DNA, 1925 bp, Oryza sativa
ccaaacactgtccaacgctaccccacgttgcaacaggcccaaccaaccacctgaattacaccagttcattaagctaaactagggatgagaacaatcacggtgaatggttgatcgcccatatccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggaaagcacggtaagtctcccagggtttcccgtgaaccggtccttaactgccatgggtgcgaccagcaaaaccatgcacccacagcccaccattcagtgtattttaattaactaacaccattgcggtggcaccaatctaaagctatgccaatagacaaagtctatgtaataaggtgatccccatttgtgtgctagttgaactaagcatggctaagcatttcctaaaccaacatctagtcattttgatacccaagttatcaacggcatatggtaaacaatatgtggctgaggaataggacccatcccacattacattgtaaaagaatgcaacatttaatagaaatgcgggatacttgtaaattgggtacaatatgatcaaacgtattgcatgacttgccttgctctcgaactgatgggacctcagcaacgtcttcgagaaacttcggatcgacgaaacggccgaaacctacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataaactgtgtttttactaataaagaaaagttcttaatcaatttattgcgcaataagtcccagggctgacgtcagcgaggggagggggcggcgccgacaggcggggcccacgggtcagcggctcaaagcggccggtctaccgtggaccaggaccacgcgggtggtccaccgccggtccacgggaccgatggtccggatcggccgaggggccgatcggacggcacggcggcggctaggcacggctcggctcggcttcaaaaccggccggccggccatggcaaccggcggcgacgcgcacggtcgccggcgacggcaatcggcggcgtgggaagcgacggaggacggggcgaaaagcggcggcagcggctgaaggcgacggcgcacgcgcgaaggacggcggcgcacacgggagagagggaaaaaaagggagcggaggggagcctcaccggcgagcacggcgaccaaagcggaggatgaaaggcggcggtgacccggcgatgctgaggtgcggacgggcggcggcggcacgctaggagaaaacagagagggggttaggggtagggagagcgaccacggcggctagagcggccggccggagttaggtggaaatggagagctcaccggcgtgcgagagaaacggcgctccggcgacgattggcggcaaccgaatggtggccgaggtgcaagcgggctcggtgagcgtgacggtggcgactacgcggcgcggcggtggctctagcggcggcggcgcgcggccggagatgggcggcgggcggcggagctcgggtgcgcggcgcgagggcggtagacggcacgggagagtgcgg

SEQ ID NO: 87333 - DNA, 823 bp, Oryza sativa
agagcacttctgcccacatctcatgacgcagaagacccagcaataagtatagttacatcccttgaattatgctacattagttgcaactcttagatgctgtaatcgacagcataaataaagtgtgtacggtgcctcctctacattaatatgcatatacacaacgatgaggtcataggcaaaatcaggatccctggcacaggccaagatggaaacaaacttaccatgcaaacgtcagacttgtcaactgttgaactcctctcttcagctcgacttggcaagcatcctagccgaatatgaactgcaagcacattggctggtagagcaaaaggcaggctttgcgatagtaatgttaaaaatgatccaagaaccgcgtctcttcagtcaaagatctcctgggcttcgattttgctgtgctggctgcagggtttggtcaaaggtgaatgaatgaatcaatcaatcgataggaaaagtgtgcagaattctgtccatatgtaagagaagaatgaacggtgccacacttactgttcatccttggagactcggtagtatttctcggcgagctgcctctgaccaataagctgagcaaacctctcgtcatgggtgatcacaatcaactggaagttctcctgccctttcctgctctccattattctgtgtcggaaagacagacaggcgcacacacagttagggtggaagctccgggtgataacaatttagtagtaaatctgtagttgccaaaaggaatacctcaaaagggcaccagcaaggctctctgcattaggcccatctagattggtggtcggctcatctagagctaatatgc

SEQ ID NO: 87334 - DNA, 1013 bp, Oryza sativa
gtactgagcaattactgtcaattaatcttaatcaatcgcaagtggatgctattgagtctgttatctcagcagtgcagtgtaggcatttgaatctcatgaaacttatatggggtccaccaggtactggaaagaccaagacagttagtgctttgctttgggctttggcatgtttgaaatgcagaactcttacatgtgcacccacaaatgttgctattgttggagtttgtactcggttccttcatattttgagggatttcaacaagaatgccaatgaaaactttctacccttttctcttggtgatgtcttgttatttggaaacaagtataatatggacatcactgaggaccttcaagatgttttcttagattgtcgtgctgatgaacttgttgaatgcttttcatcgttgtctgggtggagatacagaatagcttctatggcttccttttttgaggattgtggttctcagtatgatatgcttcttgaggatgatggaagaagcgatcctatttgtttcctggactttataaagacacaatttgatgtgacagccacagctttaaagaaatgcataatgaacttattgattcaccttcctaggaagtgcttttcacatgatagcatcagtaatatatcaatgctctttgattcactggaaaaagttgaagcccttttacatcatgaaaatttaactgatgatggtgcaaaaaggggctttggttttctgtctattcaagacatttcttgtgcaaagtctgcattcattattgagaaggaactgaatagagcaaagttatcatgccttcaattgcttgaagatcttgagagatcactggatctacctactggtagagacagaaattggattcagaactactgcatgcgtaatgcaacacttattttttgtacctcctctagctcgtatcgattgcatcacatggaaattgcaccgcttgatgtgttaattgtggatgaggcggctcaagtgagggaatgtgaattgattattccacta

SEQ ID NO: 87335 - DNA, 724 bp, Oryza sativa
aaaagccaagtagttttcttcctcactggtcttatttgttcaatagttctttttgatcgtttgatggtcatcataacctcacaataattttctttcattgttcatctttaggtatgcaaagaagctggatttggaattagtctttttgagagattggttgtactggattttgaaaaacatttgctgaatatacaatatcgcatggatcctcgtatcagcttgtttcctaatgttcaattttatgggaggaagattttagatggtccaaatgtcatgtcctctgtctataacaaagattacacaaacctcccttttggtacctatgcttttataaacatcagtgatggaagggaagaaaaagagggcactggaaacagttggcgaaacctggttgaagttgctgttgttttgcacctgatccaaacaatttttaaaagtatatttctttttctcatcatggtatttctaatgtctatatgaaactacttggataatataacattatatctttatttcttgcttacatgagatattgccctacaaattagagtgttctttgcctacgttgtacagttggctcagaatttcttcagcacatggtccttcagtatttattgtattgtagagaaatataactttactgacttattagctgtcagctgcaacaatttgtgattttgatatccaatgttgagtgtgcgttgtaaactgctttaatctgggt

SEQ ID NO: 87336 - DNA, 7062 bp, Oryza sativa
atttttctacttagaagagattaaatgaagagagagtaggattatctactaatctgaagatagtctataaaaaaactttctacttgaaagagattaaatgaaaagagagcaaagttatctactaatctagagatagtctataaagaaaaacgaggcaatgtattagagagctgtagatacctatgtagacatactattgaggtggtttactattaatctagtttattgttgagatatatatgttttatagagagcaccttactttaccattacgggtgctcttagcaggacaacacagtgcgaagggcacgcaacctcggtatttacacccagcaaaatggccaatttggacgtctaggcatctattctagcgctagcggtggttgcttcatcaacatcaggcactgctttcgttcactaaacggaattgcctggacgtattctacaacagagacgacaacgactacaaattgaaagaaatggcgcaaacaaggcctttggaaggaccatgcaacacgcgtcaacaatgtaatataatacttaaatctgaagggagaaaagcggccagctatgagcaagagtcatttgccaaggagcaaactatcagaaagagcaagagagtgtacaaagtgatgcaaaaggccgaacttccggccttcattcttcggaagaaagtacacattacagcgtgcagggtgaaatgggatttggttcctgtgcagtccttagtatgattgcaacttaagcagtcatactatagctgtagaatgcaaattcaaaagcccaaatttgataagacactgttcatgcagaaaatacagcaaaaaaatattataggaagcctactgtagcatttaatctagaccttccattgagaaattgaatggacaagatcttgtgcagtccctaacgtgcagatgtagttgggactacatctgatcccaatcctgtgaaatgctaacttcttctcatatggaaatatgatgatgttcttcgctttttttttctttagtaattttcttattataatgttataatcagatgcatcagttgacattttaccacatcctgcaatacaatggattttttaaaaaaatatatttaattcaataattaataaagtgaaccttaatttgttttgagccaagccttaccaacttcactctctcacctagcctgctagtcatcatgcttgtggaaatagcaggttagtgcccatgagccaaattgcaaatgccattttgtcaaccggaaaccccatagggttaggttgtcattatccggtttggagtttgctcatcagctaatagaatcaaaggaaagaaaaatcggttgtcattatctggttcgcggtttgcccatcggctaatggaatccaaaggcaagcaaaatcgatttacctcgtgctaccttggaacaggtacaaccgtacaactagtggagtgcacattgggaaactaacctatcatttctttataaagtttggtacattccaaatgaattactttaaccaccatgttaagaccaaattgacttctgaaaggatcagatatttctttctgagaaatagttgaacagacattggagttcgacaacactctccaattattcctagtatacccgtctctgggtttctacatgattggcagctcagagcaacacagaaaatcattgtcatgaaactggggactgagttataataactaagggaaaaccatttgtgctgggaggactaacatgagagggccctgaatgggagtagaatggtgtccatgctttcctcctccttggtaatgttatcaaggctcaaactcggaggatgcttcgatgtttacatctgcatgctgacctgattcgcagagcagagggtcttcttcggtctgcaggaccaagtgttgtttcatcagccttctcagagcttcaagttcaattgccacctctatcatccttggcctctcttcacctctcgaccttaagcatcgtaaagccaattgtgcaacggttttaacatgtttcgtgccagcttcctcagctacttgagaatctacaatttccaacaactggttctgatagaataacatactaaaatgacatgctagatttctcacatcatctgtcctaccatcagatataggtttctgtcttgtcaatagctcgataagaaccaccccaaaactgtatacatcactcttctcagttagctggcttgtttggaaatattcagggtccatgtaccccaatgtcccctgcactaaagttgtcacatgggtctggttgtgtggtattggcctcgaggcaccaaaatcagacacctttgcagtgaagttctcgtcaaggagtatgtttgatgacttgacatccctgtgaataattggttcctttgtagctaagtgtaagtatgcaagtgctgatgcagtttcaactgcaatccttaggcggtcctcccatgaaatcaggacagatgtattttgaagatgagaaaaaagggccccattggtgatgaattcataaactaacaagggaagttctgtctcaagacaacagcctaatagctggaccacattcttgtggttcacttgtgaaagaatgaccaactcgtttatgaattgttccatttggttctgatcaactcgctgcgccttcttgattgccacaaccatttgattggataatatacctttgtacacgatcccaaatccacctcgaccaatgatattgtcatcactgaagctgttggttgctttctcaagttcactagaagtaaatatccgcagtggtgcaccttgagaaaacatcttctgcttcagcaacattccaccattctgcataaagtatctctgtcttatcttcgcaagttttctcttcttaacaagccaatgggtccagaatatgagaacaaggagaagcagtagcagagctagtccagtaactgcacagacacagaaaattcagggatctctactggatgcagcattaatcaactcaagccttcaaattgaatgattacatcattcacatggcaaggcagtgatacagggcttcagaaacttgcctattccaatcaacagtgtgccaattccattgcagccactgccctccttcaagccatcacctctcatccctgctgggcacatgcagtagaaactccctttcgtgttgatgcacttatgcgtgcatggcctcttaatggtgcattcatcaatatcttataaaaaaatcacatgaaaccagacgaaatcaggcatgagctattcttgctgactactaaattcaagaaacataagctgaggtaactagcatgaatgtattcgttaccttggcatccatcgggcccttgcaagtaagggttcccctgaaacccaagggagcaattgcagcggtatccaattccatttgatgagttatagcagtaggagttctccttgcaggcatatgacatgaagcggttcgcctcctcacagtagccaccatcaatggaccactcaagaacaacagggcggtattgaggattgttcctgttagtgttgctcagatcaacactagagaaaacataggagttctgctccacgatgaaagcctcgccacatgttggagtattattgacctccttgggcctgctgagctgcccagttatgttagtgaactccaactcaagcttctttaaccccttcggtactggtgcttggcagcaagccacgccagagcacataccatcaattatattgcttttggtggagcaaaaagaagcacagccaccgctatacccgctgctaccgttcaatagcatggctaccatatcacaacccagagctgtaaatttgtttcttgtatctgagaacgtgaaattggtcccctcaaggctgaagctagaattccttttgcactgctgagaagtggcactggccaagatgcttacaaaaccatccagcaacgagatgttaagaatcccaaacatgatattgttaatgcgtaccatcgggccagatgaggcacatgtgatctcaaacccttgggctggggcagggttcccaccaagaataccaaagggataagggatgggaatattggagcacttggaggtgcttgattccatcgaatgaacataagatgcaaagatgcatgtgaggaggagcaatggcaggagaagaaggtaaagcatcatctttgccattagtctttaacaagaaaaaatagaccatggcaatactgctatcaactaggatggaaagtttggatcatggaggagaatggactggaaatcggaggttaaataggtcacaggctcacaacctgaggaaccacttggcacgttactcaaaatattcaaggggaaggtgcaaggaatggcaggaaaaagctaacaagcaatttttctggcttatcccttttactgttgttgtcatattgcccttgactcaacggtagacttgctgcaagcatctttcagctaagatggagacatatgatcgcaagcactctcttccccaggtgcatgggctcacaatgaatatgaatatatcatattttttgaccgggcgaaaacagccgggttgacgttaaacagaaatgtttggtttcagactgatgaaaacatgaataagcttaagtcttaactaaattttactagctgacacaacagacaatggccatctgtttacaatctcaaggctgcctaccaatcgaagcatcgagcgctaaattttccatcttatacgcgggctaattgtctttttgtatagactgaactatccttaccttgccgtcagcgtcagacacagcaactccagcacggccacagcttctgcacgtcacctcatcggcctcaactcgcgggaggcggagcccgccaaccacctgcagttcagggccgtagggagattgattacccgctccctcgtcgcctccgaccccgcccgcctggccggcgcccggcgctcccccatccggcatcgaataagcccctctcggcggcgatggcgaggagagagagagagagggggggggggaggggggctggggctgggatggcggccgctttcacctgcggctgaggaggcggtggtggatgatgcggcaatggtgtgtgggccggaggaggagagagggggatagggccataggggatagcttgaaaaagcactatatcagtttctcaagttatttatcaattttatatatctccaatgaaattaagttgctactccgtagatcttaaactttatcaatattagcacatatgatattttttttagtaataatcctgaaaactgtgaatctgtgatggtgttcttctgacaggttccagctgattgctgaatagttaattagcagagtaatttgctcatttacatgtgatcaattgaaatgattcaatgctcatagacaggtcacagggcatgctcgtgtgtgctcgtcttcttgtttatctgatgaatgctaaaatacagatcaacgccaacacaggacatggaaggagagcaaatatggttcagtgagtagcaaaaaagtgattcagttttctcatatacgtgatcaacattcaatgctaaaatacaggacataaattggctctctaaaaagtatccacgaaatggagagctgattatgtactgcagtagaacaagcagtcaaataataactttggtaatgtaaatgtatgaagatgtatgcgaagtatatcacaatcctagatctgttcttgacacaaagaatgccatatataacacactgtagaagttttcagaactaccaaatctggttattgacatatactgtgatacgacggttaacagcgaagatagactgtttacatcatttggtgtacctgttctgatatgttacatcaactacctaaatatgtgcttctgaacataaaggtgaaacaggttcctctaaacagtaaataactactacatctgaatataggtgtagcaatatacatgacaacctattgattgttggctatgtatgtaaaaattcaactaaacagacatggtataaaatgctgaagttagtactttacagtacaggagacagccaatccaagtagtggtcaccattcttattgctctgcgaacaagctacttcagggaggtggttggctattctccggagaaggtatccatcagattgcctaatcaagatatggcatttggaatggaatacaactaatggttctcaatctttacgtcatccactgcagtcagagatgagcacgtttgatgtatgaacattatgccacagcaatgccagagaatgtacatataaaagttgcaaagtctgaaccagatcaaacaatgccaaccatagcaagctaacgctgtgcatcccgtatggcaggactagccactctggcacggtgagcgatagaaagagatggcctcccaacagcttccattatcctactgaagacgacctttgcaggaacacacgtgacaagtggaattgctccctctggtttgatcaaatcacccaaaatattgtgcagctttgcttgacgaccttctctgtgatgcctttttccaattgaaatggaagaaagggctctgactttctgacttgatgagcttccttttttggaattagagggcttcttttgagatctatgtgacaatgggctccgaaaactggtgttgcttcgttttgaaagcctaaactgctgattgaagggggtggaggatctactaaagggcggattcatatcccacaggccctcatcgtcaccatcatccaaggtcacccgtgttgaattagaacgtggaattcttggcatagcagtccttctgcctgtacgccaagcaggtgatgcagaggtgctatgttccagaaaatcatcactggccaaaacaaggtggtcagttgaaccatcttcaagtatttcaatttggataggatgcccaactattgctttgccattcagtctgctcatcaaagaaaccaatggaacatgctccccttgatagccagcctgtacattcaggtcaacattaaatagcattgggcccatgtaaccaagttgggaggaataattttgtcgatacaatgaagctgggctgcaggaat

SEQ ID NO: 87337 - DNA, 3078 bp, Oryza sativa
tttatatccgactcccacgctcccttcccccattttccccatcgctccagctccttccacaagttccactgcaattctgcaaacgaaccagctcaaatcgaagctcgaaacagggagagccagagaagcgcgcgtccgcgacggcgagtacgcaggcatggacttccacgcgctcccccgccgcgacctgcaggcgctgtgcaagcgcaacggcgtccgcgccaacatgaccaacgccgccatggccgatgccctcgccaagctcgccacggtaagccccgtcaactgttcgaccggccgtcgcttcagtcgcccattgccgtcctggattttgtttggtgcgggatgctcatgtgctacctcgccgggcccttcgcgttccaggttgatgggatcgaggagttcgtcaagcaggcagtcgccctgccaccggcgccggcgaccaagccggcggttaaggcggtggcggaggaggatccgcgcgagaagaaggggagcccgctcccgcgcggccgccgcgtcacggtcagctcgccggaggtggtcaacctggacgacagcgacgaggaggctccggggcagagtaaggacgcccctctcccccgtggccgccgcggcacggtcaggtcgtcgaagctcatcaggccggacgacggcgaggaggagggcaaggaggacgaaaatcggggcgagaacgcgcctgtgcatggcgaggggcggcgcggtgccagcaggcgcgcccgggccgagcccgtggtcgctccaactacgaggagaagggccgctcccactagtaagatcgagacaggtgatgtggctgtggaagcgccaccggctccgaccactcgccggaggccgcagactagtacggaggctgcaccggcaccaaccactcgccggagggcccagagtactgtagcagcatctgcagaggagaaggtgccgaggggtagacggacgacgaggagagcagcggcgaagaagcccgatatgctggaggaagaaaccagagaacctcttgcgcctgagcaaaatagcgcacacgaggagccagtgcaggaagagcaaggtgaaatctcaattctatcaaccatttcgctcgaaacttgtaatagatccatttcattattatgtagttttgaggtctgaatttagtgtgcatgttgttcaattggggaaattcaggaattgaagtggaggtgcctgcagaaactgtcgaggcagtagctcaggaatgcttgcctgaccctgatgcagtagttgaagagaagccggtgcaggaagaggaaggtgagatctccgttctgttaacgatttcactagctccatttcattcttctttagttgggaggtctgacttgagtgtgcctgttcgattggtaaattcagggatagaagtggaagcacctgcagaaactgtcgaggcagtagctcaggaatgctcacctgatgcagttgtagaagatgagcaggcagctgtcgaagctgaacagactatcagccaggatgattcgcccatttttggcatcgtgactgggacaattgttggagcgagtgaggaagcccctgtgtgcaacagtgagtgtcccaagaacatggcgactgaagagagttccgacacagttagtgaagagaaggaagccgtgcctgctgatgaggtgccgctggttacggtgacatgcggcgaagcaactagggatgctgaattgcccaccaatattggcaatgccaaagaagaggatgatgatgaaatggaggctgcgcatgaggctggttttgcggttgaagtggacggatctgagactgttgatgagctgattggtacactgacagagcatgctgacaatgccattcagcttaatttctcagcagagctcagttgtgctgatgaagaggcgggagtatttgccaccgatgatctgcagcagagctcagcgactgtgaagactatggtggcagacagcgaggccaacgaggaagaggatgcactggaagcagaaaatgaggtcggttttgcggttgaggagaaggaagttaggacaggcgatgagccgcatgaaacactgtcaaatgatgctgacggtgccattcagcttggggaggatgcactggaagcagcaaatgaggccggttgtgcagttgaggagaagggagttgagacagttgacgagccacatgatacagagacaaatgctgctgaaaatgctcaagaggagggagttgtggccagtgaggatctgctgcagatttcagagaccgagcaagatgaattcaactcggatatttgccatgccgttgaacacaatgaaagggacaatgtagaaagtgtgtcatcagagagggaggatgtcagtatggagaatgcgttcaccggtgacctcacactgaagttcgacggtcctggagacttgggtgatcgcaatacctctcttttggaagagggagctcggaccttgccactatctactgaaacgcccaacaatgtcactgatgcggtggtcacagctgccgaggaaatggtgtctgaaaccatgggtgtcagtaataagaagagtactgaactagctgcaatggaagacggcaacgaagtgaaggttgtggagaagcagaaggaggatcctgtggaactagttaaacttagcctaaggactcttagagccaagctcaaggagcagctgactaagcacaaggtaatgacacctgaccttatttatgcactgtagactatctattatataattaaaggaatagaaaaaggagcctccacgttcgctctcatggcttagaaattctcacattaatcagagaaaaagaaaaaacagagtccatatagaaatacaatttagaaatagctaaaatctggaattaaaaattaaaaaataaggaatattagaagaggagactagagtccatatagaaatacactttagaaatagttgaaattcggaattaaaaaataaggaatattataagaagagtatagagtccatatagaaatacaattaggaaataatagaaattcggaactaaaaataaggaatattagaagtagagtatagagtccatatagaaatacaa

SEQ ID NO: 87338 - DNA, 538 bp, Oryza sativa
ctaaaagtgcttggcctaaataggttactgtctacgaacaatttgtttaggtaggtcatgttgattctggcaagtcaacactctctgggagactgctacatctgttaggaaggatatcgaaaaaagatatgcacaagaatgagaaggaggctaaagaaaaagtaagtttattattgttgttattgtactctacttgatcctgatgttccattcatattctttgtattatggaaactattttttaccagggaaaaggatcatttgcttatgcgtgggctatggatgaaagcagtgaagaaagagaaagaggcgtgacaatgactgtggccgtggcttatttggagactaagaagtaccgtgtagttttgcttgactctccaggccataaagattttgtaccaaatatgatatctggcgcaacgcaagctgatgcagctattcttgttgttgatgcttgcactggttcatttgaagctggcatggacggtgaaggagggaaaagtgttggccagacaaaagaacatgctcagcttattag

SEQ ID NO: 87339 - DNA, 8392 bp, Oryza sativa
aaggatggtcttggactgggtgattgggcgcgccacctgtgagcaagcccggaacaacagcttcaagacacagtaccgctgcaacaacgagagctcatgcatggacaggttcatgggagagggctacgtgtgcagatgcaaagcagggtacgaccaacacaacgggaatccatacgaggcaggcggctgccaaggtaaatagtagatacttctaaacacagtgatctaaaaaatatgcactagctagtgaaaacagtttgttatagtttctttctgtttgtatcatggcagaattcaattaccatagaacttagctaactgctatgaatagaactgtatttttctgctttctcaatgtggcttcacactatttatgaagatatcaacgaatgccggtctctcatttacaacaactgtagcgtactctgtcataacactcccggaggatatacttgctcttgccccaataataagactggtgatggctacaggacagggacagggtgcattgactcccatcggccacctggtaaatacatgccatatattttttccgactgcttttgtttaagataatgggatatttttttagattgcatataatcctacttattctagaatttctgttcaaacaaccatattaatcaccacgtgttatttctagaccaattttgagataagttggaaaactcaaaaaaaaaaaaagcttttaaacggttcttcctgggtacttttatgtttgattggatgagaaaagatgaaaggtctaaattgattctactaccaataaataccacagtaagaattttgttccttttaacgtgactatgcatgaacttaggattgcctgggtgataggagctttgttccctttttacttaaagaaatgtcaatatgaattgatatatttcttccggttgaaacgctaaaatgatattgtatgcatctcctatatatggctggattacgctgtaatatttcttctctaaaaaaattctgcaatagttactcgtaataatgcgtgatgatctgaccaagatcatatattctctctctcatgcaggcgcccctacccacaaccaaccgcaaggtatcataaaacaaagtgctttgttcaccacacagaagagcattttaagtgcagtctttctaatcaggaaattattatttgttcaatgtaccgggagaacgttcgaaatcttgtttacaacatctaataatgaaccagtagcggcctaatcatttttcatttggaaaacatctcctaattgcatgcaatttactattattaggcctagatgtgtgcagagaattgaacccttgcacgtactcaaaatcctgcaaggatgagcaaggagttacttcgtgtgtttgcccgaaaggcatgatcggcgatggccagaagaatgggagtggctgcaaaaagcagtttcctttatataccgctttgggtaaatatgctcaacacccggcattccacatcagatcattcattttctctcttttatttttaattcctctgctattaatacagttgtcaaaaatatctcccgtgcagaactgctaatctacagtatatagccgctgatgattacgtcattactaacatgaatgattgaacatcatatagatatgaccagtgtattgactgcattcatgattaatgattcagttgagctagcaaaactagattagacatagctaatgacgataaacattaaaaatgtgttaaggttgtaaaaaatacctcaatattgtttctggacgaaagaattgaagtcggagctcataaataaaccggaaccatgcacaaatcacaatttacaatctgcagacaaatagtcgttcggtcaaaggctcctaatattgattgcaattttatacttctttttacttccacaagatatcattgagaaataagactaacacaagttgtgaatattctcatccagtgtctgcaggtgtagctcttgcacttacggccacgctagctacagtgttgttgtgctactacttgacaatgaagaaaagaaaggtggaaagaaacagagctgagttattcaggaagaatggaggattgctactgcagcaaagattttcgatgatgacatctcaaggtgaggattcatcagcgaagatatttagtgcggaagaactcaaggatgccactgacaactatagtgagagtcggatccttggtcgaggcggaagtgggatggtttacaagggtatccttccaaataataccacggttgccataaagaagtccatcttgtttgatgaaagccaggtggagcaatttgccaatgagattaccatcttatcgcagattgatcacccaaatgttgtcaagcttttgggttgctgtctagagacaaacgttccgttgttggtttacgagttcatacctaatggaacactcttccagcacatccacaacaggagttctttaagatgggaagattgcttaaggatagctgaagaaacagccgaagcacttgactatctgcactctacatcttctacaccaatcattcacagagacatcaaatcaagcaacatacttttggatgagaacttgatggctaaaatatcagactttggtgcatcaagatcagtcccatttgatcaaactcatgtaacaactctaattcaaggaacaattgggtatctcgatcctgaatatttccaaagcagcaagctcacagagaagagtgacgtttacagctttggagtagttcttgcagagctattgacaaggcagaaacctatttctgcaagcaggccggaggaatcctgtaacttagccatgtatattgtgaatttatttaatgaaaggcgtctactacaggagatagagccacacattttggcagaagcaggtgaagagcagatacatgctgttgcccagctctcagtcagatgcttaaatttgaagggagaagaacgaccagttatgagggaagtggcttcagttctacatgggctaagagagtcgtttgacgaggagcaaatcatcagaagaagcaatgaatcaatacagataactaatggacaagacagtgtacatagtgaggcaagaccaattcccagcttgcagtcttcaggggaaattaccactgagtacagcttgccagctgaaatactgccttcttcttacttggcaagatgatgctcttattacgatactgtaaaggaattttgtaaatgttcacttccgtaatttttttaggcaaaagatattagtgcgcacgtctgtgttaggggatcggcaaactgcagccctagacctatcaagggtgtttgtccctaaaaaaattggttgaggccaagccttccaacttccaatcctcaacctctgacctaaccatcatgtactataaatagttgagtatgaaccaacttcttgtcgagcagtaaacctacatggttgatggttaggattaggagagtatacctcatgctttgacttaccccaatgagcgtggcgcggttggactgcttggccgctccgttgctggtgattagtggcaatcccctcgggcttgtagaggtcgaatccatcttcgctcgcgttctaattgcgttttgttgctacggcggcggcggcggcggcgatgcgaggccggaactcacgaggaggacaaaaggtcggacaggtgggcccttgtgagaatatgggttgctgcgacgcgacctatcgaggaaggtgtggttcgttatagacttaaagttgggccagaagcccataaggtgattgctgcgaactgcaggccgtgatggttcggccttactactcggtgcttctgggcgatccctcggccttgggctggtagcaacttcacacagagtcggcaaagtttccttcttgtatacgtggccttagattctcgagctcatatggccatcatcaattcaggtacggcacatgcaacgcaacacagagagcatagcaaggttaataatatagtcgaattgttaactataagattctttatagctttctctcagcctacccatataatagttagctctttatagccgatttatctctctcacagagtttcttggttcttgtgttcaaaccggcggtaagtttatagcccgcttctcctctctctcctctcctccatctcagtatttagccggcttatagtctactattatacttgctctaattcacgagtaaatttacacggaggaaaccgtggagggacgcactcgagatggggagacgatgggaaccagactagccttaatgttgacagcggcacgcattcaccttaatgttgacagcgttttatgctaagttgctaacttgctatctgctcgcagtagctttttaaaaaataaagctcaagccttagcattggccaccacatacaagagcgctaccaactgttcgatccaagtgacgtgaaagaaaaagagcaatgaccagtgtaacaggggcgctaccaaatacttttatcttcccaaaatataagaaattttaaatagatggggcacatctcagtactataaatctggttcatctaaagtcccttatattttggaacatacatttatattttgggacttttacgagaggacaacgattgcaaactgaaacaaaggcgaatcatagctttcgagatttcttaccttttgtccttttaaaaacttatttgttattttacaaatagatttataaaaaagattattctaaaaatataccctattcacggtgccagtattattggcgtcatggtccaacatgacagcgtcaataacaacattgatgttgttgtcctctctccctgtaagtcaagtcattatatgaaggggttcagcgtcactgacaccgacatcaaggatttatttgaaaaaaataaaaatgacctcataataaaaatattaataaataggtccttgacgtaagtgtcactggaataggaaacctatttgtaatttgtaataaaaatattaacattttagttattttttttacaaattgctccacagcaccattgccattggagtcaaccccttcacatagcagcttagctttcgcgaggagcgagggggtaacactaatattattagcgccgtcatattagaccataataccgacgctagcgccgcgaaaagggtctatttcttaagtaggtttttccaatgatttatttataaaataaatttttagatggtctaaaatgtataaaaaaaaattctgtcatagcttccaaaagtaccgtgcgtccatcaagctgtcttcttccaagggcagccattatatcgagtgcatagtgtgcaatatctttgcatgatgggagtcacgtcaagttgcccttctccgaagagcgagtgcatagtgacaaacgactcgtgtgttgagatgagaatcaaaatggaatcaaatagttcaatgacaagttgccatcctttacatatggcaaattttgctacggaacacgtaaaaatcgtgtaattgactggaagatactgtaaaaacgtaataatgcccatagacactacaaaatttatgtaattggttgtaaaacatcggagataatattttataattttcgagacaaaagagaggagggaattttctaagggcctgtttggtacaggtccaactcctaaatttaactctaggagttgggtctggagtggagttgtggagttgtctaaactcagctccacaactctagtccattttgtgagagagctccacccagctttactcccagttttggtggagctgaaactgtttggctgagttccagcttcagaaggggtggagctggagctggagttgtgccaaacaggcctaaatggccagattacccccgggttttgaaccacccatccgccgcgcgcacgacgggcacgacccagacacgccgctgcgcgcgtgtgcaccacgaaacaagtcgaacaagattgatccattcgctaccaagctccggctggtaaacaggacaacacagtatgaaggggcacgcagcctcggtagttacacccagcaaattggccaatttgggcgtctaggcatctaacggtggttccgtcatcaacatcacgcacgaactgctttcgttcactaaacagaatttcctggacgtcacttttacaacagacgacaacgatcacaaaaaaagaaatggcgcaaactcggcctttggaaggactatgcaacatgcgtcaacaatgtactactacgtgataatatagagtcgcacgtctgatcaagccccgtcaaacgaagggtcaaagcaacccgtgagcagagagagcgacctcaaattacttctaacgaaatggtggacctaattaaatagcatatcaaatataagggcgagttataatatggaaggcctgagagtatgcatcccaaaccacattatatatgtatcccgctaaagatagttcatgtggttctttccttgtctaataaagccataatgatggagcattaagccacatcatttatgaattaaatttgaaaaatatactatttatttatttttttcagaaatattcatgatataattttttccaaagatatatcgtcgatgctgcataacagttacacaaaaatgatgtgtgcgtgacattgcgggcggtatcgcgtggtgagattgcaagaacgaacggtctcgcacaaccaacataccatgcgagaccgaaacagtagggtcaattcttagtgattaattagtgtctaattagattaattaatcgctaatcatgatcattagttgagactgtttggagctggcgctgtttttggctgcggtgtggctgggttgctacgcgagaccgcccgtgtcatcaagttatttctgcgcatcggttttacgagattgacggtatattttaaaaaaaaattgtatctcgaatattttttttaaaaaataaataaacattatattttcaaatttagttcgatcatttatatcttttctaaagctatgttattttagttatttctagttcttgaatgattgattgaagatgcaaatttgatgaaatccaacctactatgagtaaagaataaatccagcttcattttatttaccacgtggtgataaaattttctcacgactacagctgcggtattttgtttatctagtttttctctccctctatctgtctgttgatgtgaaattcgttgtacacgaaggctctaacgcagattctaaatcttgataagatttggacgtggcaattattttgatcttgcaactaataaggatgataggaataatcgaaccaatgaaccaatcagctaatagtgtagttgatgcagattcgatggtttaagcatacattgtatggaggtctgatgcaagtagattaaaatatatatcggccaactaaccgatacatctgataattgaaccttagaataatgataactcgacagctagaaactccgatggatgtcgcataaaaacttattaggcttactagaattaaacttataatcagcaatctaacatatcaaacctaactgagagagtacaaaattgaagagaataagaaaaacctatttaaccgatagatctacacaacccatgcatattgtcaacgggctatacctgtagacgggatttgtagagtatggggatcgttagaaccaggttatacgcgagatcatatcaagcagacaaggacaaatatttatattggtttgggctcacaaggagagtaataactctagttcagtttatatggatttatggatgggatgtcacaaatattacaatagggaatagagcgactagaataatctgccgactagaagccgtcaagaacggcccgacgagatatattcgacgaatataacttattgtttctcaatgtggctttagctatcgcttgtaactcgattcccctccatgaatcaggacttgtaactcgatctcatgtccgatcatgacttctggcttcctccggattgcttctcaatcgtacaactcttcaactacctcctttttcttcctcctcatccgatccccttcttcttctcttgcgaatagtagaggcggcatgggcgagcacagcgaaggaggtggcgcttgcggcacagatgatggaggcagcgtgctcgagcactggattccggggtggcgaaggtggcgctcgtaggaacgacacgagcggatctggcggcagcggcgtcggccctcgcgagcacgactggatctagcggcggcggtgtcggcgcttgcgggcgcggctgaatccggtggcggcggtgctcacagcgaatccggcgatggcccttgcagctggatctccggtaacagcaactctatccaggtgctttgagcctgctccttgtgttattcccctttcacatggcgggttcgtcaccttcttcccctccccatggcgacaa

SEQ ID NO: 87340 - DNA, 2036 bp, Oryza sativa
ttgacaatgtggtgctacagtaaatatgtgctaataacggattaattaggtctaataaattcgtctcgcagtttactgacggatactgtaattagtttttttattagtgccaaaacaccccatgcgacaccctatataatacctgatgtgacacgccaaaactttacacccctaaatctaaacaccctctaaaccaccagcagactacatcatctttcatttggaaaaacttaattgcatgcaatttactattatatttacttattattaggtctagatgtgtgtgctcacccagaaaggaacccttgcatgtacccagagtactgcaaggatgaacaaggagtaacttcgtgtgcttgcccggaaggcagaaatggcgatggcaggaagaagggaagtggctgcaaaaggcactttcctttagatactgctttgggtaacatactcaacacccagcattcttcatcagataattcattctctcttttatttttatttctcattcctctgctattaatgcaattgatatataaaaaatatctccattgcagaactgctgatccataatatatagccgttaatgattacatcattattaacatgaatgatgaaacatcgtatagatatgaccagtgtattgactgcattcatgattaatgatacaattgagctagcaaaactagattagacatagctaatgacgataaacatgaaataatgtgttagggctgtaaaaaatacctcaatagtattgtttttgcacgaaagaattgaagtcggaactcataaataaaccggcaccatgcacaatcggtcatagaatcctaatatggctcgcacttttacattttcttttttttaaaggaaaacttttacattttcttttacttccacaagagatcggttaaggaagaaaattaacacaagttgtggatattctcatacaatgtctgcaggtgtaggtcttgcactgacggtcacgctggctacaacattgctgtgctactactggacaatgaagaaaagaaaggtggcaagaaagagagctgagttattcaggaaaaatggagggttgctactgcagcaaagatttttgatgatcacttctcaaggtgaggagtcatcagcaaagatatttagtgcagaagaacttaagaatgccactgacaattatagtgatggccgaatccttggccgaggtgcaaatggcactgtttacaaaggaatccttccgaataggactacgattgccataaagaagtctattttgtttgatgaaagccatgtggagcaatttgtcaatgagattaccatcttatcacagattgatcacccaaatgttgtcaagcttttgggatgctgtttagagacaaaagttccgttgttggtttatgagttcattcctaatggaacactcttccaacacatccacaacaagaggactttaacatgggaagattgcttaaggatagctgaagaaacagcaggtgcacttgcctatctccactctacatcttctacaccaatcattcacagagacattaaatcaagcaacatattgttggatgagaacttcgtggctaaaatagcagacttcggtgcatcaagatcagtcccatctgatcatactcatgtaacaactctaattcaaggaacaattggctaccttgatcctgaatatttccaaactagccagctcacagagaagagtgacgtctatagctttggagtagttcttgcagagctgttgacaagacaaaagcctatttctgtaggtaggccggaggagtcctgtaacttagctatgtatattgtgatcttgcttaatgaaaggcgtctactacaggagatagagccacagattttggtagaagcaggtgaagagcagatatacgctgttgcacagctctcagccagatgcttaaatgttaagggagaagaacgaccagttatgagggaagtggcttcagttctacatgggctaagagagtcgtttgacgaggagcaaatcatcagaagtgatgagtcaatacaga

SEQ ID NO: 87341 - DNA, 2028 bp, Oryza sativa
ttttgtagattttcaattccttcatcgtctctaccctaaccatcatgaatgtggaattagttgagtcaagtgcccatgagaccatggaggcatgagccaaatggcaagtgctaactgctctcgtcaaccagtagagctgtaggtttacctgtatttcccatggaatttaaaggagggccaaagtgttctatacctcatgctttaacttaccccgatgagcacggcttgcttggactgctcggctagtcggctgctccgctctggtaaccagaggcaaagtgtcctcgagccccgatggtcgaatccatcacttccactcgcgttctggtgcgttttggtgcgacggcggcggcgccggggacaaggagaaagaaaaaagtcggacaggaggcgtcccgctatatttccagccgttcgatggattgtctgcgcgatctgttctagttgggccggaactggagcgcgaggaacgtgcaacacatagtttattgttgggccataatgggattgcagcaaacgcccggcctgtgatggtctgatgggattgcgaggaacacggagtggcccaactaatctcggaagcaggggtgatcgaagtcagtagcatcttttggaaacgacactttgattgatctaaattatttagtgtcgagaaattaaaaaaaattatatatacctaaaaagataacagtaagaaacggtaccctttatacgaaaacggcactcgatcaattggaaattttcacgaccatttccgaacccgcatgcactatcatgataaagactaaagagaaaaaggcaatagaatttcaactaaaaattttgagggaattttggcatgccgatgtagagaaccatggtttacataaacaacaaaaactagataaacttttagataaaagtggcatacttttcaaactgttaaacggtgtgtttcgtacgaaaactttctatatgaaagttgttctaaaatataagattaatccatttttcaagtttgtaataattaaaacttaattaatcacacgttattaacacctcattttgcataaaacacttaatttttatctttgttttcattttcaggagattcaaacaccacctcagttgatatattgtacactaccatgggaggtccattgatagaagtggactgctctccatgcatttatccgaggcactgtccctgtggtacaacttcagcggctcaatgttactcattttttcctggccgctctcctcttgaagcaactgcatctcttggcaatcttcagcagattgctgctccataagctctctcaaagccttttcacttttcagggacaggtgttgtttcattaaccttctgagcgcttcaagttcaattgctacttctaccatccttggcctctcttcccctttaagcttcaaacacttcagaatcaaatgcgacaccacattaacatgcctcattccagcttccttcaccacgacgcagtccacaatctcctgtagtcggttctgctgggcaagcgccgtgaaatgtgaagctagatttatcccttcctcttgcctatgataagatatcggtttttgtctagttaatagctcaacaagaaccacaccgaagctatatacatcgctcttgtcagttagttggcttgtgtaaaagtactcagggtccaagtatcctaatgttccttggactaaggttgttacatgtgtctgattggaagggactagccttgaagcgccaaagtctgataccttcgcggtgtagttctcatcaatcagtatattggcagacttgacatcacgatggatgattggcacctttcttgctaagtgaagatttgcaagagctgatgcagtttcagttgctatcctaagacgatgctcccatgaaattggtaccaaatttgtattatgaagttggtggaacagagctccattcgatataaattcataaaccagtagggcacttcagtctcaagacaacagcccaatatcttgaccacatttttgtgatcaatctgtgaagaactatca

SEQ ID NO: 87342 - DNA, 4329 bp, Oryza sativa
tggttttgaagatgattggatttacaggtgaattacaggtgctatcattttatgtgaccggtcagaccggggtgcgtatgccggtcagaccggcagtgatcgagcggtcagaccggccagcccgcggtctgaccggccgactctgtgtcggtttcggtttcgggttgtttgtttggatatccgtgattatttcatgattatggcttctagatggatactatacgtatgtaatactgttgtttgatactaatgagtcaagttggagatagcttggtctccgaatatggtttctttgtttatttcatgtgtaggtgactcgatgtctcgggagagtatttgcggtgatggaccgggagtcggcttggggataagacgacgtccgtggtggtcagagatcatgcgggatacttaggctagagttgatgcacgtggttgatggagattccatatggcatacgatggagttattatgtgcgtatgggatgcggactcgaatttggaaggagtccaaatttggtatgattggttatgtaaagtttgtttcttgtactagagggtttcctaaggtgtttaggactcctagtatgagtttggttcgtggctttaggctgcctacctcatgtataaatagagggggagcgtgaggcttcccgatatcgcttttgagagcaattaagttgagttttgagttagggtttcgagtttagtcgaaatttttgtaaggagtgttgttggtgcactttgtaaacacagagagaatcaataaagtcgtcatccactttaagagttcttcgatttgtgtttaccgggtttcggcggtctaaccggcgacacaccggcggtcagaccggcgacacaccggcggtcagaccggcggcaatgcggtggcagaccggcggcgacagcaggcgaggcaggcgacttcggcggttcgaccgatcgatctacatcggtcagaccgatgttcatcaggcggtcagaccggcgcaacatcttcggtcagaccgcgatccatcgatttcgagggtaacttttatttccgctaaaagtttttgttttttgggtataccaactattcaccccctctggttggcttagttattgctatttgatcctacactctctcctccaccgaagcttatagtaggcttatagcttactattatacttgctctgatatagtagcaacgacaagtgtatggtttatattaacaaggtgaagtgagggcggtggaagggtaattgatcaatagtaagagaataaggtggtgggcaaggacaacgttaaccgaggatagtggtttggagtggctagccaaaacaaaagatgatgggggcacacacaatggctacaacagcgactaccccacacgtacgtattactctccagtgcatcattacatcatcacggttttttttgattgggctagtgggcctcagatggccttttatgtgcatgttatgttgaatactacattcagcaaccaatgacaactaactgattcaatacccatcgtcatttccattaggaacaccacaacgtgaaacacatttgaaacgacaacatgagatgacccgacaagatgtatagaaataaattttgttagtaaacaagctttccggttgttttgttttattagcaactcctaaattttggtcatgcattttttttaccaatggtttgaacgtggagagaaaagaggtactagggttacctggttgagcaaatcttgaagcaattgaaacaatccaaaagtaactgtattagaaaaagatatgaataccaaatagacaatgcatttgctttatacctttaatttgttcgagcaatcaaaacctaaggaatgtttgatttcttgtctatgtatccattggaattgtctatttatatttgtttgtcacaaaaatgttgtaagtgaaccaaagcaaacaaatccataggtaattttaaaattttgacaagaagtcaaataaccgtgcattaacaaaaattagtaaagtatgtattgctttcccccctcctcctttggattggtgtatttttaatgaaccatacattttcaaaggattaggtactattaatgtcttttgttgtagcagggggtaaacaccatcctcccagtccggtcaaaacaccaaaggaaaagaggtcttaagaattctaagtgtccaacttggaaaaagctcgtgactcagaaattaccatccgagtggtaaagtaccattaaagtggtaaaatactatcctagtggtaaaataccattcgagtggtagagtaccatccgattggtaaattctcatccgactagtaaaataccattcgagtggtagagtaccatccgattgataaattcccattcgattggtaaaatactattcgagtagtaaagtctcactcgagtggcaaagttccatccgagtgggttttcaacttgtgactggtaaatttcaagggcccagcaagtgagaaggaatgtatgaactctcaagatggaaagtgcgtttggccaatgaacttgagggaaaacactactcgagcaatgaagataccacaagaagattccgtggaggccactcccaactacttctatcagttgccgccaaatgaccataatgacctctaaaatgtatcaaaatgtccttagggttgctgacctggcaagggcattatggtaaactcatatatccataagggcaaagttgtaagccggccaaaatcctatagcaagacaagaatatcaatcactaaagttgtgcattttgtgttcgagctcatttcttatgataagcggagaaaatgaacttttccgtctatcctcgaacttgtccatgactcaaggtcacgacatctttgtaacacaagaagaggaaatctagaggaagagatttcctactcccatcatcatttggggaatatggacctcttctcttcctttttcctctcgtgtcggatcggcgtaaagtttcgcgagtatactttgggggtgtttgattgagattgatataagttgatgtggctatcgctacagctacaccaacaataactagtatagcaaatctatgctaggcctgttgcggcgttgtggtgtgccatcgctgagggcaccgaacacccgctttctcaactacggtgctagtggagtattgttatatggatccattgacaatagatccattaataatagcttagcatgttgtaaaatgcatacaaattaatatccactctagaattcctcatattcccgtgttccaaacagcttgtcctattgattttttgtgtttataatcctacagttttgtatgcacctattgatctatttctatgtttttcgtaaagctatgtttttcctatcatgaaggaggcttaattcatgaaacaaggggctaaaaagggaattcagctctatgtacttcagtagtagaggtggaagtaacgagctgaatcattggtggtagagaaaaatacgtgaacggcatctatcgtccagaccagatccgcatacaagtgcaaccacgctaaaattaactgacccaggcttttctgcctctcctggctcccccctgctggccctgcctccctgcgcgagaacatgcaagcgtaatgtttttgcaactgatgatccccggatagcagcgcagtgccacttatgatgccgagacgacagtgcaatttgaccgacgcctaccacaccgctgctcttaactttgttcaaactgcagtgcacagtgcagtgtgctctctcttcttaattcaccgaatgggatgctctctctcgcacgcaggcacacagtcgatgtgcatgcgtgagacatgtttgtccggttgcatgcattgctcgccacttcgcagcatctccactgagatgccgtctcgagcgtatcatgtctatctgtaaactgctgctcccccagaccaccagcaccaccacgccggccgtcgtcgtctgtgcgtgcatgcatgcacacctctcaaggcacatatacgcaccggcatcgcggccgcgtacgtactcaatggggcacgtgatgaactgacgagcactggactggtattattcctcccaattgaatcgttcatcagagagctctcactgcttcttgcactcccatgtgcatagcagctatagctagccggaagatgtgcagatgaattcatgaacttgaacgtgcaagtgcaattgtgcaagtgtgtgagcatatcatgagtgtgggcttcagtagaaaatcgcagaaggctcaacagtttgctttttttgaaacggcgatcggtgactgtgtgcacgcaattatatactgagaattctgagacgatatgtgcgaacctgcagg

SEQ ID NO: 87343 - DNA, 524 bp, Oryza sativa
cagataactaatcaactaactaaccggtggcacacaagattactgctaacaaaactctccctaagcttgatgtgccgattatacaggaaacataccaatttgttcccgcagctcctgaaacttgattcgagaaagcggcttcgtcaggatatctgcaagttgcccttctgtgccgatgtaactcggtgtgatttccccattctccacggcttcacgaatgaaatgtaattttgtttgaatgtgcttacttcgatcgtgaaaaacagggttcttcatcagggccagagcggattggttgtccaccctgagatcgacgacttcagttgctgcattcctgaggtcaccgaggagccgggcaagccaaatgccctggcatgcagctgttgcagctgcaatatactcagattcacaggaggagagtgctacaactctctgtttttgagactgccagctaacaggatttttgccgagaaagaaaattactcctgtgatgctcttgcgagtgtcaatgtctccagccatat

SEQ ID NO: 87344 - DNA, 989 bp, Oryza sativa
ggtcatacgaattccgaatcgacccattcaagtctcctaatgtttgttataacctaaagaaccctatgcaatctttttatgtactgttattgcttctttataggcttgtagctttgattgtgtgctttgcgtagctttcgtcattctggaggttcccgaagcgtggtccgctatcgtcgccgaaggttcggaaggtcgttctctcttagcaaggcaagtcacatcacccttgagcatattgaatcccagtttataaaattattttattttaaattattgcattaccgctttatttaaattcccgcgttatcactgtttttatttagcacttcctattaatccttgttatagccttatcattgctattgtttattatcaccttgttcaccctaggaaaataaaaccccaactagtgggtaatccattcatggttccactagtatgaatttaggtagatgcttcgctgattaattaggcaacactaggtggttttataactttagactttgggagttctcatatcatttggacattatggaatggttggcttgtgatggaattgaacacacacctcccccttctctacaaaactcccaaaatggttttaggctgggcttaaggtgcatggttttgttagagaaccttggccaccataagtgtcacatcctgattttcgtttcaggatttataaattatttaataaattattaatagaatttatattaagtgttctttaatttacaagtgaagttaaatgtgggaaataaaatttcttaaatttaaagcatggatggatttaatttttgttaaattctccatggttaattatactctctgaaattttctcggatttttcagagctcaattcttaaataatacaaagaacagttcagtaattatttgatcattaatgatctaattataattgttaagagcttttcttgtttaaaaatccttaaattataaattgttgtttaaaaaggaattat

SEQ ID NO: 87345 - DNA, 2965 bp, Oryza sativa
gtatcttcatctacgtccagaaaattccacatgaatttatcgtgcccacaaattaaactatagattaacaagagaggagagagatttaaatcctgaaaatcgtccaaaatcgataacacccaatctcctaccctcctctctcactccagacttgttcccttcgcccttgacccactttcagcctcacaagctcgctccacctgagtacatgatgccctatgttaggtactctaacgatttctccctcaaatttactggacaattgttcacgcatacaagtatcgatccacaggatcgttctgccgccgcctacgccaccacgtatccagttaatcaccttctaacatccacctatgttttttatatacagttaggacaacaccacacggctctccctctctcacatgacagcttggctacttggcccactgattgccgaagtagcgtgggttgggcctccgacgtcttgggccgatgcttggcgccgtttcctgtatcggcacgatcccctcctcgcctccagcatcttgttctgcttctccagcgccttgtccctcctcctggattccttccaccgtgccatcgtcttgttcatcagcggtttgatcggcagtcttcccgtccagttcatgatcgtcaggcttcctgtggttgtggcagtcttgagtcttcagaggaggcctgacaagcccccatgcttggaaatcggcttgcccccaagccggtgcatgagggaaccttgagtgaagatcttgcatatcctcccatgtggcgtcagtagctgctcccatgtggcgtcagtagctgcacttcctgtccaatgagttagtaactgaataatgggacagtttttggtgtgagatacgcgatagtgaagaaactgctggggaacttgaaatttggaaagagcagtaggaagttcagcttgcataggacaagaaaatccccgagcccccttcaattgagaaacatgaagcaccggatggatctgactagctgctggcagaagcaacttgtaagcaacagcgccaacccggtgcagtatctggtaagggccatagtagcgaaacgccaacttgtgattagccctgacagccactgaagactgaacatatggttgtagtttaagataaacccagtctccaacttggaattccctgaagcttctctttttgtcagccatgtgtttcatttgctgttgagctcggttcaaatgatgctgcaagagttgctgcataagcttcctctgttggaaccactgattcagatcaggaatggagcagtcattcagactaatgccaaaatgcccaggacagtacccatatagaacttcaaaaggagttttgttcaacgcagagtggtaggttgtattgtaccagaactctgctaagtaaagccaggatgaccacttggtgggagtagcatgaacaaagcaccccaaataaatttccagacattgtttaaccctctcggtctgacaatcagtttgtgggtgataggccgagctcatatgcaattttgtaccagatctcacaaagagttgctcctagaattggctagtaaaaatcttgtctcgatcagaaatgatgatatgaaacagaccataaagtttgtacacatgtttcataaattcaagtgctacattgctagcagtgaaagggtgagccaatgggaagaaatgagcatattttgaaaacttatcttctatccccaatatgcagttctaatgatttgatttaggtagcccctcaataaaatccaaagaaatagtttgccacgctccagcagttacaggtaagggttcaagcaaacctggatacttggctcgatctggtttggcttgcaaacaaatttgacagttttgcaccctggactgtaccttctttttcattcctgtccaagcaaataaactcttaacccgctggtaagttgctggaaatcctgaatggcctcccattggtgagtcatgaagagcatcaatcaacttatcctgcaattctgttagatcccccacccaaatacgtcccttatatttaatgactccttgttggagagtaaagtgaggtcgagctgtagggcagatagcaagctcaatgagtagctggatggcatgagcatccttgttataactctggatgatttcctgcatccaagttggtacacattcagatacagaatttagctcagctgagtcttctttcctagaaagtgcatctgctgctgagttagtgactcccttcctatagcagatttgatactgtaagcccagcaatttagaatatgctttctgctgccaaggcgtgtgcagcctctgttcattcaagtgtttgagactatagtggtcagttaatataatgaattccacctctgaaaaagcggattccaatccccgatccggaatttcacggccaaatcaagagaatggaaggaaatctgagtggaattgtggttctgataccaggtgttaggtactctaacgatttctccctcaaattaactggacaattgttcacgcatacaagtatcaatccacaggatcgttccgccgccgcctacgccaccgcgtatccagttaatcgccttctaacatccacctatgtttctttatatacagttaggacaacactacacggctctccctctctcacatgacagcttggctacctggcccactgattgctgaagtagcgtgggttgggcctccgacgtcttgggccgatgcttggcgccgtctcctatagctttgttcggcatgatcccctccttgcctccagcatcttgttttgcttctccagcgccttgtccctcctcctggattccttccgccgtgccatcgtcttgttcatcagcggtttgatcggcagtcttcccttccagttcatgatcgtcaggcttcctgtcgttgtggcagtcttgagtcttcagaggaggcctcacaccctactgctccagccatccgagaggg

SEQ ID NO: 87346 - DNA, 635 bp, Oryza sativa
ttcatcttcttggggcaggaactcttgatgcacaacagaagatccggtgatctgaagtggctcagtgcgctgtctttggctaccacctggaaatactgggatgttgacaatccttctcttgcagttcgtcatccgattatgctcacttttgagttgcatggctttgtccacaagtttctcaaaatcttcataatcctctaggagtaattgcactgcaagctcatcttttaacccctggagaaacttctcttgtttgtcttcatccgtttccacatcttctggtgcatagtgagccaaacgatagaactcatgcaggtactctgtgacggtcaaatctccttgcttcaggtagcgaaactctcgttttcttagtgtgatcattcctgcgggaacatgtgatctcttgaatacagatgaaaactcgttccaggtgatggtatgtccttctggccgtgatgcttcgtagctatcccaccactctgaagccggtccaaccaactgatgagttgcgaagccaacccgctcctggtcggtgcactgaatcaaccctagcttcttctcgactgtgcgcaaccaatcactggcttccataggatcgacggccatggcaaaggttggaggcccagttttgagaa

SEQ ID NO: 87347 - DNA, 1714 bp, Oryza sativa
ggcgaattcgagctcggtacccttcccaaacatgcatatgagtgacatgagttcgtcattaatggaacaaagtttcacggatcagaatttactactcaggtacttttgcaattattaagagcagaaaataaattatattatctctatgcttttgatttcttccaagtaatacttagcaccttgcgttactcggtccatccaacgaggccccgggtgctaggaatcggcccaaaggcaaccatccattggcaaaccaaatggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaagggaaaaatatcatataaagaataaaataaatgatgacttagctttgtaatattccccttggtgatggcagaagtggccaatgtgggaacaaagtcgtccatcaataacaatgaagacaccagtcggcggcgacggaggcaggccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccactcggcggcgacggaggcaagccggcggtgaagtcgtagacgcccaacagcagcggcataataggctagccgtgtaggcagaaacaccagtcggcggcggcgaaggccagccggtcggcgaagacctggacgcccatgaacggtggtgtgaccaacccaccgtataggcggggacaccagtcggcggcgacggaggcaggccggcggtgaagacgtagacgcccaacaacggcggcataataggccagccgtgtaggcggaggcaccactcggcggcgacagaggcaagcctgcggtgaagtcgtagacgcccaacagcggcggcataataggccagccgtgtaggcggaggcaccactcggcggcgacggaggcaagccagtggtgaagacgatgtcgctatcggcaacggcagcggcacacaccaaccgtggcagcgaggccgcaagcagtgaacgattgtttgatctcgactgccatccaatgcatgcgaacaaccatcgctccagcatacatgtagattaaatcgacgtaaacacgtgcttgctcctggtggccgagtatattcctgtgtcctgtgccaatctagcagcacgtccatctgcatggaaggaaagagaggagcactcggacacggcaagaggcacccgagtggccgagtaggcgacgatggcggccgtgtcgtgatctcaaccagcatgtgaaaaacaacaaaaattgccaggaaatcaaaacggccggcgattagggattaattaataatcaatctaataaaaattaaattggaacagccaacccaagttgtacggcgtggcttggatacgtcgtgcgcgtcgatcagcttgggtcgcaatgccgcaatcagcagtagccggcggaagccatcaacggccctgcgacctcggagagtcggcagcatgtagatgaccgaccggggcagctgtaaagcctaatgataacagctcggaggcgatcgactacggagacgggga

SEQ ID NO: 87348 - DNA, 1323 bp, Oryza sativa
agtttcgctacttgaagcaagaagatttgaccgtcacagagtacctgcatgagttctatcgtttggctcactatgcaccagaagatgtggaaacggatgaagacaaacaagagaagtttctccaggggttaaaagatgagcttgcagtgcaattactcctagaggattatgaagattttgagaaacttgtggacaaagccatgcaactcaaaagtgagcataatcggatgacgaactgcaagagaaggattgtcaacatcccagtatttccaggtggtagccaaagacagcgcactgagccacttcagatcaccggatcttctgttgtgcatcaagagttcctgccccaagaagatgaacgcaatgcagacaacaacactagcaatactaatgatgatgataccaccaacaaccatggttcatgccccattagtgaccactcgaataaagcgtgcaatgtcagtagcattcaccaagatgtcaacgatagtatcaatgttggaacccagaatgacaaccttagcaattttgacactgagaaagactccaatggtgatagcaactatggtaccactgatgccaatgttagcaaggatttccaaccaccgattccaactccaagtcagaatgatcgtcctcagacggatagctcagcaaagaagacgttgatttgctacaattgcaaagaaccagggcattactcgagggactgcctgcaaccaaggcaaaatcgacctccacattaccgccaatttacacgaagcagacatcccaatcgtattgtggtcactggagcaaatgcagtacctgttaagcctagcgctagtcagaagcaaccataatactcttatatcggtgttcaaatacttttgttttatagttgttacccgtcaatcatgtaataacagagaaacatgagataatgaaggagtttgataagtttatgaaggaaccatgttaagattgcaagtgctgtgagttgtgtacattttgttgctgattagggagacctagggtctcattttcgtaagctcataatctattatgaaccaaataacctagcgattgatggcgaagaaaatcaagtgatcaaccaaagagacatttgtttggaccaaggggttcagatatgtcttctttggatcaaaggcatgcacccgttgtggagaaattggacacgttgctagcatgtgcctcaccctctgccctcattgtgaagaagaccatccaccaggggagtgtcccattcgcaaggtcacatgttttctgtgcgaggtacaaaccaatgtgccaaggattgccaactagtgtgttgttgaccaa

SEQ ID NO: 87349 - DNA, 1429 bp, Oryza sativa
  unsure (1)..(1429): unsure at all n locations
acgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggactctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttntcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatcatgtatatgctagttatatgtgatacttacaatttttaaaagttttaactcacacaggtggcaatttcatatgtatgttaattagagtttttaacatttaatttactagcattcatatgctaattataattgactagaggatttttaaaagttttaaatcacgcaagtggcaattttaaatgttaattagagttttttaacatttaatttactatcattcatatgctaattataattgactggagaatttttaaaagtattaaatttaatatatttttaaaactatcattcatatattagagtttttcacaatttaatttactatctttcatatgctacttatatatatgactattcgaatttttaaaaggtttaaatcatgcatgtagcatttacatatgttaattagagtttttatcatttaatataatataattcctacgctaagtatatatgatgattacaatttttattaattttaaatcatgcagtat

SEQ ID NO: 87350 - DNA, 625 bp, Oryza sativa
atgttaagatttcatttgcaaactctttgtcctttctgcaatggccataaatttgctttttcatgttcatagaaaaagaagtcatatctgtgttgattgatttataaaacataattcaaaacagcgtgatctacatgctaaatgtatagttacggccttcttccaaatacaagacattttgttgctcgagttggtaatttgcattctgttgttccctgccgagcaagctctcaatctcctctgcattgtcttcagcttcagcccatgggtgctgctggtatctccttaacatctccagcctctcagcaacctctttcatcgttggccgttcttctccattcatgcttatgcatcgcatcaggaggtatgtgatctcttctagcatttcagcgctcatctcattccttacttggctatctagtagctcttgatggcgaccaactttcattgctgtggtgaagcatgacaccaggctcctgttttcctctggcccgtccaagtacaatgctttcttccttgtcagaagctctagcatgacgacaccaaaactgtaaacatcgctcttatcagtcaactggcatgtcataaggtattcgaggtccaagtacccgcaagctccctgcac

SEQ ID NO: 87351 - DNA, 761 bp, Oryza sativa
  unsure (1)..(761): unsure at all n locations
gccaacctctatgtacggttgaaagagctggccgcgagggttcgcatcggtggtgcggctgtgggcgaaagcgacttagccgttcgcctcgtgtctgccgaactcactgtctctgacatgcattgtgcgctgtattcttccatcggggaggccgagtccctccgctttgtgggcgagatggtgcccgacatgctttgttactcggttctccgtatggatcgcgccggtcggcaagcgtgcctctggaaaggccagacgaggacgctctcttgcaatctggaaggcctcgctcctctcctcaacaggatggcctgngtcctcgaacgactccccgaggagctcgagatgaccatcaagtcatcctcgatggaccttgctcggggggctggncgaactcgtgctagcgagttaccaggcccgttaccccgatttctctccctggatgtgcgctggaggagttccctcccgggaccgaggtcgacgctcgctcgcgggtcggngatgctgccgaccacatcgttaatggcttcgaggggtctgccctctcgctcgcgttcgtctccagctccgacgaggagggcgacgtcatcggtgtggatgacggtggcgacgaggccggctacccttgctgcatcgnatgagcccccgagcccccgcccaatcttactttntttctttttctttcttctaaggccttcatgcctctttttggataaaataactcaatctgctatcagaaacgaaatgatgaaaaaattttg

SEQ ID NO: 87352 - DNA, 1612 bp, Oryza sativa
  unsure (1)..(1612): unsure at all n locations
ctgtcgtcggctgagctccggcgagggccgtggaccgtcgatgaggacctcaccctcatcaattacatctctgatcacggcgagggccgctggaacgcactcgcacgcgccgccggtaagcttctatacctcttatactgccagtaaattgtaccgtaaaagttgtctttgtcgaaaacactagctacttagctgtttaattaacttcgattaactcaaattatcaaaatttctcaatccgcaactccgcaaggtatagctaagatatatacacgtaaatttaattacgctttaattaccagcagagaaaaaaagaaagctaggtatgcatgagcagtgggattaataattaattgggttgggagaattaagcagcaaacttaaccaacaacctgtttatagagtaggttagccaggacagaattttcctttccagtgcagcttagccggcgacgtcagtcacgagtccaatcatttcctccactacctgtcttcaaaactatgtgcgcctccgaccacataattaatcactatagccatgcacagttatcacaaattaaccaatctctcacacaactgttgattaattgtaacctagccatcacgccatgtgtctcacaacatgtactactactccaactaatgagtcaatcaattaatcaactgtgagatggatgctgattaatagtggagagagagagattattgatgaaattttaattgtgcatatataggtctgaagaggactgggaagagctgccggctccggtggctgaactatctccggccggatgtgaagcgcggcaacttcaccgcagaggagcagctgctcatcctcgacctccactcccgatggggcanaccggtataatcaaataaattaattagctcactcgtcattgattaatcttatagaatctagtattcatgcatagatcagaaatgttctcagctacttcctctgtatttttaatatatgacggcattaattcttattataacctttgatcattcatcttattaaaaaaattatacaaatcttaaaaatataagtaatagttaaagttcattaccgataaatcaagccacacggccacaacaaaagaaaatatatttgcttaaatttttactgataaatcaaacataatgtaaaaagtgaacaacataatatattagaagacggaggcactatcgttctaatctaattggctgacttcagtgaagctttcattaacttatagtagtcattaactaattaaatcccttcttaagacctgctaattaaccaccatgctcaccatccagcaaacctcgaggcgacacgtgtcctacactgtagagaagaatgaagactagcttagcttagcttagattaattagctgggagcttaatttgacgcctcgtgatgcagattagactcgtgtagacgccgctagcaagctaagctaaaagtaaaggaaggacatgtcacggtcgtacagacttgtgacgtggacgtgacgtggacttggccgctctcaacacatgtcaactcgtccctgccatgtacaaacgcacgtacgtgacgtgacacactaattcacacactttcagaattttaatcagccaaca

SEQ ID NO: 87353 - DNA, 573 bp, Oryza sativa
gctggcggagatcgcccgagaggtggaggaggagcgagaggccgcccttgtcgccaccaccgcgatgattgaggcgcaggactccctccgccttcaacacgggagctgggaggcggagctgaagaacaagctcgacgccgcccaaggggttcttgactccgctgctgcccgagagcggcgggcaacggaagccgaagcggcgtcccggcggcgcgaggaggcccttgaggcccgtgccatggcgctggaagaacacgccggcaccgtggagaagggcttcacggaccgcgaggccgccactgctctccgggagacgacgctggcggcgcacgaggccgcctgcgccgaggaggagtccgcgctccgccttcgcgaggatgcactcgctgagcgggagcgagctctcgaggaggccgaggccacgacgcaacggctggcgaacagcctctccctccgcgaggcggcgcaagaggagcaggcgcgccgcagccttgaatgcgtccgtgccgagagagccgcgctggagcagcgggctgccaactcgaggcacgggagaaagagctggccgcgagg

SEQ ID NO: 87354 - DNA, 646 bp, Oryza sativa
cctattatgccgtcgttgttgggcgtctacgtcttcaccgactggcttgccttccccgccgccgactggtgtttccccctgcacggctggcctttatgcccgccgctgttgggcgtctacgtcttcaccgaccggcttgccttcgccgccgccgactggtgtttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgctgccgccgactggtgtttccgcctgcacggctggcctttatgccgctgttgttgggcgtccaccccttcaccgaccgggcttgcctttcccgacgcccgaactgggggttccgccctgcacggctagcctattatgcccgctgttgttggggcgtccaacgctttcaccgaccgggctggccttcgccggcgccgactggggtttccgcctgcacggctagcctattatgccgctgttgctgggcgtccacgtcttcaccgaccggcttgccttcgccgcccccgactgggtttccccctgcacggctggcctattatgcc

SEQ ID NO: 87355 - DNA, 2112 bp, Oryza sativa
agtcatagcaatccatttgggcatgagcctaagtgtaggattatagatatcattcgtcctaggtttcttgcaaattggagcaccagaaatatcttcccaaaacctatttttctcgaacccagaaattcctttctggagatcgattttacaggtatcgtgaaaaccaagaagtgtgcttaggcctttccatgtaagtgtaaactcctcatggaaaaagcaaaaggaaattccatcttccatttctttcaaagtgcacagaaattgcaaagtaagcaaatgagaaccaggctcatataccacagcaaatttctgccaaccaacagctttccaaatagaacgaaattcagtatccatacctatctttttcagcaactccagtgagtactctcgcgtgtgagcatactcccggtcggccagcatgtagtaggcttgtctctcccgatcaccgacaaggtcaaggtcagcgtcgttcaggagttgtcgtggagcttcggcttcttccatcatgatatcggctgatgaacgagtactagactcgtcatgatgacttgatgaagagccggatcccttgaacagacgagacaatcgcctcctcattctgcacaatggagcaaaaacggactaactcggcgggggttaggaatgacaaagatttcacctaccggttagtttcaccaaagcaacttgtatatatgtaactaagtattcgaatttgagggaaactatcaaagcttgaatgaatttgagagcaaactttgtagagggaatgaaaatgtattgaaatggggtggaattccctctctcggccgactggctcttatagggtacccacaacggtcaaaaatgacatgtgggacccactagccgttaccctgccaaaagtggcagggaaccgttacctggccggttcaaccgaacccttggtgggcccaaccggccccactttcggctgttggattccaacggttagtgtggtcatggcacagtgcatttcgtggaaaattttattttggtttgctctgaaaaattcatttgaagaatttcctcaaaattcaaaagtcctaaatgcaattttgaaaatcaaatatgtgatgatgaaaaattcaaatttgttgaaagcaaacatgcggatacataccaatttacctgttggcgaaggtcgcgtcatttaaagtccgacgtgcaagactgtacctccttccaattcagttcatggattttccactcgtctccggaggtgatggagcgggcgtctttggcttctccctccacaccttctttggcttaggtggggatggcggcttcttctgagccagctgctctaacttcttagccggtattggtggttttaccggtagcctccagtaacggttcctaggcatcgttgtttccttctccaggaaattctgcatgaatttcactaggctgtccgtcttgggtggctccacttcgacctcttcaatattctgcgggttcggcccgtactttattctgaccatggagcattgttccgtcctcggttggaacttaaacttcttctccttcccattgatatggaatcggatactccccgttcccacgtcaatattggctcccgcgatgctaaggaacggacgccccaggatgagcggcgtcacctttcccgactccatgttcagcaccacgaaatcaaccgggatgaagaaatcccgtatcttgactggcacatcctccgctatccctgccgggtaacggactaacgagtcagccagttgtaggcgcatcggtgttggtgccaacaccatgaagttgagcttgtcgaaaacgtcctttggcatgacgctaacgctggctccaaggtcgcacaagacctggtcgaattgctgtgccccgatcgagcaggtgatcatgggacaccccgaatatttcttctccgggagcttgtggagtatgatgttgctgtattgtttcgtcagcttgaccacctccgttattgggagcagtctcttgttgttgagtatatcctttaaataacgggcgtatgttggcacctgcatagcgtccaacaatggcacattgatgtggattttctggattacttcaacaaaatgagcaaattgctcgtccactgac

SEQ ID NO: 87356 - DNA, 1046 bp, Oryza sativa
catgtactgttcatgcttgtttatgtgctgttttggtgattttgctcttttctgcttagattccgacgtttccggagagtccgttttcgcaggagaagaatttgaagagttccaaggctagcaaggcaagtcacacagatcccaaacaacccttttgagcatgttgatcccgtttaaagctattgtttctattcaactattgcatttattttcgaatgtcattgggtggaattaacctattgtttgttatagcccttttgttcttgattactttattccttgataccttgggttaatataacttgactagttgagctttatatatattggttcagctagatattagatgtgattgcttagccatgcttagaaacattagcacattattgggataacttataattcattattatttaatgatgattttatgttagttcacgatggtcaatcgtgattggttaattaattacttgccaactaaaacttgataatggtgggttgtgagcacatggttttgacagtcgtgctcatgacaattaaggaccggttcacgagtttcggatgtgaaacattaaccgtgccaaccacaagccagcgtgggcaacggctttaccttttgtatagcatggtttattgcggggcaccagactgagaagtggcggagataagcccacaggggtcgctggggagtccatgcgttgtttataagggggtgattatgatccaggaatggtgcgctgcggtggagtgtgttatgcaaggggtattgtcacagctcctttccgaggtaccgtggtggtattgaggcacatggtgacatgatgtggggctgtgtcttgtgggtacagtggtacacctctgatcagaataaaactattcgaatagccgtgcccgcggttatgggcgggtctaacaatgtctttcgtgattagtctcacacctctcatcgtaataaaagatgctataattggtaataatttgattagctcctggtttggaatggtatattcaaagtttggagattgatctgtacagccgggtatggc

SEQ ID NO: 87357 - DNA, 634 bp, Oryza sativa
tttgagggttttttgctctttaaatgaatatttgcgaatttcttcatttaaattttaatttaaaatcggatttattgcgtcagccgaggggaggggcgcgcggaccgggtccacgggagtggggcccatgcggcagcctcacggtccacgatggaccgggtgcacgcggcttacgccggccggcgccgtgggtcccacgcgtcagccgcacacgagggcgcgggcggctgacggccgggccccacatggcagccgcggggcgcgcccgaaggcggcctcgccggcacagccgacgggaggcgacgcgcccgcgccccgatggtcgccggcggcgaccaccagcgcggcggagcggcgcccgagagaggggagggaagggggaagtgaaacggcggtccacggctcaccctgggtcgacggcgacgacggaaacggcgaccggagcggaggaaggcggcggcgcggctcgggtcgacgaggacggcggcgttccggtgatcggcgggcgaaacggaggagtggacgaggtcggcgaggacgcggcgaagccgaaggaggcgatgccgaagcgggaggaggtccggggcgacggcggcggcgaaccggagctcggcagcgacggcggagaaagagg

SEQ ID NO: 87358 - DNA, 1413 bp, Oryza sativa
tatagcatgttttgcttgtgtgctttgtttgtcgcgtagatttcggtcgtttcgtcgacccgcggtttctcgaagaccttgctgaggtctcatcagtgcgagagcaaggcaagtcatgcattataattgatcatattgtacccaatttacaaatatcccgcatttctatcaaatgttgcattcttttacaatgtcatgtgggatgggtcctaccactcagccatttattgtttaccctatgccattaataatttgggtatcaaaatgattagatgttggtttaggaaatgctcagccatgcctagttcaactattacacaaatggggatcacattattacatagactttgactattagcatagctttggattggtgccaccgtaatggtgttagttaattaaaatacactgaatggtgggctgtgggtgcatggtttagctggtcgcacccatggcagttaaggactggttcacaggaaaccctaggagacttaccgtgcttaccacaagcgggagtggataactgcttgatctgaagtatagctcgaccctttcctaggcaccggtggcgagggtgggcgtgatggagttgggtcggccggggtgtctggttgtccagctgccggattcaccgcggcgtaagagggaccgcccattgcctgttggggtgggggtgaaacctttgcgtggtgtggatggttaggagagagttatgcggagggtcttgacacgatttccccctttgcagtatcatggtgatactttggggcatggcgacatgtgtggaatcgtgtcttgtgggtacagttgtacacctctggccagagaaaaactattcgaatagccgtgcccgcggttatgggcgatcaaccagattcaccgtgattagtctcacccctagtttagcttaatgaactggtgtagttcaggtggttggttgggcctgttgcaacgtggtatagcgttggacagtgattggttaatattgcttaattactacaattgttttactgctttcaactgctgcttttaaatgctagctttgtgcaaatgaacccatagcctcctttggttatatcctgcatcatacattctcatccggtatgacttgctgagtacagtgggtagtactcagtcttgctttcttttcccccacaccagagctgaagatcttcctagtgggagctgttctgttgaagttggtttcgtcgatgccgtcaaggattgcctgtggagtggagtcgcccgctgcagaagtcaagaatccaagtttagttcgttttatcttttccgctgcatttgtaatcttttatatttttgtaagacgtggatctgtatgtcaacaattatcgtttgtgtaccctggctggtccttgtcacaccccgaagttttcctcccaagccaaattgtaa

SEQ ID NO: 87359 - DNA, 1607 bp, Oryza sativa
ctcaaattgggcgcaacatcgaagcttacgtagatgatgtagtcgtcaagactaagtagaaggatgatttaatctcggacctagaagaaaccttcgcgagcatccgtgctttcaggatgaaactaaaccctgaaaaatgcaccttcggagtaccgtcagggaagctgcttggttttatggtgtctcatagaggcatacaagccaacccggagaaagtcaccgctatcctcaacatgaaaccgccgagctcccagaaagacgtccagaagctgactggatgcatggcggtgctcagccgattcgtctcacgacttggcgagcgggggatgcccttcttcaagttattaaagaaaacagacaatttccagtggggatctgaagcacagaaggccttcgaagacttcaagaaacttctcaccgagccaccagtcttagcctcaccacacccacaggagccgctgctactatatgtatcagccacctcctaggttgtgagtacagtcttggttgttgagcgtgaggaagaaggccacgtccagaaagtccagtgaccaatctacttcgtcagcgaggtcctagccgactccaagacgaggtatcctcaggttcagaagttgttatacggtatcttgatcaccgttaggaaattatcccattacttccaaggccactcggtcacggtggtcacatcgttcccgctcggcgatatactgcataatcgtgaagcaaatggacggattgccaaatgggccttagaattgatgtctttggacatatccttcaagccccgaacctcaatcaagtcccaagcattagcagattttgtctccgagtgtaccgagtgccaggaggatacccccggagaaaagatggagcactagaccatgcattttgacggatcaaaaaggctttcgggcactggagcgggagtggtcctaatttccccaactggagaaagattaagttatgtgctttggatacatttttcggcatctcacaacgtcgcagagtatgaggcgctccttcatggactacagatcgcaatctccctggggatcaagcgtctaatagttcgtggagattcacaacttgtcgtcaaccaagttatgaaagagtggtcctgcctcgacgacaacatgacggcataccgacaggaggtacgcaaactggaaaacaagttcgacggactcgagcttagtcacgttctccgacacaacaatgaagctgccaacagactagccaactttggatccaagcgcgaggtggccccctccgatgtattcgtcgaacacctttatgagccgactgtacctcagaaagaaacgactcaagttgcggacactcaagacatagccatgattgaagccgactggagagagcccctcatacgatttttaacctcccaagagctccctcaagataaagataaagccaagcggatttcaaggcgtagcaggctttatattattcatgaagccgagctatacaagaaaagcccttcaggaattctacagcgctgtgtatctctagagaaagggagacaactgctgaaagacatacattctggcatatgcggaaaccatgccgccgcacgcaccattgtcggc

SEQ ID NO: 87360 - DNA, 743 bp, Oryza sativa
ttgttgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaatccggcctccagaagtcgcgccacctcctcgcggatgaaggcttgacgttccggggcctgccgtcgcactttctgccggaccggccttgcgcccgaccgcatggcgagacggtgctcaatcacctccctggggaccccgggcatatccgccggtctccatgcgaagacgtcagcatttgcccgcaggaaggagacgagcgcgtcttcctatttgccgtccagaagaccaccgatccgtgtggtcttggacgggccgtcgcccagggcgacctccttgaccgggacctcatcgcatgtgatcatctgctgcctcggggtggcgggggcggaggcgccaagcctctcatcgccaccctcgggcttggacgcgacgacgagatggtctgcgcgctgctccatgcaagcaagcgcgactttgaggtcaccatggacagagatgggtaccgagctcggattc

SEQ ID NO: 87361 - DNA, 800 bp, Oryza sativa
gaaaactggcaccaagatatgtgggaccattccagatcatcgccaggcgaggagaagttgcatatcagctacagttaccagagaatatcgcggatgtgcacccagtcttccatgtgtctaagctaaagaaatgtttacgagtgccggaagagcaagctccgctggaagagtcacattagcaaggatctcacatatccagaacacccgatccggatattggatgaagccggcaagaggactaacagcaaagtgtggcgtatgtacaaggtacaatggagcaatcccactgaggatgaagccacctgggaaaccgaagaattcttgaggacggagtacccgcatctattcgaaaactggtaagaaatctcgggacgagatttatttaaggggggtaggtttgtaacaccctgaaaatttgaccgacaaaatcaaaactataaaaatacggattttcaaaaactttttaaactaattgcatcatgctgatcttattcgtctattttatctggatttgatctcgaagattattaatcgtgagtaaagaatagttaattaggaataaaccttaaaaacaaattggtgaaataaatacaaattaaaataaagattaggtggggatagaaataaataaaatattatcgcaaccatatttggatcaattaaatttaaatacgatggaataagaattaaccctaattaaaactcaaataaattatataggaataaaatatgagtaatattaatctagggtgattcattagttaagataacacggagtattgagtaaaatgcatatatgc

SEQ ID NO: 87362 - DNA, 866 bp, Oryza sativa
ttcgccatcgcccctctccacgccatgttcccggtgccggcggccgcgggcagcttgtggcgagaaaacgacggctgcgtggcgtggctcgacgggcagccggaccgatcagtcgtgtacgtgagcttaggcagcttcgccgtcatctcgctggagcagttcacgaagttcctccacgggctcgtcgccgccggctacccattcctttgggtgctccggccggacatggtcggggcgagtcagagcgccggcgccctccgcgaagccgtcgcggcggcggagaagaacaacaaggcgcgcgtcgtggggtgggcgccgcagcgggacgtgctgcgccaccgcgccgtggggtgcttcctgacgcacgccgggtggaactcgacgctggaggccgccggcgagggcgtgccgacggtgtgctggccgttcttcgccgaccagcagatcaacagccggttcgtcggcgccgtgtgggggacggggctggacatgaaggacgtgtgcgacgccgccgtcgtggagaggatggtgagggaggcgatggagtccggcgagatcagggcgtcggcgcaggcgctggcgcgcgaggtgaggcaggacgtcgccgatggcggctcgtcggcggcggagttcgagcggctcgtcgggttcatcaaggagctcagcaatcagcatgatggacagttcatacaagcttaactcgagctattcaatctccgagtgatgatattttaaagaaaaacactttcccaactatagtattgttgttgtggcactgacatgccaccgtgtgcagtcaattggtcatagttccctcttttctctaacaaaatttaacaaatcaattctttcattgtttgcgtttc

SEQ ID NO: 87363 - DNA, 1035 bp, Oryza sativa
agggtgtttatctgtccacgaggtactatatgtaggttcagctgagctatctcctccctaagctcagggatcatcccttccattctcagatgattgcaatggctcttacgactcagagcgtcggccacaacgtttgctttgcctgggtgatagtgaacttctagatcatagtccttgattaattctaaccatcgcctttgcctcaagttgagatctgactgggtgaagatatactttagactcttgtggtcagtgtagatatcgcaatggtttccaatcagataatgtctccaaatctttagcgcatgaaccacagctgcgagttctaggtcacgggtagggtagttttcctcatgtggttgcaattgtcgcgacgcataggccacaacttttccgtcctgcatcagtactcctcctagtccttgccttgacgcatcacaatatataacgaagtctttcctgatgtcgggaagaactaaaataggcgccgaggtcagcttttctttgagctgctcaaagctttcctgacactgttctgaccacacaaacttcttttccttcttgagtagttgtgtcattggtcgggctatcatagagaacccttcaatgaaccgtcggtagtatccagccaagcctagaaaactccgaatttcagtcacagatttgggtgctttccattctgtgacagcttccactttagcaggatccactgctactccaccggccgagattacgtggcctagaaaagcgacttcttttaaccagacctcacacttgctgaattttgcatataacttatgcttccgatgtttctcgagtaccaatcgcaagtgttccgcatgttcttcctcatctttggagtagattagaatatcatcgatgaataccaccacaaatttgtccaagtagtccatgaacactttgttcataagattcataaagtatgccggagcgttggttaaccccaacgacattacggtgaactcatataatccatagcgtgttgagaacgcagttttgggtatgtccccggtt

SEQ ID NO: 87364 - DNA, 2418 bp, Oryza sativa
gccatagaaacccccagaacccaggaaattaaaatagaacaaataaagtcagaagaaccaagagaagaaatccagaagtttgataaggtattaagtgaggaagagcaatgggaagtaaatgagaaattattactagagagttatgaagaagaaaacaacctgatagaggaaatagagaatatagaagaagaagataatgcagaacaatataatgattttatagactcattggatgaggtaggtttgcataatctagataatgcaatggaagctatggaagtagatttgggaacaggaaaaaggaaaagatacggagagagttctgtaaaaaatgaaggagaaagagaaagaccagccagggcagcaggaagatggcctccagaaaaagaagaatattcatatcattatatcccaggacagtataggcacatgggcactaaaagaagagattttgagaaaccaataaaatttcaaaatcaaaatagtgatggggctatactaaatctagcagcacatgatcccatagactggccaaatatcattagtatttggaaggggttaatagttcaaaaatacatacaaaatcagcataatatagggaataaggtggaggatatgataacttatttagaaacatttttgggtgaatctgctaaagtcctatgggaacaatgggttgaaaagaatcctaataactacgaagagctaaaaagagcaggaagtaatcctcacaactttgcaaatatagtatctaatattatcatagctgaagacccagaattaggatatacaaccctgcaaaatgaaagattaaaagaaatagaaaaattaactttaacaagctggaaaggtataaaggaattttctcaacattatctatataatgcaacaactgctaagcaaggatacaataagggaatagttgagcgatattttaataaactacctgacccattaggtagtatgatttttgaggaatataaaaaggaaactgaaggagctgaaattaatatttcccaagccataaccttcgtgttcaaacaattaagaaaaatatgcacaggaatacaagcccaaaggtcaatgaaacattctgattataatttttgcaataaaataatacaaatacctttatcatatggagaagataggcctagaaataaaagaaaccatagatatcaaagtagaaatagcaataatataaagacaaagaaaaggtacttcttaagaagatcagataatagagcaccattcttacataaacgaaatgtaagaagatataacccaaagaaaacttatgataagacatgcagatgtttcatatgtaattcaccagatcatttaagtagaacttgcccaaataaagatcaaaaaagatattctagtaaatatgaagaacaatagagagttttaattatagatagcataaatgaaaatatattagtatgtgacgatgaaataaaagatgacgaatcaatatattatatcatagaaacagatgaaattgaaaacaccaatgaagagtatgaatcaaccgatgaagagttaaatttaattgacgaactagccagtttaaaaatagaaatgatggatcagttaaattgtgaacatgattggattagaggaaaaggagattataacattaaatgtgctttttgcatctattacccaagccaagataatagagtaacctgtagtatatgcttaaaacaagcttgtgctgaatgtataaaagcaaataaacaaaaatggagaaaagagatagaattagaatcagatgaaaggatattatctagtagagtacgagttttagaaaacagaataaataaactagaagtagaactagagaacctaaaaattaactatgatattaaggcattaccagaaaataaggatatacaaaataccgaatttaaagagcaagtgataacattaaaagacagtaatactgctaaaataattcaactaaaagatgccataactaattttggaaataaatatatagtaaaattgcctttcaaagaaattttgggaataagaataccggtaaaagtaaaactatcacccaaggtatcatataaaattctagcactagtagacactgggtgtacaaaaaatattattcatgataagtactttataaaatgtccagagatagttcatacaattgatgataataaggcagaagtctctacagacatgtccggaataaagaaaattcataatcagttagctcataatgttgaagtatacattaatggaactaaatatataatagatgagattacaataagaaacttatccatgataagtgatgacatgataattggcctaaggtttttacaacaatcggtacaaaccacagtaatacatgagcagggaattacttttattccatatcaaaacaatgtaccatat

SEQ ID NO: 87365 - DNA, 601 bp, Oryza sativa
agggtacaatagaacaccacacacccaaaggaagtaaaacaaactagtgcattagcagcacagccctagtaaagagatcacgaagcctagcagctcctggctaggcaccaaagagcaccctcattagcgatggcttggaggacatcaaccaagcatggggtggcaccattaaaaacacaattgttcctgtgcttccaaatttcccaagcaaccaagatgattaacgtaggattctgataggattgcaggattgagaaaacgtaggaataggaaaaacgtaggattctgataggaatgtaagtgtaaaacagaggattgcaaaacttaggaaaaacacaggaatgaccgtttgattgaaccacaggaaaaacgcaggaattggatgagagagatagactcaaagaaagttaccaagaggttgaagctcttgctaaatttcctccaaaatctctataggattgtccattccataggaattttaaaggattggatatgattcaatcctttgtttcaaagggcttcataggagattttcctataggattgaaatcctccaaaattcctatgtttttcctccaattcaaaggggccctaaagagtt

SEQ ID NO: 87366 - DNA, 539 bp, Oryza sativa
ctcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccaaacaatgtccgggcaacaataacaaagatatgtgcattcatgaacgcaatttcacagaaggtcatcgatccggatagattagaaacccttcagaatgaagtggtgcaatgtctcgtcagttttgagttgatatttccaccttcctttttcaatataatgatgcatctgctttgtcaccttgtgaaagagatccgtattctcgggcctatgtacctacacaacatgtttcattttgagaggtacatgggcgttcttgaagaagaaatttcgtaaccgtgctcgtccagaggcaagcatcgccaagggttatggaacagaggaggtcatcaaattttgcatagaatttatcga

SEQ ID NO: 87367 - DNA, 1254 bp, Oryza sativa
gagcacggtaacgaacattcttctccaaaacgcccatgtacttctagaaaaaaaacatgttgtgtagtaacacaggccgagaataccgatctctttgacagggtgccaaagcagatgcatcattatattgaaaaatgaaggtggaaatattaactcaaagctgacaagacattgcaccacatcattttgaagggcttccaatctatccggatcgatgaccttctgcgaaattgcgttcatgaaagcacattgctttgttattgttgcccggacattgtctggaaggataccccgaattataactggtagcagttgtgtcatccacacgtgacagtcatgagactttaggtttgtgaacttcttctccttcgtgcttattattcgctttatattcgtggaggacgtccaagaattcccaatagggtaactcccaaaatatatagttcttcgctatcaataggctggctgccaggcccctttccaaacactactttaagatctttcaccatagcaaacactgttttcccactgcgatgtttaggcttcgtacggtggtctgccttatgttcaaagtgattgcctttcttccgtacagggtggtttgcagcaaggaatcgacgatgacccatgtacgcaaccttcctacagtgcttaagatacgtactttctgtttcatccatacagtgagtgcaagtcttgtaccccttattagactgcccggatacgttgctaagtataggccaatcgttgatggttacgaacagcagcgctcgtaggttaaactcctcctgtttgtcctcgtcccacacggggacaccttctttcttccacaacagtttcagatcttcgaccagtggtcttaggtacacatcgatgtcgttaccaggttgcttggggccttgaataataatcagcatcattatgtacttcctcttcatgtatagctagggggaggttctagatacacatcgtaacgggccaagtgctatggccgctgctcatctctccaaaaggattaatgccatccgtacttaaaccaaaccgtatgttacgtgcgtccttaccaaagtctttaaatgttctgtcgatgtttcgccactgcgaaccatcagcggggtgtgacacagtatcccgtcctgttgatgttcctcagcgtgccaatgcatcattctagcacttccccttgctcctgaaataacgccttagccgtagtattatagggaaataccacatcaccttaggaggaattctctt

SEQ ID NO: 87368 - DNA, 5416 bp, Oryza sativa
tgatcaattgtgcaacaagagaggttatccttactgatgaacaaggaatgaatacaaggataatagttaaatccaatctatctatggaacaacatatgacagacatttgtatgcttaaaccaaaagaagaagtcccagtggtgcaagaatatttcgatgtatttcctgaagaactaagttcattacctccagatcggggaatagaatttattatagaattacttcctggaatggcacctatatcaaaaagaccctataggatgccaattaatgaattggaagaattgaagaaacagatagctaagctgcaagaaaaaggctttattcgaccaagttcttcagcttggggagctcttgtattattcgtaaagaagaaagatggaagtttaagaatgtgtgtagactaccgggctttaaatgaagtagctattaaaaacaaatatcccttaccaagaatcgatgatctatttgatcaattaaaaggagcaagtgtattttctaaaatagatcttcgatcagcatatcatcagttgaaaattaggcaagaagcatttggattaaccaatgcccctgcctatttcatgaatcttatgaacaagatatttatggaatatctggatcaatttgtggttgtatttattgatgacattctgatatattccaaaaataaggaagaacataaacaacacctacgaatggtattggagaaattaaggcaacatcagttatatgccaaattcaataaatgtgaattttggctagacaaagttgcatttctaagacattataactaaggaaggagttgccgtagatccggagaagattaaagcggtaatggtatggagaacaccaacctcagtacctgaaataaggagtttcttaggacttgctggatattatcggagatttattaaagatttctccgctattgcaaaacctatgaccagattacttaaaaaggacaggaaattcgaatggacaccagaatgtcagagtaattttcaaagattgaaacataagcttactactacgccagtattaatcttgccagacatccaaaaagattttgagatctattgtgatgcctctcgacaaggattaggatgtgttcttatgcaagaaggtaaaatagtagcttatgcgtcaagacaactaagaccccatgaagataattacccaattcatgatttggagttagcagcagttgtacatgcgttgaagatttggcgacattacttaattgggaatcattgcaagatttataccgatcataagagtttgaaatatatttttactcagatggatcttaatcttcggcaaagaagatggttagaattaattaaggactacaatttggaaattctataccatccaggaaaagccaacgtagttgctgatgccttaagccgaaaagctaattacaatctacaacaagaaataatatcagaacaattgcaagcagaaatgcttaaactaaatctgggtattattaagtttgaagaattaaacactttggagttaaaacctaccttaatggatcaaataaaagaacatcagaaggacattctgaaatacaaacttttaaggaacgaaaggtacaaggaaaggctgcagatattaccgaagacctggaaggaatattttggtacggagatagaattgtcgtaccacaatcaggaaacttgaggaaggtaatactaaaggaagcacatgattcagcctactctttacacccaggtagtacaaaaatgtaccatgatttgaaagacttatactggtggccaaatatgaaacgacatattgcagaatatgttgcactatgtcatgtttgtcaacaagttaaagcagaacaccaaaagcctacaggattattacaacccttacaaatacctgaatggaaatgggatgaaataggaatggattttattactggattacctaaaacttctactggatatgactctatatgggtaatcattgatagacttacaaagactgctcgattcattcctgtgaaaacaacttatactggagcacaacttgctgaactctatatgacaaggatagtatgtttacacatagtgccaaaaagaattatttctgatcgtggtaccaatttacttcacatttttggcagaaattacattatgaattaggaagttatctggatttcagtacagcatttcatccgcaaatcggaggacagacggaaagactaaatcagacattagaagatatgttaacagcctgtggtctagattttgctgctagttgggacaaatgtctaccttatgcagatttttcatataacaataattatcaagccagtttaaaaatgtcaccacatgaagccttatatggaagaaaatgccgaacaccattgatatggacataaaccggagaaagatgtatattcggaacggaccttttaaaagaagctgaagaaaaagttcgactgattagagacagacttaaagtagctcaatctcgacaaaagagttatgcagattctagacggagagagttaacttttaatactggtgattatgtttatctaaaggtttcacctttacgagggataaaaagatttaaagtcaaaggaaaattagctcctcgttatattggaccatatcaaataattgctaaacatggagaagtagcctatcaattggctttaccagattatctatctgatgtacatcctacattccatgtttcacaattaaagaaatgtttacgtattccagaagaagaaatatcagtaagtactgttgaactgaatcaggatttaacttatccagaataccctatcagaattttagaagaagcacagagaacaactcgtactaaggcaataagaatgtttaaagttcaatggaatcatcatacagaggatgaggcaacttgggaacgggaagattatttacaattggtattcccgtatcttttcgaagactcctaagcaaatctcgggacgagatttctttaaggggggtaggtttgtaacatcctcaaattttaaactaaaatttgactgcatcatgctgacttttgattaatttagtgtgtttcaaaaatttatttggttcctaattggttcaagtattacttctttagaaccctactaatttacccaaattattccctttattccaaaccctagtgaatttgagcaaattctctcaaatttcaaactatagataatttccttagcttatcctaatattagtgaggacttgctatacttcaaaccctagtgaaacccttccaaattcatagattaaattcattattttctacggaaatattcaaaaattctgaaattgattgttcattgcacataaggtgttcggtagaatgcctagcccaactagagcagcccaatcccctccaatcttgtacaaagtctagaattgatcctaggggaccacaacccacttaaaaccgtggctttctttgcctcttcctccccttcacgcgcgtggcccgggcatccgacttagtcgcgcgccgtgtcgccgcgcgtcggcctcggagccgcttgcgcgtgcccgacctccttggcgcgccgtcgcccgtccgacgccatcaacccactgccactgcaccaatcgcaacgaggacaaagccaggacgacgaccgccgcacgaaatcgccgctcgacgccgtgcgctcctgtccaagccgccgccgagtgtgatttcgtttctatacggggtgaatcgcgccaattcttgccgcacggttggattgaagatagacggtggtatcccctctcacaattcaaaccattcacccccgagccggccgttttcaccctcgccgccattgcgcgtcgcgcctggattggcgccctcacgtcgccagccgattccaaccgcggtcaagtcaatccttcgccggtaagtatttgaacgtggcctcccgccactcaaatcgatcttacccgccctctcacagcctctgctgccctagctctatccaaatcccgagctcatccatggcgatgacggtgtccgagctcatccgctcctcctagccctataaataggaccccaatcccttccttgtccatcatccatcatcaacaatcaaagccctacaaccccgaagctctgcttcgccaatccaccccatcaaccaccatcgcccgtcggacgaacacttttgtgcgatcgactccacgcctctccatccatcctccgccctaaatatcccttagaacaccttatatcaaccatgttctagcatagtaagccctaaccgaagctctgcgtcgagttttacctcgccgcaccaagctgagcaccgccgcccccgcgttgctctgttcttcgccgccgcgaagtttttctggccgcaatccgtcgtttcaaccgatctcggtgagttcttccatttcaaccatctgcatactacctggattccattttagcaatccctttgcactgtcatgccaccccctgagctgccgatgtgagcacggccaccgccaatggaggcgctcgttggcaactatactcagtgccttgccaaaggtcggcaagctgccggaatccctctaggcacctcgtagatgctctagaacccctcccctaaccatgtctaactctcaacacctcgatcgccatctcggccaaaccgtgccaccgctcgccgtcaccggagatccctagcaccctcccctcgtcggctgcaaccactttccccctccatcgccgccgcaatcgccaaccctagcactgccggcctgatttggggaacggctggaggttgaagaagagaagagagagagagagactgacaggtgggacccacacacagtgccatttcacatttaatcgattttaactttagaagcccatatcttttaaaatatagatccaattccagtgaaacgtggaccaatattcttctaaaatcattcctatcttttgagcccctttttcctatttttgcattttattttattttctctatttttcttatttttggattttatttaaactccttttgaatttgaattttatatgtctaaccctaggtcttgaggattcttctgacacactagataatatcaataaagagggggaaatcactccccgtgattccctctccctttccccccacttttccctctctctctccctcggattcgtttggaaacactcccgcaaacttcgtcggcgcatcaatggcgggcggatcttccgcggccgattccccctcatccgttcgttctctcccccttccaacactatttaaacgctccccgtgcctgcctgcaccgtttccggcactcgccgctctctctccccgtcggaatcgagctcgcgcccgcgttatctctcttcgacgtcgcgccgagcttcggtccgccggcgtcgtcgcccggaccctctttcgtttcggcgt

SEQ ID NO: 87369 - DNA, 570 bp, Oryza sativa
tccgcctgcacggctggcctttatgccgccgttgttgggcgtctacgtcttcaccgaccggcttgccttcgccgctgctgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgctgctgactggtgtttccgcctgcacggttggcctttatgccgccgttgttgggcgtctacgtcttcaccgaccggcttgccttcgccgctgtcgactggtgtttccgcctgcacggctggcctattatgccgccgttgttgggcgtctacgtcgtcaccgaccggcttgccttcgccgctgccgactggtgtttccgcctgcacggctggcctttatgccgccgttgttgggcgtctacgtcttcaccgaccggcttgccttcgccgctgctgactggtgtttccgcctgcacggctggcctttatgccgccgttgt

SEQ ID NO: 87370 - DNA, 917 bp, Oryza sativa
atccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagacgcccaacagcggcggcataataggccagccgtgtaggcggaggcaccagtcggcggcgacggaggcaggccggcggtgaagatgacgatgcccatcaacggtggtgtgaccaaccgaccgtataggcggggacaccagtcggcggcgacggaggcaggccggtggtgaagtcgtggacgcccaacagcggcggcataataggccagccgtgtaggcggaggcaccagtcggcggcgacggaggcaggccggcggtgaagatgacgatgcccatcaacggtggtgtgaccaaccgaccgtataggcggggacaccagtcggcggcgacggaggcaggccggtggtgaagtcgtagacgcccaacagcggcggcataataggccagccgtgtaggcggaggcatggacgcccatgaacggtggtgtgaccaaccaaccgtataggcgaggacaccagtcggcggcgacggaggcaggccggcggtgaagtcgtagacgcccaacagcggcggcataataggccagccgtgt

SEQ ID NO: 87371 - DNA, 703 bp, Oryza sativa
tacgacttcaccgccggcttgcctccgtcgccgccgattggtgcctccgcctacacggctggcctattatgccgccgctgttgggcgtctacgacttcaccgccggcttgcctccgtcgccgccgagtggtgcctccgcctacacggctggcctattatgccaccgctgttgggcgtctacgacttcaccgccggcctgcctccgtcgccgccgactggtgtcctcgcctatacggttggttggtcacaccaccgttcatgggtgtctacgtcttcaccgaccggccgcctcgtccgccgccgactggtgtttccgcctgcacggctggcctattatgccgccgttgttgggcgtctacgtcttcaccgaccggccgcctcgtccgccgccgactggtgtttccgcctgcacggctggcctattatgccgccgttgttgggcgtctacgtcttcaccgaccggcttgccttcgccgcctccgactggtgtttccgcctgcacggctggcctattatgctgccgttggtgggcgtctacgtcttcaccgaccggccaccgcatccgccgctgactggtgtcaccgcctgcacggctggcctgttataacgccaactgatgctatcttcttcacggctgactacatcgctgtcactactaataggcatcagtatcttcaacacaagctgcctacgtttgccatgg

SEQ ID NO: 87372 - DNA, 1070 bp, Oryza sativa
ccgtataggcgaggacaccagtcggcggcgacggaggcaggccggcggtgaagtcgtagaggcccgtgaacggtggtgtgaccaaccaaccgtataggcgaggacaccagtcggcggcgacggaggcaggccggcggtgaagtcgtagacgcccaacagcggtggcataataggccagccgtgtaggcggaggcaccactcggcggcgacggaggcaagccggcggtgaagtcgtagacgcccaacaacggcggcataaaggccagccgtgccggcggaaacaccagtcggcggcggcgaaggtaagccggtcggtgaagacgtagacgcccaacaacggcggcataataggccagccgtgcaggcggaagcaccagtcggcggcggacgaggcggccggtcggtgaagacgtagacgcccaacaacggcggcataataggccagccgtgcaggcggaagcaccagtcggcggcggacgaggcggccggtcggtgaagacatagacgcccaacaacggcggcataaaggccagccgtgcaggcggaaacaccagtcggcggcggcgaaggcaagctggtcggtgaagacgtagacgcccaataacggcggcataaaggccagccgtgcaggcggaaacaccagtcggcagcggcgaaggcaagccggtcagtgaagacgtagacgcccaacaacggcggcataataggccagccgtgcaggcggaagcaccagtctgcggcggacgaggcggccggtcggtgaagacgtagacgcccaacaacggcggcataaaggccagccgtgcaggcggaaacaccagtcggcagcggcgaaggcaagccggtcggtgaagacgtagacgtccaacaacggcggcataataggccagctgtgcaggcggaagcaccagtcggtggcggacgaggtggccggtcggtgaagacgtagacgcccaacaacggcggcataaaggccagccgtgcaggcggaaacaccagtcagcagcggcgaaggcaagccggtcggtgaagacgtagacgcccaacaacggcggcataaaggccagccg

SEQ ID NO: 87373 - DNA, 665 bp, Oryza sativa
cgtgcaggcggaaacaccagtcgacagcggcgaaggcaagccggtcggtgaagacgtagacgcccaacaacggcggcataaaggccaaccgtgcaggcggaaacaccagtcagcagcggcgaaggcaagccggtcggtgaagacgtagacgcccaacaacggcggcataataggccagccgtgcaggcggaagcaccagtcggcggcggacgaggcggccggtcggtgaagacgtagacgcccaacaacggcggcataaaggccagccgtgcaggcggaaacaccagtcagcagcggcgaaggcaagccggtcggtgaagacgtagacgcccaacaacggcggcataaaggccagccgtgcaggcggaaacaccagtcggcagcggcgaaggcaagccggtcggtgacgacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatat

SEQ ID NO: 87374 - DNA, 6319 bp, Oryza sativa
tccaccgctgcctcgacctctccactgccgacctctctgccgctcaccctctctgccgaccttcccgacgccggcctgcaccaccgccgccgcactcactctctcgaccgccgccatccatctccaccgccatctccaccgtcgccgtctcgacctctccgccgccatctccgccgccctctctgccgccatctccaccctctacaccgccctctccatctccgcctcgacctctccaccgccctcctcgccaccgccctctccactgctgccgcctcactcactctctcgaccgccgccgggacctcctcttagtcgccacgccaggaccatcatcgccgccaccgggatctcctctccgccacctcctcctctcgactgggacctccacagtgcgccggccgggactcgtcgtcgccgtgcgccgcctcctctgctcgtcgtctcctctccaggtacccctctctctctgatgccgatgaatggaatggtggagttaatggatgaatgaatgatgcaatggaatggatgagattttgttcaatggaatgaattgaaaatgcatatgtataattgtgctcttttcttgtcattccatacagattgtgcactgtatactgctttatatgttgttttgttcccttttgctagaactattgaattttggggataatgtttaccattttttttagctgaaaatgatggattaatagattggcaacagtgtggttagataggtagggtagctagctagaaatagtttgtctagctagctagttaggggtaatgttcccttttcctataaataaagcatatacagggtttgaattttagttcaaatggatgaattgatagattggctgtagatttaatgtagttctgaggttatcaaaccatcacagaatacaaaatgcatggggaatttttggtggattggtcagtgtagtccatggacggaaccgacctagacaccaaaattctccatgcattttgttttctgtcattctttgataattaaggaactttattaggtttagggtttgaaatttagttcaaatgaaagaattgatagattggccgcagattacctacacttgttgatttatatacccttgttgtctatgaataggtgaattgcatgaattgttgtttatatacatgatttatatacccttgctgtctatgaataggtgaattgcatgaattgttgtttatatacatgatttatatacccttgctgctgctgccacataaattattgtgggctgttttattatctacacttgcctctgcttgataaattaatggtgggctgtgatgaatgctcaagaacagaaatacctctaaacttgatctttttttaatgcataagaacagattatctacacttgttctttttttctgcataagaacagattatctacacttgttgatttatatacccttgttgtctatgaataggtcaattgtatgaattgttgtttatatacatgatttatatacccttgctgctgctgccacaatgattgtgggctgtttattatctagacttgcttgaattgaatggatgaattgctgtttacatgaagttagtagtactgtctccttttttatctacacccctgctactgctgttattgtgggctacttgttaatacacctgttccttgttttatgttgttgctgcccctgtggagtatctttgcccctgcttctgctgcccaatgtgttccttgttaaatggccagtgatgaattgctcaataagaacagattatctacacttgttcatttttttgccccaccacttgttcacttgttccttattaaatggccagtgtagagtggttatatacctctacacttgttctttttttatgcataagaacagattttgtgcacttgctctctttttatgcataagaacagattttctgcacttgttcatttttttatctacaataatatatgcatgatttatataccactgctgttgttgcccctgtacttcttgttaaatggccaaggatgaattgcttaataacattctatctatacctgttcttttctttatggataagaacagattatctacacttgttgatttatatacccttgctgtctatgtgaatttccctctgctgttgctgtttatgtgaatttccaccctgctgttgctgtttatgtgaatcgccccctgctgttgctgcccctgtggcatatatacccctactgctgttatatggccctgctactgctcttattgctgctattatatggccatgctgttgctactgctctaatttcctggacttgctcttttctttatggataagaacagatgaactacacttgttctattttatggataagaacagatgaactacacttgttctattttctttgggttgctttttcctcctagtagctgatttcctctttttatcccttcatgcaaatgattgtaatttatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatctataggataaattttcaccacatgaccacataaattttagctagcaccccttagcaaatattgccttctgtttgtgctgcagaattgccgcaggaacaacatacgtcgatgtcgggcgggacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggctagcggcacgtgagaacttcgggatcctccataaagatatcgggaaggtcacagaagccgagaaagagcgagcttggacggcaatggagaaatggttcacatttccagccgaagcaaaggataggctcaagcggaaggcattccaaaagatgggcaaagcttggaagaattggaagtcgaagctcttcaccgagtttgtcaacccgcccggcaatcatacgccgttcgatgaataccctcaaataaccgaagcggtgtgggaggaattctgctctctcaagaccacccaagagtttagggaatcaagcgaggcacatcgcctactgcaacagcggaatgagcacccgcatcggctgggcaccgcagggtacatcggcaaggaggcaatatgggcacaagaagatgcagccgctgcagcagcgaatgtccctgccccgttttcagccatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaacgactatcttcttttctagttgggcttggttgctgaacaagcttcacaaagcgaggttgagtccgcgccgaagaggcgcgaagatgacatcctcacaaaggcgctcggaaccaaaaaacatcctggccgaactcggggaattggtagcgatgtgccctggaagcatggactccctcagtatagatcccaatacaggaaacgaaaagtctccaaggaagagagggacgctcgtttgaaggccgaacttaaggttgaggtcattcaagaactagaagctagcatgaatgcaagggtggaagaaagggttaacaaggtcctcgccgacatgaatataccccgagtcacaacacctgctgtgcaaccaactcctcgtgtacaacacgacgcgagtccatcacagcataggagtagttgtgcatccacagaggtgccggcccctggtctcccgatcgcaccactagctgcagtggaccacatcgaggtaattgttgttatccgatccatatctaataaaagacatgtacacattccaatattaaattcaaactttcaccttatgcagggtgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgcggcaaggggaaggtcggggagttggcgccggagccaaaaaggggcaaggctgcgacgtcggtgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggttttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttacgacagagcttcactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggcccatatgtggaaaagggtggtaggcacaaggagggcaagaacgaactttatcatgacaccaagtttgcatgcgcaaaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaacccccccccccccccccgctatcagaggcgaagtgtgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctccttttttttcccttattgacaggttgtggaggtcgagtacattatggctttaatccatttggtaagtatatatgcggttctatgagcaacgaccgaaattgtggctttcaaggggtgtgaatttgctgtgcaaaattgtggcatttgaactgcatatatgtgttgttggggatctgtgatgtttgagatggatctgtgatgttatattgggggggtgatgtatctgtgactagaatatatctgtaatgtatctgtgtttcagagggcatggctagccaatcctgaggctagccaatatttagcat

SEQ ID NO: 87375 - DNA, 657 bp, Oryza sativa
cgtatgcgagtatgcccacttcctatcaacccaaatctacaccacacgagagctcggtatacgtatatataaaccattcaaaatttcattgcgtatcgatttgctgtttattaatttcatatattcatatgtcattatttttcgaatgatagtgtattcacatgagggacaatctcccacacaaggattatatcacggctgttcaagaacaactgatgagattcatcaacgaagaagtccttaatcccgagggtgaattctactacaacggatcgacaattcataacgtcggtccttcttcttttgacataatgccggcgtcaaagtcgtagctagctagtgagcaaatgaattgtactatacatgcatgtatatgtttatagatgtacacatttactttagtgtaaatatatattttggtaatatatatgcacataaaatgttaagtgctttaaattatacatgtgtaatatatgtatttatacatatgcatatgcatatatatatatatatatatatatatatatatatatatatatatatatatatatatatatatatatatatatatatatatatatatgtattccatatatatatatgtgcgtaatatatatagcgtaagactattgtacatatagaataactattctatac

SEQ ID NO: 87376 - DNA, 800 bp, Oryza sativa
aacttgtctagtgaaacacttcagtggttgtcacagggtcctgaatggagtgccaccacctggcaaggatatgacataaatggatacacctttcacacagtaaagcaagacagcaaatgcacagtgcagaacagtgggttacgcatcgaggctgctagtgacggtggtcgtcgtgatcaatactatggtaaagttgagcaaatattggagctagattacttgaagttcaaagtcccgttgtttcattgtcgatgggtcgatctttgcaatgtaaaagttgacaatgaaggtttcaccactgtcaacttggctaacaacgcgtacaaggatgaaccgttcgttctcgccaaacaagttgttcaagtgttctacatagttgacccatgtaacaagaaactacatgttgttcgtgaagggaaaaggagaattgttggattggacaacattgcagacgaggatgattacaaccagcacgtccacggcataggtcaagaaatacctctagaagaggaggaagaagaagatgaagttcaatatgcacgtgtcgaccatgaggaaggattatttttgtaatttatgtacgtagtttatgtctacatgtctgttatctgtatgactctaatatgtacgcaatgatcaatagtatattgcttatgaaatagtcaaataaaataattaagtataaaaaaatatgtagtgtatgtgaaaatatgttaaggaaaataaaagaactaagtgaaataaaataaaataaaattgctctaggcaaactcacctgtgacgggctctatctgtagggc

SEQ ID NO: 87377 - DNA, 1095 bp, Oryza sativa
gatactcccctcggggtgtgaacggttccgtacataacccttaaggatccccaggtacctttcgcaaggatacatctgcgtcatgaatgctggaccacagcactttgtttgcctcacaaggtgcaccggaagatgttccattatgtcaaagaaagttggaggaaagtacatctcaagatgacatagggttctcacaagttctgcctgtagttcatctagtccctcgggatcaatgatcttctgcccgattgcatggaagaaggaacacaaccgctggatcgtgtgtcgcaccttaggaggcaaaatattccttattgcaacgggcaacagctgtgtgataagaacgtggcaatcatgcgacttcattccaaccaacttaagatcttgcagtgaaacgagcctactgattcttgatgagtaaccagatggaacctttataccactcaaacatgttagcaaatcaatcttctcttctttcgagagagtgtagcaggctggaggaaggtaaaccctgccggattccgtggttatgggatgtagctccgaccgaacacccatatcttccagatctcgtcgggtgttgagaccatcctttgtagtacctgggttaagcagtattcccattaaactctcgcatacattcttctcgacatgcatcaaatctatgcagtggcgaacttcaagatccttccagtatggtagtctccaaaatattgacttttttttccacatgctcctctcttttgtcttttgtttttccacatgctcctctgttttttccttcgatgtgctcttctcttttcgctttccaactttcctcttttttccaaactcgttggttattcccatcactaagttgtgcacctctgtccctgttagctctgtcgggggtccggctgtatctctgtgtccattgaaattctttctcatattcctatacgggtgacaccttgggagaaatctcctgtgacccatgtagaccgtcttgtgtgaagcttcaaccattttcttcttgtttcctccatacactccgaacacgcccatttccctttcacagtttggccagaaaggttgccaagggacggataatcgttg

SEQ ID NO: 87378 - DNA, 4045 bp, Oryza sativa
cggtagagccacaaaaacacacgattgacagaacagcacccgccgtggcccccagagcagagcagcggcaccgcttcccagcgaatcggcgatagcgagccggcatcgtccgatggtgctttcggccggcggaacacgcgaccaacacagcgtgcaggtaggcaggcagatggtgaatttctttatccacgcaccacgcaccggcacacatgtccgggagacatcatcccgcacacgcatattctcgcctccgcgcgccccgtgcaacgtgctgcatcccagaaaagcagctccagcctcccggatgaaaagctcctcctccccttactactcacttaggctcgtttgaatagcatgattaagaaaaacaagagacatgaaaaacagaagtacaagtatacagaaaattacaaaacgtaggaaaaatatataaatgaccgtttgatcggaccgcaagaaaaatacaggaattagatgagaaaggtaaactcaaaaggaaatttttcaagagattgtagctcttggtaagtttcctctaaaatctatatacgatgaaccagtaagttttctctaaaatctatgtacaatgaaccattccataggagtttcataggatttggaaaacctcaatcttttgaatcaaatgattattaggaaaattcatataggatttaaatcctacgaaattccttcgtaggatttttgattcaaatgggccattgctgataccgtaaagtagtagtaaagctaccgtcaagaatccagcactgcaactagctaagctagtagtagtagctgacgagcaagcaagcaacaaccggacagcggtagtgctgctgctgctagactgctagtgcattggaccggatatgtattactcccagaggagaaagtgatgtttcctttgtttcagctctatcccacaggagaaagtggtcactggaccctcactacttcgccattgatgctcgcccaaccgggagatggctttattatagagtaatcatcgacaaaaaaggccgtcaaccaccggagatgatggcgggaatatgcttcctgccgtggagttcagttcagtcacaactcacataggactacagcctacaggagcgagctgagctgcacttacattgctactactagtatcaatgtatcatgtatacttcctggccgtattggagcgtgccagatcgcatgaactcacacaaccaattcgccgtggtcctcgtctgtgcccagcagcagtgcccaaaaacaacattggtgtgcacttatctcgcgatttgcaagttgaccaaatgaccatcacaactcactagtttgttcgagcacactgacatcgtttttacaccggtggtctgggcatgcggttcccgtggtttcagaccacaactgaattcccgatcttcccagaaaatactgtaactgaccggtgaccggtcagcggtcacagactatgttctggttttatcacaaaagccggatcaatatgatcatcacacagaaaatgagatgtcaaaaccaaacaaaacaaaatatgccatgtgaagacaagtagacaaatcgctcaaacagaatgcggtgaagatatgggaagacagatcggcgagatcttatcatagttgcactttcacagtacacaagtgagtggagcatcagtccctctaggagaaggcagacaaacaagcacatgttgccatgaatgcctcaatcttaaggattggtattaggcatgcaaaaaatttcggggttttattgagtcctttagttgcctctcctaccccgaccgcggaaaccacgcccgccacctcggccaccacctcgtcctcctcccctacctccaccgcccttgaagtggccaccacccttcttgccattggacttattgccaatcttcatgtcctccgggagaggaagtatgctgtcaacgcacttacggaagctgaaatcatcagaggatccatcaactcgtcgaacgaagaaacagcggctctgaaacaccgggtggttgcggatctcaaatgcttcaattcctgctccaattttcctatcggactcagcatggcctttcttcagcaggtcttccaacaccatatgctcatactgcaaaagttaagcgattcagcaaactcaagtgtgacagtagcaatgacaatgcaaaaagtaaagtgacatctggatagtttgaaccagacaaagtacagtacacaagcacataggcatctggaagtcaccacaattgattactgtgaaactatagtcacttccagcaatgagcttatttttctcaagggcaactagagatgagcttattgtggtaacataaacatcccactgacaaatagttttatcttccaattccaaacaacgatgaagtaaaagatgcaaggctcaagtatgcgattattttgatcacatgtagatgaagaatcatagtgtatttctttgtaactcatatatgtgtcagacagttcaatttatgtgcaacatatcataattgcagccttaatccaatacaattttcttataagagtgattagcaaaccacctagagaccttgttcatgtatgacagaaaacaaagtgatctcttttacctctactgttgcatacttgctaaaaacaggtaggaataaaccaacaattttctttgatagagaaaaaaattgctacttatggtctaactcaattttaacagaaaatgttgcgaaacaccaaaggaccatttggaggtcgcaagctaaccagatttaaattgcaagtcataacataacacttcaagttaaacaaacatgcctgaagccccaaatagagtctgttctccttgtggtacaaccatccttaagtaaagaacccagtcccagttcgtcaaacactacatggaagaactcatatggagtcccaacatatgaaggcagtgcagctgaaagagtattaaacgtcatatgctattccgtaaatgaaacttaccatgagaacctaaaagaaaagctaagtgaaagaattatactgtttaagcactaaatcactggtactactgaactcaacccaacatgtccattcacaaagatcattggtttagaagtaaaatcattggtctagaagtacctaatatacatacgaaatgcctaaagcaacctctccaagcttaataacatccttgaccatgacagatcaacccaatgaaactgggggctctacggagtattcaacgccatatgctattctgtaaatgaaacttgcccatgagaacctaaagaaatgctaggtgaaagaaggataatgtttaagtgccaatcactggtgctaacgaactcaacccaacaaagatcattggtttagaagtacctaccatacatacgaaatgcataaagcagcctctccaagcttaaaaacatccttgacagtgacagatcaactcaacgaatctgggggctctatggagtttcatgcaaacttggctaaatacaaggcgaacactcagattatcatgtcgaattatttagccgattggatcaccggtttcaaaggcaaagtactacctaatacgggcaccattatacaccactaaagctaattaaataacctaccagcttatcactacagctacaaggataaaacttttatcataccaaagtttagctacaacaacacacatcgtgacttcgcgagtcatcaataaagcaagaaactttttttcgcggccaaaaacagcgagaggccggccacgattgacaaccgaatcgcaaccctcaccttgttgatctcgagctgcggcgcccacgagtggagcagggcgaagaagtagtcgaacatctcgacgcccgtggcgaactccttgggtcccagcttcaccggcttcgcctcctcttccttcgcgccctcctcttcctcccccttcgcctcatcctccgctcccttcgcctccccctccccctccaccttctgcttcttggccgcagctccctccgccgcctcctcgccagcagcgccggcggcggagtcatccccctcctccctctccctcttctgactcggattcgccg

SEQ ID NO: 87379 - DNA, 631 bp, Oryza sativa
tccaaagacctttattttcatattgactttggactgccatatccattcgatagtaggtgggggagtgagagccagaaaactgagcttgtaacagagtcgcgaagtgaatttccctgatccccaaacgaatgtccatgaatcatcaacctcctgaagggtaaaggaatggagattttcttgcatgtccttatatttatcaaacgcttgttgcgaaaggggaaggaaaaattgatcttgggggtctcttgataagtgttgtgcaatagattcatttccgtgctttgcgaaggagtataaacggggatatttgactgaacgtattactccctcccataaatcatcccaaaaaagaacagctgtcccagagcctattattggttttgcaatgcttctaaacaatataacatactgaaagatgtccctccaccaaaacgaaccacaacttctcacagtctgaggaactgcgtacttgtaataagaggaccaaataagatttacccaaggtacctgagttttgttgtaaaatttgtgcaaatgtttcataagtagggctctattttggattctcaaatcaatcactccaagccctcctttatcctttgggcgacagactttagaccaagctgctaaa

SEQ ID NO: 87380 - DNA, 974 bp, Oryza sativa
ggcgtcatctattaaaaaacggagggagtattaccaattcactgccagatcaagaacattatttcacagctttggtttaatatgtcaactgcaaataattgaaacaaataagtaccaagagtcaagaagtatacccccaagacaatgggcagctacactagtttgttgatgatttagaagctttctggatctccaaagttatcgcctcagcaagatcagatgcctcatactctgctccaaagcatcgtgctgtctccaagcatggatctagcaagtacctgtatatttatacagtcaagtgcctgacacattacaacaaggcaagctatatagaataataccgtgcgtgcttacatgttatgagagctttctacaagatagtcctgaccaatgtcatcaacctttttgaagaaaacacggtattcctgtgcaatctgtcttactgcattgatggatcccgttagtcctattattcttgggtcaaactctgccgttcaaagaaacaaactaatcattcccaaatacagtgaatttgaaggttccaatagcatgaaaaatagagagcaacttaccactaagatatgccttaagctgagcaggtgaatcacgttgaggatcaattgtgataaagagtggtgtaatcttggtgccatattttgactctatgaaacgacaaattaagaactgtaagaaaaggaagatcacaaatgtaatacaaacaacagagttcagataaatctaattattataaggaaattatagcatacataaaaattaatattttatagggagaactactaccaatttaaaaagcccagctaacagaatctacatcagtgaaagctcaatgctttcgtgactctcagtaagccacgtaagcagataatctccagccatttgatgcaaacagaaggaaatataaaccgccagattggacaaagacactagcgaattggtcaaattggcatggatgt

SEQ ID NO: 87381 - DNA, 1779 bp, Oryza sativa
cgtaaattttttgaataagacgaatggtcaaacatgtacgaaaaagtcaacagcgtcatctattaaaaaacggaggtattaaaaaacggaggtagtacttgataacatgccttgttgttgtgtttggtcacagattacttgtctattgcctactacatagagcctgaaacaacagctagaaagttcaatctatcaataccttttagctgtggtgctaatattgttgtacatgcaattaaatgttctgcttttactttcttggtacttgatccaaacaatctcttgaaagatctattacagatgtactttggattatacacgggggagaattacacatactagtttatcatttaaatcttgaagatactgtgatgtcgacacctcatgcatagcatgtttgttacaagagaacattttcatgtcgattttttatccattattttagttgcgctgctaacatggattcgttttcccaggacctagttcggcacaatccaatgtttgctgtgaagcactttctccctctcccctgtatagccttgatcacaaaagggtgacatggtgaacctctcatttagctctgccaccaactgattccagctcctgttccccgctcctttgtgtgtaagaattgagcaaaactgtacagcgcctcctccgatgaaaattttccagctacgattcacttgcaattttacgatcacagaattctgtggcaatgtctatttgatgtaccaaaactaccttgtagaacaggtcctgtaggtagggatgaaactggttcggatagtttccgtccgtctgaaccaattttcggattcggaaaaattcggtcggaactatccggaacttttcggattcggaaacgaattcggattttttttctcggatacgaaaacgaatacagtaagggtgatatccgatggaaacgtaaactgtcggaaactatctgggatttttcatcggatatccgatattttagcaaaagagagatttttcagccaaaaaaataaaaaaaccctaaaaccctagccggccgccttcgcgccgcccactgccagccgccgcatggccggcgatagatccgcgccgctgcggccgcctgccgctggccgtcgcggggctgagcgccgaacacctccgtaggacggcagatccggcccctcccgagggcggcgccgctggatccgccgcctgccgctgtcgcccaccgacgctgtcgccgcgcatcgaagccgtcgccgtagtcgagcccgctgccgccgcccatcgccgtgacccggccgccccaaggccggcgccaccggattcgctcatcaccgtcagttgcacgtcgtcgcctcgcgccgccgagccctcgccgtcgcctcacgacgtcggatcccgcggctccgggaccgccaaccctggatccagccaccacgaggctcgcgtcgccgttcgccgcacgccgtcgcctcgcgccgccacgccccagtcatcgccattgcctcacaacgtcagattgggccgctccggggccagcaccgtcgaatccgctcgccgccgtccgttgcacgccgtcgcctcgcgccgcggagcccacgacgtcggccaccccgaggccggcatcgccatccggcgcacgctgtcgtgggaggaagggtggcggctaggagagtgggactgtgggagtggccgggtagggttaggtttatgtatccctctatctaaatgggccaacgggcctaagaattagctaataagtctatatgtactccctcaacttcgaattaaatt

SEQ ID NO: 87382 - DNA, 5017 bp, Oryza sativa
  unsure (1)..(5017): unsure at all n locations
ccgccctggccgccggagtcgacgaggagcacgccgcctggatggtccgtttccgttcaccgattgatcgatgttcgtcgcgttcttggcgcgcgcgcgctgacactgacatgaaccgtgcatttccgttcgtctttgtgcaggcgaggcacccgtcggcgctgggcgagttcgagaaggtggtggcggcgtcgaaggggaagcagatcgtcatgttcctcgactacgacggcaccctctcccccatcgtcgacgaccccgacgccgccttcatgagcgagacggtgagcttgagctcccctcccctgtcacctactctgctcctccactcatcatcatctcacacctctctccttcctcatcagatgcggatggccgtgcgcagcgtggcgaagcacttcccgacggcgatcgtgagcgggcggtgccgcgacaaggtgttcgagttcgtgaagctcgccgagctgtactacgcggggagccacggcatggacatcaagggccccgcctcccgccacgccgccgccaagtctcctccccacaacaagggagtcctcttccagccggccagcgagttcctccccatgatcgagcaggtgcaccagcgactcgagcaggccaccagctccatcccgggcgccaaggtcgagaacaacaagttctgcgtctccgtccacttccggtgcgtcgacgagaaggtaactgatcgatctgcaagctcgattggttgattggcttttttcatttggtgatcaattgatgatggaattgggggtgcagagttggggggcgttggcggagacggtgaggagggtggtgagggagttcccgcggctgcggctgagccaggggaggatggtgttcgaggtgcggccgaccatcaagtgggacaagggcaaggccctcgagttcctcctcgactcgctcggtacgtgcagtgtgttactactctacaactttgccattcctcgtcggcaaaaaaacccattggctctgctccgccgcaggtttcgccgactgcagcgacgtgctgccggtctacatcggcgacgaccgcacggacgaggacgcgttcaaggtaaataaatacttgtactactaaccgacaaaaattactgcatgctgccacgctacgactacgtgtagcagcagcagtaacacgagacgctaccactacttcgtttgcaagtggttcgacgaacgtacggccggttcgtcgcgtgcagctagcgacaacgtacgtcttcttctacgttggactaatcggcgagccgtgtgcatgatccgggcaggttttgcggcggcgtgggcagggcgtggggatcctggtgtccaagcaccccaaggagacgagcgcctccttctccctccaggagcccgccgaggtaattaagcaaaaccactcgtacgcacgcatgaaaacgttcgtatcactctgctcatgtttgtgttgcaattgcgacaacaggtgatggagttcttgctgcggctcgtggagtggaatcgcctgtccaggacacggttgaggctgtaacaattgaatttaaccggcgaggctagctagagagaagcgcgtgatctgggccgtccaagcgattacatcggcagggtaacccgtgacgctgatcgatcgtggattctacaccaacacaggtgctcgaaaatggtgtccacattgcagaagcgcagagagctaattaatcaacgacggacgagagaaactgatggctgtctggccattgttgtgccataatcctgtttagttcttcacctttctcccttcttcttttttcccatttggggccccccttttggtaccaaccatgtaaattccgtactactagtaccttgtcatgcacaagaggaagatcaatgcaaataatgaagagcaactaatgcaagtatatactcatcagcacattttctttctgctagcttagctatagctcttgctctgatctgatgcaccaatgatgcattacacatttgctttagctgaagaaaagctcagtgcactacccactgccggcacaacgtagcaacaggctgaaccgcatattggtcaattgggtgagtgtaaagcttgatctgctcgttgatggatgttgttaggacgagcagtaaactgggcctcactcacatgatcggtagcacggagtggtaccacggcttctctactgctctctgtcaatggatccaacgacacattgccttgtcatgttcttcctgtgaatcatgtcctcatctctgaagaagggcctgccagagcaacctctttcagcgtgttcttggtgggcgaagctttcactgatgcacaaaatgagcagcaatctttgatgaggttctgtgtgctcgttgaccactaatttgttcggatcgaaagctcgacaatgtcagtaactatcactgcatcatgctctcgcacacatcgagtgaatgagacatcctcgatcgactcatttaagtagattgcagtaataactgaaacgagcatcgattaaccaacttggatcacttgcaaacaagggaaggtaggtacgacgctgcatgcagattgattgatctggtcagatcataatagtctcgcttaaaaattgcacatgaatcgcactcattttggatttggatgggactgatctcgattgtacacgttgatctgccttgaagagttacacgacaaacacagccggcccacaggcaaaataatccttggaaataatgcagagaaaagattagcatctgcaagaacctcgtactgagaagctagctgttggatcgatccatggtgcatttttctgcatccacagtggggtgaaggacttaaggacaaagtgagcaatcatcaacagatatactagtacgagttaatcataattatgtgttagatccagtgctagctatgatctagtagttaaaatcatttcttcctcctaacaatactagcatatgcaccgataataatcaacgagagaagtgctagtgctggttctacatgcctacaatccacgcatcatatcaatcattaaggttgatatttcagtccaatggcgcactatgagagagcccaaaaagtaagaaaaatgaggggttaagtgattttactacacacacaaaacgactgtccacagaaaccatgccgatgtcactgataggtgggccccacgggctggttagacttcgggggcccttttgtcggcggctatataagaaatcacagtacacatacatagctatttttttcttttttttataacaaacttaaaaatagtcagatatttaaactgttgtcgatttgcactctccaaaaagtttaaactgatggtgaagtgatcaaatgccaccatccccattggccagccccacatcagaaaggagcaaccaattggtggaatcttggataatgtatcttgatatacacaagacataatatttaccatttggggatatcatctgtgaatcacagttagtgtgcttatggagaccaagtccatgtgaagggtagtgggtgccatggaccccaccaactagcttatggagtagagacaaagtggcaagcgaactgctatagaggggacagcgaccgaccgattgatccatcgagcgaacgatcgattgaatgtagccctactatcgagagacgtctggcagttcccagcatacggcagactgtgagcagcaacttgtcatgccttgncaatatatatactgtataccatactataaacagactgcaggcggttgcgcatgctgactagaacttctgattggcgatagagttcaaagtgccatacgaagaataagctgaaggagttctttcttcttgctttcgaagctcagctatattgaccgagtagcagcagaactattttatttctcccatgatgtgggagctggattgagttgacttagagttgggaaattatccaaatgcattgtgaatcacaaattggcacgaggcaagttaacagtatgacaaagtgttactgacagattttatgtggaacagggccgggttgctttgggaacaatttggggtttttccttaatcccttatccagatacaagccaatagtagtagcaacaaccgacctgaccgggatctaattaagtcaggtcgacattgaacatccttatcaatgccacttttacataaaggattatgaggctaagcaaatcaataatcacctctctcattgctaatggatgaactgttaattggtggggaattaaacagcgcatatgaatcaaatccacccatctattcgctgaattattttatccatctaatcttaaacaggattgtgccctagctagcatactagatgtgcttatcatgatagactttcgttccaagcaattatcatgataaacatgccatgatcatgaatagttagccttaaagcgcgagaaaacacataattgaatggctggcctgttgttaatttttaggtggctccatggagccaatcatatatatgtgtaaatggtttgataggatattaccgtggatcaagcattaattgcatgggaaacattagaaaaaaggagtacatttaagtttgatctcctgttcttaccaacttgaaccccataactttaccttttgttttactttgaacctctttccctcgaaatgttgccatctccaggaagacaaataaataagatgttattagtacggtgatggagacgagagtagcatggccagtaaagagagcgcgctagtacaccaagtagagcttaaggaaaacaataaaatacatagtgaaaaagagataaataaggggttcaaagtgaaagaagattaaattgggtctaatgtgaaactctagtaaaaggaagcaggggcaggcccagaatttttgttgggtattcgaaatagaaagggataaaaaaatacaatatcaagcctaataaatgatatgtatgtatagtttcgtatagttatacactatataatatataatggctataagcatattttcataaattcatagaattggccatgaaatgaatt

SEQ ID NO: 87383 - DNA, 3456 bp, Oryza sativa
cgatcaatccggttttttttttgatgattttcaatatttggttggttcataagtagtgctatagccgtgccttgcgattgcagtgtcgtccgtgacaaatggcgatgttgggcctaccactcataaatctttggctacatagttaggttaaaacaagtttgtttggtagagtttcaacttttaaatttaaccccaaaagctgagtttaaatcggagttgtgaagcaaccttaaaccatgcttcacttttctagtttattttgtcagggcacttcaaccgattctattttctttttgagtttctagtttattttgttagacacttcgactctgttttctttttgagtggctgaaactttatgattgggatctaacaccaggaaaaatagaacagaaccaaacgtacccttaaaagttatccacctttcatggcccttgagcacccggccattggtggaccgcccagttattgctggcctccaattgggacgagaagcctccgggctccagacataatcactcacccaacccaagcagtgtccaaccgagcagcccaacaatcaaactgagtgccattttgccacaaagatcaatgagagattgagagtaccaaccaaacctgccagatcccatcagggcaagcaaaacttggcatgtcactgcctagtgccaacatcgctgcttgctgcatgactgcatcagaaacatataaccaacacaacaaacagcaggtaaacttgtctacaaacttcacccagaagcataaacagaatcaccatttcagttacaaaaaacgctgactggcctagtcaggagccaccaacattcggaacacaaacaggtaaaaggaatgtacagttgacgggtataccaccaccaccaccaccgaatcaccatctttctgacgaaacttatttctttttgtcctatataaactgaattcaaacaaatttaccaggtaatgggtatgatcctgtaacttaacctgaccgaccaacggcatacgcctcgcgggcagcctcggttgagttcttcacgctttcagacaagctggacatggctgttgaaaactttgacagccgatcgaacatggttgctaaaccggcctgcagggttgccagcttcgatccagtctccggtttgttaccttctgcttgatgattcttgaacattttcttgagatctgacatgatgttcttgatagagcccaaggtttcttcacccgggagtgacgcgattgctgaggaccagtcatcaaggagcacgaacatgggaggagcaaggtgccggcgaggcgagagcgtcagcctccttccccgggtgtgatcgtaaggttgcagcacgcatttctgcagccaggagtggagaccatccacatagcatttgtaagcagcaatccaattcgtcaagctggagtagaagaaacccatctcgttgacaaggttcaccaagggctgcttgtacggctcgccgcgaggagatctcaggacataaacgatatccgacgacgagacgatggtctgctgaactcggtgaatttcatgcatcattgcccacatgcgcgtcaacctatgtcaagcacgataaaagaagtatccaaatcaatgccaagaagttaccaataagggcaagcttgatcttggtttgagcgaattcgcatttgatgaaaccatgaatactttgttgaaagggtgcagcatttaactgaaaataaaaggaaacatagttctgacaatggacttacccttttaatagttcaagaagttggggctgcagctcttcatcccttaacttctcaattattttagagattgaatatagcacttcagtttctaccttgagccgcgaatacaaatctttaacaataactcgagtcttgtcaacttgtctggcactcgcatccctttcaaattggtgccttaactgaacgcatttcttatcatatatcttcttgagtgattctgtaccctgcagttcataaagtagctaggttagagtacagaaatccaattaagcagaaaaatatatagtatgcctcttacacttagacatagtaaaatactgtagcggttctttcccccatttttttgttactcctacaagctattctgaacccaaaaagatcatgacactaatgaggttatatcctaatgcaatttctgcattctgtaacctgtaggaacctctaatagataaatacaaataccatatataaccccagatatttaagacattattacaagggagtgattataaagatttaagatagtgaaagaaacatatatggctgtgtgcattcatagttgatgcagaggctcgaagctactgccactatataaaagaagtcaaaacaaacaaatcagcatgttcccttttttcaccaaggcctccctgaccactcgctaactcacactcctccccacgcttcccaaatctactctccaacataaccttcttacgtacttcgccaatgtaatcaaagttgccttcagccttacatagcaatcctctgcccccaatgcataacttatttctctaacacatcctatgcattactcaactcattttttatggtatgcccataaatttaggcacttgttttttgtttagacgttagaaatgtgctacctccatgactccatcccaaaacatagctacttctggctatgtacctggacaagtacttgtcctggtgtatagccagaagtgctatatttcaggactgtggtagtatataagtatcctcactttaagaaatatctatgctaggggtgttatatggttctcaaaagatagaggtaccttcagtaaaaagtggttgatgattgcaatttcctttaaagttatggtacctataatacctttcaaacaccgacaaacatcgcttttgaaatataatacacttttggtatgtgcaataggtcactgtccgatggctgttatccagaaagggttgaataaacatgtcaatacgtcatggtccccacataggtaaggcgaagtgtgccctaggctaacacttgagcaccctgtcgtttgtgggaagaagatccttacaagcatactataaagctcaataataacatctaaagctccacctcactgctcactgccactaaaattagagaaggtgagcaaggaaagcaaacgtgacggtggtttgcacctagacccagttgtgacaaaccgacaaaaagacttgggcacacccaataggtggctttaaaattagatgttctttcgtcgacctaggactaacacgccaccgccattcgccacattctctctggctttaacaataactatgtggccttaacaacatatgtatcttctctcggccataaggtgaggagatacctgcgatggcagatcttgaatgccttaataaccatatagttcttggttgaacaccttaataaccatatagcgttagcccatttcttcatgcaaatgtatg

SEQ ID NO: 87384 - DNA, 1767 bp, Oryza sativa
attcgattaatgagataggtggctgcctgaaaggcttcatcccagaattttaaaggcatagatgcatgagataaaagagataaaccaatctcaactatatggcgatgttttctctcagctgagccattttgttggtgagtatgtgggcatgacacatgatggataatgcctatggtagagaaaaatgagtttagagattggtattcacctccccaatcagtttgcatggcaagaatttttctatcaaattgtcgttctaccataacttggaactctttaaacttttcaagtacttgagacttatgttgtaaaagatagatccaagtaaatttactaaagtcatcaataaaactaacatagtatttctttcgtccaacagattctggagcaggaccccatacatcagaaaaaaacaagttccaaaggatgtttagaaatactagatgacacaggaaaaggtaactgatgactttttgcttgttgacaagcattacagactgactcgctagacaaatctgaacaaggaagactaaatttattgactacttgcttaacagtagagatggagggatgaccaagacgacgatgccaccggtccaaggataatttgatggcgctgtaggcttgcttcaaggaggattgtggtagggggtacagcctgcgccaagatcttcctttaagaagagttttcctggtgatttgatccttaagaaagaaatagtcacgatgtaattcaagaaaagcagagttatcatcaactaagcgatgtacagatacaagatttttcttagcctgaggaacatataaaacattttttagatgaatattacgactatttggggtatgaacaactgtatgaccaatatgacttatatccatacctgcaccgcttgcggtgtggatctgttcacctccattgtacttctccttcacggtgagtttctccaattctcccgtgacatgatcagtggctccggtgtcaatgtaccagtttgtgtcaacaccataggagtttacggctgcagctgcaacatgtttagcatcaggaacataatcctcatcatacctataccaacaatctgccgccgagtgaccacgcttgaaacagacttggcatgtgggcctcttgtcgacaccaccaaatccgccagatgcgcgaccacggccgcgtcctcctcctgaattgccacgaccacggccaccactagggttaccgcgaccatgactgctgcttcctccggtgttggagcctcctcggttggcgagattcaccgtgccttcatgtgcgccacggtagatggcctggcgcacttcgaagttgagcacttgggagtacagatcactcacagtgatcggttccaccctagcacacacagccgaaaccacctcgctgtatccttctccaagcccagtaattatatactggatcaactcctcttcatcaatgggacggactccagcgattgccatctcatctccaagggacttcatcttggcgaagtactccggagttgtcatgttgcccttctttgtgttggtgagagcgaatcgagtgttaatcgaacgcgctcgagtgtgtgtggagtacatcccttcgattgcactccatgcttctgctgcagtgtcgcaagttgcaacctgcatgagtacttccctcgtcagagatgagagaagaaatcccaaaacttgctggtcagcggcttcccagtcgtcgtacgccgggttgggcttcttcacggttgcgccatcagctgtgacgctgatttg

SEQ ID NO: 87385 - DNA, 680 bp, Oryza sativa
tttatatggatctgcctgatccttattattatccactttgcatcatttgctacaaattgtgcaatacatcatgggtctgttccatatagcagtatatatttgtttcaaaaagaacaaagtacaaggctgatcctcttcttttataggaaaaagagtttcttctggtcctcttggtgcagggttgagaactttactggatggtccaaatgaaggtacaatcaaatatggcacactgaattctcattgagaagcagttttcagaatgtgagtaacacacatgctaggtcaacatcttggaaggatcacaggtataaactaaagatactgcattaaaagaacttgagtataccataacataaaaggagggttagttcacatgacaatctcaggcttcaggatgcttgacttgatctctttgtgcgggagaacaacaccgccgttggtatagacctcatcacctacatgtacgtcctctcccaggatagtcatattttctatccgtgcccattgtccaacagttgagtgccatccaataatgctgtttgatatgcaagcatgcttcttaatgtgcacgccacgcatcaccgtgcaacgggaaagcctcacaccatcctccacgacgcatccaggaccgatagcaacatcaggaccaatcagacagccttcgccaatcttggcac

SEQ ID NO: 87386 - DNA, 666 bp, Oryza sativa
ttttgatcacactgataatcctggggatgtccctgatcctgttattgtgcaagagcttatctcgatgcttgatcagttcaatcctcttgtgcagcagttccgtcttgctcgaaacaagctgctttcttcaagtgctcctgagattgctatcaagctcattgggtcaggccattctcagagtgaccgttacagccttcccaccacctctgagttggcagcactgattatacctagtgcatcttgtgaggtatcaaagtttgatgtcattgtgcagaagcattcaggtgagttatgtcagttgtcacctattcatccagcccttatgtcattgcagtacccgcttctattcccatatggtgatgtgggttttcatactggtatcaagcttagagaggtagatgatcagccacccggtagtcacgacgaagcatcgatgcttgaattttatcggtacgagtcccactatcgaaaggatgagcccaatccattcacctgttgtggtaggctttctgatcagctcgctgtgaatgctttctcatgtatagagacatctcgactcatataccatgccctcaaccagaaaaaacttcgctctgagacacatcaaggtatatctgatgctgttgctaggggagacagtgatggaaaggatgttggcaccaagta

SEQ ID NO: 87387 - DNA, 698 bp, Oryza sativa
ttcctgcagcccgtaccggaagctcgtcaatagcaggttgcagagagttaattggctctgaacagtaaacagtgttctgctgtagcattcatttctgatctctctcttgcttgcagtttcgctgatctgcagaacccacagatggacatggacgggaaggcctgcgctgccgtcggtcagagtgtgctgatggcgatctatgacacgttatttagccaggttggcgtgccattcctgatggatttttgtgtaaaaaatatgatttttttgcatatattttgacacgttaaacttccttcgctgcagcttgacgtaacatcatctcagcttcttgttacggatcgtgattttatggatccaagttttgggaaccagctccgcgagactgttaattctctgttagatctcaaggttataccagtatttaatgagaatgacgccatcagtaccaggaggcaaccatacgaggtgtgtttcctaatgtgatttgtgtgcactgggagcttcactgatatatacgtattccaaattccattaacaacaaacactaaccttttacactttactgattgtaatgatcaaccgtgtgtaggattcatctggcatattctgggataacgatagtttggccagactgttagcgcaagaacttaaagctgatctccttatcatgctcagtgatgtggaggggctctata

SEQ ID NO: 87388 - DNA, 700 bp, Oryza sativa
ctgcaccccttaagaggagtgattcgtactagttttgcctatgttaagaaattattattattggggaaaataattcagttgaaggtaactagtaactatcaccatctgattgtattactagcataattggtttttcttgttgctgcagccaaggcagaagggtatggtgcaaggtgcacaatttaatactgccaatgcagctcaagcattacaaggtatgcagtccatgggagtcatgggtggtatgagaggaaatggaactattccatataatcagcaacgttttgcccatgcacaagcacaattgaggccgcagcagacatcacagcaaggcacactgtctccacaggtacttgacttccgtaagcaaaagaattatctttggttatcaagcacccacctccttagtccttaccttaccatatgtatctttcatggccttattgttattatatgtgaatgcatgccgcagcaaatagccaaggtcctttttaaagaacatatattaacaggtactgatcaaagaagctaatattaatctcttggcagctttctgatgtatctttacacacagttactaaaattatgcttttacccactaaaactgcatgagagttaagcatttgtgtgtccttttccctttttcttttaagattaatcagaactatgcttattaactttgcaccatggatattctatt

SEQ ID NO: 87389 - DNA, 543 bp, Oryza sativa
cggcgtgagcaatttctcctccaagaagcttggcgatctgctctgcgtcgcccgcgtccctccggccgttgatcaggtcgagtgccacccgggctggcagcaggcgaagctcagagcgttctgccacaccagtggcgttcatctctctgtaagtcctgcatgtttctgagctcatcgatcacttgatatgtagtagtagcattgtgctgtggttcactgctcacatgattcttgcaggcgtatgctccattgggcaggatgaagggcatcgccgttgattcggtgttgccatcggtagccgagatgctaggaagaactccggctcaggttgctctgcgctggggtcttcagcagggtcagagtgtgcttcccaagagcgtcagtgaggcgaggttgaaggagaacatggatctgtttggttggtctattcctgagcaactgtgtgccaagctctctgaaatcgaacaggcaagtgcatccaacctttcagctgtctcaagtgcagaaaacagattcacttctgtcttcatatcttatgcaatt

SEQ ID NO: 87390 - DNA, 566 bp, Oryza sativa
ggcccctcctcttctcctcactcccgccgcacgccaagctcctcaccctcccctccccccttccaaccgccacacccctccggcgcggcctctgccacttcgtcgacctcgactccttctcgggagcgttgctcgtcgcgtcgtccccgcccttcttggcgccctccaacctgcttgctgtcctctgcaccccgtctccgccgtcctccgcaccgccctctgacctcgacggcgtcctcaccaagggcagcggctcgccgcgctatcccctcgccatgggcagaggaaatgggacccactacccgcgcccagctgctcccccactacttgtgcccgccggcccccactcacacgcagctgctcccttccctccctccccccaaccggccgtggagagaagaggagagaggaagagaggtggagaggagaggggaagaagaggctaacatgcggggcccacgctgggtgagctgccacatcggacaaaacctgagtcaaaaccacagagggatctagtttgcactgggtttcgtaagttaggggacacgttgtatctggttttacgg

SEQ ID NO: 87391 - DNA, 675 bp, Oryza sativa
cttaaggtacccatcccctgcgcgcccatacgcaggtgagtttcggatccgggtgccaaatcaaaattcttgagacgacgagagaagaaggtaaaactagatcagctcaccgatggctcgagacatggcgaggacgccgagcacccgggcgccgtcccagtaaatgacgcggccgcccgccgcctcgattcgttccagctcgtcgggccgatcgggctgaaccgttccgaggtagcaagtagcaaccatgtcaggcacacgctcatggacaagaaactaacgattttttgcagatggacgggaaaggctcagccggccctgtgatgcgagcatatacgtactttgtggtcaacggatagtgcgacggggacgccggcacgggagatgacggcgcgggagtcgccggcgttggcgacgacgacctgtgttgggctaacgacggcgacgacggcggtggaacccgcgtggtcgcgacgcgaaggcgtctgctgctcgcacgggcaggcgggctcgtcgtcgctgcgggtggacgcccggttaccgacctccccatccatccgcgcgaagctcttctccatcacatccctccaaggcgccacttcgccggaggcccccttgttgtgctcctcggcgacaatctcgtgcatcctgtcctggcacgtcgtcgcaacctaa

SEQ ID NO: 87392 - DNA, 654 bp, Oryza sativa
tggatatagattgggagacatctgcatttcatattttagcttaagggctcatatcagcactcttgcaccagttatatgttaacaacttaacactttgttttttcttccccttaatgaaatgatacgctgttcttctatgtttttgagaaaaaaaaacttaacactcattagataactgacagattttatgctcatatgtgtatttctgtagtcaattcctatgtttgtccactccactagaaatagtgatactcccactagaactgctttttcaaatgattcatgtttgatatgcagttttgcagttacattcaatgagaaagtcacaaggacagtcagacaattttcaccacatttagcagcaaagatgaggccacccttaaggtggggatcctctccccctatttcttctataacattcttctttttttaaagagtctcagaagaacgggctaacaacattgctgatatttgcagacctgtcattcgtggccgaccaagctcaaaaagatcaattcatatttgtggccggcctcgatgggtttttgttgtattattttctgtcgggtagtataaagcactgacctccatacatactattctagaccatagttttttttttataaaaaaaacaactaaataaataatgaactc

SEQ ID NO: 87393 - DNA, 634 bp, Oryza sativa
tgcaagcaccaagaagtgagccccacacttgaggactcggcctaatgtgcattccctgtatgagctcaacggcttcgtccaaatgcccggcacgaccaaggagatctaccatgcaggcatagtgctctgcacgaggggtgacattataatccaccatcgactcaaacagcctcttcccctcatccacgagtccagcatggctacaagccccaaggacactgataaatgtgatgatattgggtgaaacgcccatttgggtcatgtcttcaaacacctgaaccgcttcatggccaaatccatgcatcccatatccagatatgagtgtattccatgacacaacatccttccggtgtcctattaaatcaaagatatgccgcccagcttcaagacatccacatttcatgtacatcgccatcaatgcgttcagaactgaaacaagtgagtcaaaacccctccggaggatatacgcatgcaacaatttgccctgcccgagagcgttaactccagcaaaagcatgcaagatgcatactattgtgactgaattgggtacaaggtcttcatcagaagccaccatctcctggaatagcaaaatggcatcacctcgtctctcgttcttggcatagcacccaatcat

SEQ ID NO: 87394 - DNA, 669 bp, Oryza sativa
ttgggagcttgtgaagaaagagggatatattgctatgtggaggaaaccattaaataactcatgctacatgaaccgtgaccctggggtcaaacctgcactttgtgatcctgatgataatccagatgatgtctggtatgtttcgacctcattttgtcctgtttttattgatgaaacctcaatgtaccattctaaatctatgtctttctggctgcaatcgtattggataaaattttaacagtcacatgtgctattggaccataaaaatacatcaccattcactacagtttgtctatataatattttaatatcattgatttatgatgggctagatggcaataatgttttctttttgcatcatcattggttagatctgttaaaccattcaccattaaaacctcataaatgcaaagcatattatcaacaaaatctgtgataatggctattcatttttctggttatgtagattatactacatcattcagaggccttagctactgtttgattggactgttgtactgctgttatgttttatttggcatgaatcttttttgtgctattctttatgttctatttctctttcaggtatgtcaatctgaaagcatgtatcagccggcttcctgaaaacggtgatgggctgactccctttccatggcctgcacgtttaatgga

SEQ ID NO: 87395 - DNA, 1367 bp, Oryza sativa
ttgctagattctgtactttccatcgtcaaagtcttgctttggaaccattggcatcaatctatacaactatctctacatgctgcagaataagcctcctgacagtcgatgcacattgataaactgttacattatccagcaaaatttctgcgagcttttatggattagccctgagacatccaatcataatcatcatgtgctagactgtagtccattgcacgagaacttccttttatcattcattgggtctgtaggaagatattcctttagtcctgccacgcaaccacaataaataaattaatatagaattatgttgttcatatcagttcaccttctttccttgaattatggtggatttttttttcatcctaaggtttcttctgggatcattacatatacctatatggttaatgactttgataaccttgacaatattattcagacaaatttgcaatagtaacataatatattgaacttgaataagtcttttctccacataaatgggaggatacctatggttaacctttgacttaataggtcccttgttaaaatagtttcaccatgttgtcacactaataataaaaaattctgatcaccattacgtttatgcagattcattggccattcagagtcaagaagggctcaggcattagtaacactgaagactacataccacctgacatcccatctacctggggagcaatggagaagctatatgattctggtaaatctcgtgccattggtgtaagtaacttctcatcaaaaaaactgggtgacctgcttgctgtagcctgtgtacctccagctgttgatcaggtagaatgccatcctggttggcagcaaacgaagctacataacttctgccagtcaactggcgttcatctttctgtaagtctgtggtacttatataattactctgagtcaatgctcttgttaatgagtcccgtggtttttaattttctgaatactgctaatccttttcttcctcttctttttaggcatactcgcctctaggttcacctggttcaacatggatgaacagtaacgtccttaaggaatccgtcatcatctcaattgcagagaagctcggcaaaactcctgcacaagtggcactgcactggaacattcagatgggtcacagtgtactcccaaaaagtgtgaccgaagaaaggataaagcagaacatagatgtttatgactggtctattccagaggacttgcttgttaagttctctgagattaagcaggttagttcaacatcctttgatcacctatatttaattgtcaatgttttcaaacatctctacagactttttcttaacaaccagtgtctgcatatgatttggacaaacttacagggctgcaggaat

SEQ ID NO: 87396 - DNA, 616 bp, Oryza sativa
ttttctgtttgctaagtagaggagatgtcttctgattctgccatcagtatgaagtatgaattcaaattaactagagcatgatgaagcagcatttgaagtacagcattttatttaatgcaaaattaaatactccctccattccaaaattccaaaatataaggcataaccacccttaacccaaagaccaagaaacaattacgatcacctcctagtttggatcaccgtaacaaatgcaatgcatgcacccaatagaattagagatcttgagtgtggaggatttaaatataataattgaatagagaggaggtgctatttaattgcatgcatgcatgcacacctcatattatgaaatatctgaaaaaagtagttgtgccttatattatgaaatggagggagtataaccaactgatttggtttaatttttcaaagacctctgggttcaggtaaaggagtttctataacacactttgatgaattgcaggtatggtttagcaatgtacctcacacgcggttggttgatgacaaaggagggcagaattggattagtaaagctaaggataaatttagatttcctggaggaggaactcagtttatccatggagcacatcaatacctg

SEQ ID NO: 87397 - DNA, 535 bp, Oryza sativa
ccccaccctgcgcgctgccgccaccgcggccctctccacgcgcgccacgtgcctcgccgcgcgggagggcgcgcgcgcggtcagtcgcgcattagcattttcgtcatagggcctgtgaaaaatgtcatccgaaaaatgcctgaaacatgtactacagtctacaattgtgtgcatgagtcgatgaacattgagagtttaggtggtgtttagatccagggacttaactttagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggcctta

SEQ ID NO: 87398 - DNA, 673 bp, Oryza sativa
atgattcctaacaaattaggataataatcttcaatccgtaccgtcgtaatttacaaggcactatagtataataaactagtaatattattaaaaaaaaccaatatttttttaatgaaagatcaaagtaagagcatgatccactttattgcatcagtgcatagcgtacacaggtaagtgcatcaaagttttgaatcaaatttttagtatttccagaagaactagaacaaacaagcaatcacatcaactaacgaaaaaatgccacagggtaaacatagttttagagctaaaaccagaatgtcggtagcaaatcagaacatgccactaaggctttgtacagaaaatatgagggaagaaaacataatagtaggaccatatgttgtatgctacatatccatgcaaaacagcaatattcgtacttacctttcctttgtctgcacaagctgctcaagtgcttgaaccaggctgtgtttcaccgtgcaacaaacatatccatttgccagctctacccactcttcaacaagcgcgccaccttgccccttattgatcattgctctttcaagtccaatttcctctctgaactcattcaataccactgcaattctcttcccatgttgcgcactcagaatgtagttgactaactgaaaagtgatgcgcgggagataagctatcccat

SEQ ID NO: 87399 - DNA, 659 bp, Oryza sativa
aattgtgctcacattttgcatacatagtttgaaagatccgatgacccacttgatcggattatgacttcggaggccatcagaaggctgatcacctactacaagaactcacagtactactttgctgcgcagcagaaagtcaatgagatggcacgggttgtaagtaactagattactacagcaacttccccaaacattcaaccacagctagaccattgtaatgcaagctaagaggactcacatggtatttttgttgcagaaagggacagtgctggatgcaggagggagccaggctagcttttggatgcaggctttcacactcacgaagcgatcgttcatcaacatgtcgcgggacttcgggtactactggctgaggcttatcatctacattgttgtgacagtctgcatcgggacaatctacctcaatgttggcaccagatacagctcaattctggtaaaaatttccttcttcagttgtcacttctatttggatgcaaacttacactgaaaagtatctagctaccctgaactgaatacttgatgttaagcttggtgatctgataaaactgtgaaaacaattaggcaagaggtgcatgtgcttctttcgtcttcggctttgtcacgttcatgtcgattggaggattcccgtcttttgtggaaga

SEQ ID NO: 87400 - DNA, 656 bp, Oryza sativa
cctgcagcccgtgatacctgaagttatgtgcatatattatcttacttcgtctgatgcagtaataatctcaaggtaacaaaagaagttacctccaggctccagcttactgaaagtttcagtaaaatatgtaatttcaggcctatgtgacccaagatgacaacttgatcggcacattgacggtgagggagaccatctcatactcggcgcggcttcgccttcccgacaagatgcccatggaagagaagcgcgcccttgtcgagggcacaatcgtcgagatggggctgcaggactgcgccgacacggtggtcggcaattggcacctgaggggaatcagtggtggtgagaagaggagggtcagcattgcccttgagatactgatgaggcccaggctgctcttcctggatgaaccaaccagtggccttgacaggtaggtactgctattatatttatggcaaatcatttgttattcattaattaatggatcatgcaagcatgccgggtcggccaaaggctggccgaccaatttcattaagattgggagaaaataaagtaaacatttagttacatccaggcccagcatgatagcaatctagctatctagcaagcatgatagcaatctagctgaacttgagatgtggagatttgatttgcacagc

SEQ ID NO: 87401 - DNA, 646 bp, Oryza sativa
attcctgcagccccaaaataggaatataattcctagttccacttagactctaacctcaattaccaaatcacctaaaacctgcggccacacctgccgctatagatggccatatggcccgaggcccacggcccggcacgaagcccgcaattttggcccggcccaagcacggctcggcccgactagggtcgtgcccgtgccggcccggcccgacagccgggccgtgcctgggctgcaccctcggcacggtgggccggcccggcacggcccgatcaaataaaaaaaatatagggacaaaaaatagacttatataatcgtataaggcatggcccaagaaaataggtatacaaaatagacttattttccagccatttaaacacaacccacagagttgagggaccaaaaatagacttatttccagccatttaaacacagcccacagagttgagggatcaaaaatagacttatttccagccatttaaacacagcccacagagttgagggaccaaatataaactctttctgtgaggcagcacaatagcccatcgtgccttcgggccggcccggcacggcccgactagtattgggccgtgcctgggccgtgtatgccgcccgtgggctggcacggcacggcccggtgcatcagtcg

SEQ ID NO: 87402 - DNA, 654 bp, Oryza sativa
gccgcccgcgccgccgccgcgtacgcggtcgcggccgtctacgcgggcaagccgctcctcgccggcgcggagctctccctcctcgcgcgccgcgcgtggccgcgcctcgccgccacgtacgcgctcgcgtgcgccgccgtcatcgcctgcctctcctccttcctcgctctcctcgtcaccgcgtgttccacgctcaagttcatgctctacccgcccgacatcgtcgtctgcgccggcctcctcaccgttcttgccttctccgtggcgtacgcgcacaccatcatagtgtgcaacctcggcggtgtcatcgccgttcttgaggacatcgccggagtcagcgcgctgcgccggtcagtgcagctgatgcgcgggcagacgcatgtcggcttgctcatctttcttggatccaccattggcctcgccttcgtggaggggctgtttgagcacagggtgaagacactgagctatggtgatggctcatcaaggctctgggaggggccattgcttgtcctcatgtactccttcgtgatgctcatcgactcgatgatagtgtcgtgttctacttcacttgccgatcatcgagcatggagatcttggatgatgagggcggctcgattgaggagcttgagatgatggtgggtagcaattcagggg

SEQ ID NO: 87403 - DNA, 641 bp, Oryza sativa
ccttatcaccgagttgacgtacgagctcaacgggtaaggcctgaagccggccatggtcagcctcgacttccacttgccagcagctcatgcctctccaccctgtccttcccctcgcaggcgatgatgttgacgatgtccttggcgaggcagtgctgctccacgctgatcctctccttgttgtcccgcggcaggttggcgtcgatcgactcgaacatggcggagtagtactccatggtctccccaaacctcatcaagaaaggcgttgtgttggtgtgtgactcctgctctaccaaagtagtcaccttcggggacagccctttcaccatccggagcagaccatcgcgtgggttgttgacatccacgctctcgtccggggtgtggtgtagctggagtgtgaagtttacagacagtgcttcacctggcctgatctcaagcatctctttcgtgacttgtgtggcatagacagacagaggcgtaaactccagaggtattttgaattcttcagacatgcttttcaacattttccccacaatgtcaagaccttcaccacgagcatactctgacactgggtcatctatcccggtgatccgcacacgaggaggaccaccaggccttgcagctaatgcttgtatcagtgtgat

SEQ ID NO: 87404 - DNA, 6310 bp, Oryza sativa
ggccttctaggagtctccgggttgtcctccactcgccatacttttccggaagatcccaatatcgactcggaacctcctagttgagaaataaagccctataaaaaggtcataactacatcgactcgggtaacaatgatatgaataagcattaatccgaaggttcaaacatagatcggctggagatccgatgtcataaaatataaacgcttagataaacaatgaaacctttgttgcgatcggctaaaaccaacttgtatgtaatccttataagccaatgtaacatccagataactcatcggctgaaacctcgatgaaacccttattggcaatcaaaaagcaggctagatgttatggttctaagcatgaccaaggctgatgcagcgcaaagtatgaaaaaaaacataatatctagacaatcaagcccttgactgattttcagggtggtggataccttagctaatctaatctggtaaagcaatttagccgatactagcataaaccctaaaatgaatcttagctgatacaagtaaattgaattaccaaacaagattaactaagatataagatagataggtgcttacattgacaagatcagagtatcgaagccctagccccgccgatgcaaacatccttgacaagtataaaatcgtcaaaaaattataaaggtaaaatagggtggtaatgtgccgaatttgtattgattgtggagataaattacaatacccccaggtgtacatatttatacccatgggtagatacgagtccttattggacaagaaagaaactttactaaagataaaaggaaaacataaagtccttatcggacactaaacactctttcctaaagataaagaaaactaacaaactctttttaattaatagataaactgtcatgtcgcatcctccttgaactcggtctcttgtgtataaacttcctttaattgattaatttccttaaccgaatatagcaaaaatccgactattggcgacttgataattcccatcggccgattcgagtactctaaaaccgatattaactctaagccgatgatgacttcggggcttaccaaatttcactgttaacaaaaggttccagcggctactcaaaccccctctcctctcctagatccgacagtcgatggatctggggctaggcagtggatccaagggctcggggtggtagggttgccacatgcgatggaggcgggaaacttggtcacgggaggcgggcggtggatcggggcgatggctcggggggcacgggcggtggagctcagccatgggcggcggatttggagatttcttttgctcaaaaatcatttttttatggtggtcaacttaacctagccacttgtgaaaatgaaaatcatttttcacaagcggtgtagttccgcttgtgaagatggctgattttcacaggcctttagttgctgatggtagtgccaaccgttgtagaaaacgtaaactggccgccaggaaaaatctattttgtagtagtggaaaaatggtgcgaagatggtgtgaactttactaggaaagaggttaaaattgttagatattatgtttatgtactcaatacaacatcaagtcataatataactagcaaacaatagaacatatggtttgagaacctgatttccactctcggatataggaatgagtcaacggaccgtcataataactatgtgcttaaatgcgtaacaatatgaatacacgatttccataacataataacttagcaagacttaaaagtgcaacatgacattaacaagtccaaaacaagcatccaatcagcataagataacatacatcacatgatacttatcatgtccaaatatgatttccataaagtattgttgttaataagttacaaatgtaaaataacaacacataggaaatgttattggtctgtggcgacgactaccacactggtatgagttgagatgatgacagtcttagatcaaagagtctagattaaatgatgaattgagttgttcgatgtgccgactcatgttgcatagaacaaatagagtggttacatgagctgataactttggataattcaacgtttaatctatcggttaatccacgtctgcaaaattttatggataccacatccttatttgtatttgtagggtactaaatgataaggtgaagatagagaaattaccacctctcatacaagtggcaacccccataggcggatcttggggtggtcccgatagttctggaacaaaaaaaaaatcctagtccaatgcatatatatacacatatgtgaaaaaaataacttttgaaaaagaaaaaaaacttgtttttaatatattatgatgcaaatttgatccttcatatttagggtatttaaaacaaatatatatgttacctatataaaaaattagatacaccactggtaacccctacataaactccaataaaaatgtgatttgagagtgttagagttgttgggaattatgtgttagaggtaatctataatataatacatgtatactcagatcaaattagagatagtatccacctttactattggaattgctattatgcatgtatactcagatcagagtagcgactgtttgccagagtgtcactgaagaaaaagaaagaacacccacactaaagacaatgatataattcatcctccccaaagacaaaccgacggcttttttgcacgacgcatcaaactgtgtcgaccggaagcgatccatcatcctgaatgagaaaggtgaacaatcttaccgctcacattattgccttttgattttgtcgacgcaaacctttaagtaaccctgatagtactgaaaccaacctctgcatttcctacaagattttccttccactgcaagcacactgacgctagcttaccagtacattacatgcacattgatataattttacatgctctaatcactaataattagcatctaatcgttcccatcacctcacgcacatcaagcaaaaatcacaccacctacattcgtcttcatcccatttctgcaggagaaatggatgagaagcaacgaatcgatcaagggtggcggccgccctcctcccgcttggcggcgttggcggaggcgtagtagacgaggcagaagaggccgtggacgaagcagaggatgccgccgatggagaggaagtggtggcgcgggaggctgcacttggccgccttcctctcggcgttcggcagcgcccccaggatcagcagcgccaaccccaccaccagcacgatcctgatcgaattcgaatcaaacacacacacaaaaaccactcaaatctcacctcaaaatccgtaaacaatttgctcctgcacgagcatgcgagaatcttgtactaggtgcatgcaggagaaagaagaagaagaagagaaagaaggtggtgtactgtaccacgagatgacgagggcgaaggacgccatctgccggttgggcgtggcgcggcggtcgcgggagcacgcgcaggagcacccgccgacgacgttggcgatggcgtgcgacgccgccagaacggcggccgccgcgacgccgagctcgtaggcgcgccggaccggctgcctgcactcgatgaacagtatcctcagccgcctcccctgcaaatttaaacctctcgatgtgccataaaccctagtactttggatcctgcttcttgatgtgatgatgcacgaactgaagaacatcttgacgtacgtacctggtgctgggctttctccgcgtggatgccgaggacgccggcgacgacgtccatggcaatgatcaggaggcagaccaccacggcctccactctcgccatggccgttgattcgtcgagcaacttcgcttgcttcgatctcttgggacttggggaggaggtggcctgtcacggaggtgcaaagatgggcgatgtcggcacagttcactgcttttcaccttcatttattcggctattttgcttttgggggtgttatcccaccccaaaattttacactatgtctaatcgaacgtttgaatactagtatattgtatgaagtattaaatatatattaaaaataactaattacatactccctccgtcccaaaaaaaggcaaaccgcaggtttgcgtgccaacgtttgactgtccgtcttatatgaaatttttttataattagtattttcattgttgttagatgataaaacatgataaatactttatgtgtgacttatttttttaattttttataattttttcaaataagacggacggtcaaacattggacacggaaaccagggtttgtcttttttttgggacggaaggagtagatcgctattaatttgtgagacggatcttttaagcctaattgcttcatgatttaataatgtggtgctgtaataaatatttactaataatgaattaattagatttaataaattcatatcgcgttttactgacagagtttgtatttaatttttttattagtatcaaacgtctcatacaacaccctatatcaaaactctacgatcctgatttaaacaccctctgtacgtccttgttttttcttctttttctttactgcacacctcacgaggacgacaggaaaagctaccgatgcaggcaggcctgtggctctgtgcttgattgagcttatcaaggagaaaaaaaatggtttgtttaagtggcaagcgacagatgccatggcttggcaacatccagcgctttggcaagcttgcaaatctttttatcttccttttttcgctttggaaggcttgagctttacatgatttacgcgctaattgcattgagggtaacattgccgatataaagtcgcgaaatctaatttgggttaggcccctttgatacctaggataacctttctctttttttttccgcgggtgcttaggaaagaaaatgtagaaaaggaatcacatgacgacgcgaaattaagaagaaatttagagaaagttggtagtttaaaaaaaacttaagaatttatgtgagtaggaaagttttagtgtgatgtgatggaaagttgggagtctgagggaagtttggtgtgagagaacatagtaagttgacgtgtatgattacattaacccatttcacttccctctcttactacaccgggtcacaaataaataatattttggataccaatagagtcatcaagttagtactatcagaaccaaaatatagcaactcgtaaatttaaactgtataaaaaaatagcaatatagtattacttttaaatgtgacatttttttaccactaaatcaaccatactaccactttgctttattataggcgcaactagtttaggcctaaaccttacaaataggttgaatgttgtttggaaagtttttggattccgaatctatttttaaggcataaagcgctgatcattttttttgaaacttttataaaaataacgaatttatttttttcaaagaaacgaaaatgaatacggagataaaataggcaaaatagacttattccttacagtagggcctaaccatcaccaaaaggcctgaagcccgacggccaggcccacgacatagagatttggcccgtaccgaccattgggccgtgcctgggcctttttctcggcataatgtgctggcccagcacagcctaacccaacgatcacgatcagcgggccgtagactgtaagcggccggcccaaatagacgagagaggcataatatacttatggaaaaagtccacattaactcccttaattgtacgccgattctaattcgtacccctcaaccagaaaaccggatagaacgactcctcgaactattgaaaccggtgcaatttgactccctcagcggtattggagggcgtttttgctgacgtggcgctgttgacccggtcttcgtcccacgtggcgcttaagtggcattagaattaaaaatttttgtgggacccatctgtcattcacaaaaaaaatatatattgtggggcccacatgtcatcctctctctccaacctttcttcctcttcccttcctctctctctcccctttctctcccccttccccatctgcggccgaggaggccggagacgagagcggtggcggcgggcgggcgagggcgtagacaatgaggaaggcagataggaggttggcggcgacgcccgcggagacgacgaggaggcgatcggggacggggtggttgcgaaggaggtccaggttgtcgggcgcgaagccggagttcgggtcgtcatcggggaggtggcggcaaggaaatggcccgactcgtgacgaggacaatggtggcgaggacggaggcggtggaggcgacaaactcgacgctagcgaggaggtcggacggggcggcggagatgga

SEQ ID NO: 87405 - DNA, 821 bp, Oryza sativa
gccgccgactggtgtctccgcctgcacggctggcatattatgccacgcgttgttgggcgtctacgtcttcactgaccggccgcctcgtccgccgccgactggtgtttccgcctgcacggctggcctattatgccgccgttgttgggcgtctacgtcttcaccgaccggccgcctcgtcagccgccgactggtgtttccgcctgcacggctggcctattatgccaccgttgttgggcgtctacatcttcactgaccggccgcctcgtccgccgccgactggtgtctccgcctgcacggctggcctattatgccaccgttgttgggcgtctacgtcttcactgaccggccgcctcgtccgccgccgactggtgtttccgcctgcacggctggcctattatgccgccgttgttgggcgtctacgtcttcaccgaccggccgcctcgtcagccgccgactggtgtttccgcctgcacggctggcctattatgccaccgttgttgggcgtctacgtcttcactgaccggccgcctcgtccgccgccgactggtgtttccgcctgcacggctggcctattatgccgccgttgttgggcgtctatgtcttcaccgaccggccgcctcgtcagccgccgactggtgtttccgcctgcacggctggcctgttatgacgccgactgatgctatcttcttcacggttggctacgtcgccgtcaccgctaatatgcgtcatcatcttcaccgaccggccgcctcgtccaccgccgactggtgtttccgcctgcatagctggcctgttatgacgccgactgatgctatcttctt

SEQ ID NO: 87406 - DNA, 694 bp, Oryza sativa
cctgcagcccttggttggtcagtataactcttcaagttaatatgatcggaattgtagcatatttgcattcgtacagacaaagattcgttacaaagttacacacagcaagctcaacaagcttgtctatgtaaatataaccttcgcagtcgaaatcaacaaacaaatgccaagttaggaaggacgatgatgatccctttcaaagtccagcggacctatcattctacgacactaacaattaaattagagaccgaatggacaatgtttggtccaattcttgccctgaactagatgaagactcaactgagagtgaatcccccatacctagtccacctgtagccaacctagtggacttgactgaccttcgcaagaccacaagggcgtctattattgctgagtaggctgatatgaatatgtgacagtcatattggaaaaagaaagactcaatagcggccaaaaccacctcatctaaaaaagtgaaggccaaaggttcatcaacacggccgaggagcattgatagcaacgaagagactcaagggagcccagactaccaatagtccaatgatagtagcttaagaattgatacaaatgacggagacaatggtggtcaaggaggccaaggcgccactgatgcgccttctagtggtcacacaacaatgtcaggtgaccacaccctgatttaattctttacttatta

SEQ ID NO: 87407 - DNA, 531 bp, Oryza sativa
atctccccctctcccccagccctctccccccggcgcgctccttctctctctctccctcctctccctccgccccgctccgcccgcgcgctgcacgcgcgagtgcgtgagccgcgccgagccgagccctcctccctcgctctgcccgcgcgtgcgcgagagccgcgtggtcgccgcccgtgccgcgcctgcgccgtctgcgccgcctggccccgctgccctgccgcgcagccgctcgaccccgcgagccagcgcgcgtgccgcgcctacgccgtccgcgccgcccgttgtttcccgcgcgcgcgtgccgtggtggccgaccgcctggtcgccgccgccgtcagcctctgccgcgcctgtcgctcgtgtccccgctccgctccacaccgccccgccgtcatcgccgtcgtcatcgcccggcccccgccactccgcgcgcaagctgccaagggacggaggcagagctcctcctccctctgccgcgtcgcccccgctccctcctccttttcccgaagaggcaaggggacaagcccc

SEQ ID NO: 87408 - DNA, 590 bp, Oryza sativa
tgacctcatgagtttctgttaacggtgaaatttggcaacagtttcttgatttacctcattggtgtcaccttgtttataactaatcatgactataaattaacagcaaaatcatgacatccgccattgtaggtcgatctactgggttctgctggacacacaggaggccgatgttgacacatttcagcacctcggcttcagggtagtttctgtccaaggaatagtctaccatctctacaatatttccctctgtccagtgcctccatacctagcattagttatatatagatctccagttatcagtaatatagatggtacatatgagtggttttctggaaacataagcaatattagtgtattgatttgtaggaattagaagggatactcactaggcttactaaatcttcgttttgctctgcaaaatagggcccactgtttctttgccctgtcacaatctctaagatgagaatgccaaaactaaacacgtctgatttcgtagagtattgcccgcgaatcacatactcaggagccatgtatccactgcatgcagtaagaatgaaattgcatgttagtacgtagtttttaagtgaaat

SEQ ID NO: 87409 - DNA, 607 bp, Oryza sativa
ctaatctccaaaccaggagacctaaaagccgtcttgtacatatcctcctacgccataaagatttgattgtagccggcattaccatccaaaaagctaatcacctgatgacccgaggtatcattaatcattatgtcagctataggcataggatattcatcttttggagtagctttatttaaatctctaaagtctatgcaaactctaatcttaccactccctttcttctccaccgggactatactagatacccactccgcataacgacatggcctaataaaccccgctttcaataaccgataaatctcctccttgacccggtcatataacaaaggattgaaacgataaggtgcttgtttataaggcctaaaacccggtttaattggaagctgatgttcgacaagaccacggctaagacctggcatctcatgatactctcattcgaagcaatcaacatactccttaagtagctcgattattttaaccttataatcggctgtcatgtttttgtttacaaaagtcggccttggcttagttccatcacctatgtctatttcctccaatggatcggccgatgtaaacccatgaccaaccttttctacttcgtcaa

SEQ ID NO: 87410 - DNA, 587 bp, Oryza sativa
tcgtgcatgtcgaaagtcatctaaaggtgacttctcaaaatttgccttgggctcctgggtctcagacttgatcttaagttcttgttctcagtcaataagatctgaaatatgcactctcataagcttgttatgcccatcaaactcatccagacagtttcaactattgaacttgcttatgtcgttactccctagaacactgtcagctggtgaaagtgccgcagagtactttgagttacttgggacaatgattgatacagaagcttcacgtcttttcttaactgttcgtggttgtttgaccacattatgttctttgataacaaaagaagtgtccaatgttgaatcacaggagagaagccttagcattgacatttcacaaggattcattcttcacaagcttgttgagcttctcaacaaatttcttgaaattcccaatattagagcaaggtaactcttaatataccctgcatgtccaaccctaatttcttggtttgtggaacatccgctcccatgcagttctttctcattgtatctttaatttcccatatgtcgcagatttatgagtgataatttattatctgatgtgctgg

SEQ ID NO: 87411 - DNA, 535 bp, Oryza sativa
ctgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttaggtgacgggtggtgacaatgagtccgtgtcgagcgctgattttttcggcctttagagcgagatttatacaatag

SEQ ID NO: 87412 - DNA, 518 bp, Oryza sativa
tgttgtctttactgtcagagggtaccaaagagttggtgaaaatattaccaagggtaaacctgacatgcatgaagcaattgatgtaagtttaattttctctttattatttttttatcatccattaatttgttcctgagttaatccctggaagaaaaaacatcacagtgctacacgcctattgaacctggtaaatatggagaccttgctaaaccaatggtaggatctaatttgtggtatgtatccaactctacatctctgtttttttcctacagcactgtattatttgacatatgcgagacagatattatgtacttgactttgatataaaacaataccccagttttgatctattgcatattttaataatactcacaatataaataatttagcttatagcacacctctatttggaagaatgtgagggaataaaatttatatttacacatatttatctagtaccaacatgtattattgtacaatactggtagaattatgaattttagtaagaaaatagaagt

SEQ ID NO: 87413 - DNA, 583 bp, Oryza sativa
ctgctaagtccccgtcgcccgcggccgccccgccgctgcgtgccctcgcatccagctcccttgcccgcgcctcgagctcagcggtccgctgatccagtgcggccctctcggcgcgggcaccttccagattgcggcgcgcttgttcctcccgcgccgcctcgcggagggacaggctgtccgccagcctttgcgccgcggcctcggcctcctcgagagctctctcccgctcggtgagcgcatcctcgcggaggcggagtgtggactcctcttcggcacagccggcctcgtgcgccgccagtgttgtctcccggatggcgacggcggcctcgcggtccgccaggtccctctccttcgcgcgggcgcgctcttccagcaccatggcgcgggcctcaagggcttcttcgcgccgccgggacgccgcctcggtcttcgccgcccgccgttcccgggcagcggcggcgtcaaggaccccccgggcggcgtcgagcttctttcctagctccgccgcctaactcccgtattggaggcggagatcgtcccgcgccttcgtcagcacggcggtggcaattgagggcagcctctc

SEQ ID NO: 87414 - DNA, 1085 bp, Oryza sativa
accgtgacaatttggtatcagagcaatttcgatcctggagaagccacgatatacttcccgtttgcaacttcaagtcgaagcgatggagaagcagaacattgatttcggcaaggtgttgatggagatctaggagtccttggtgaggctgaatcgtgctcaaggcgaaactcaagcagcggtcgtcaagctagatcgcgaagtgagcagttggagacctcaagtagaagcagcagttcaggagttgcgtgaggaagtcggcgaccttcgtcagcaactggatctcgtcggcaaaatgaagcaggcttctccggcgacgtcttcccctccagcaccatggcgcgggcctcaagggcttcttcgcgccgccgggacgccgcctcggtcttcgccgcccgccgttcccgggcagcggcggcgtcaaggaccccccgggcggcgtcgagcttctttcctagctccgccgcctagctcccgtattggaggcggagatcgtcccgcgcctcgttcagcacggcggtggcaatgagggcagcctctcgcttctcctccacctccctggcaatctccgccagctccttccgacgggcctcgagctctcaggtgtgccggcggtgtgccttgcggcccgcctccaccatggcctccaccgagcattgcccctcttcgacacgcgctcacgccgcgtcgagctccgcccgctctgcctgcaggacctccatctgggcatttaacccatccaacaccgtggtgttcgcagtggccaaggcttgcagaaggggctccgcgctcagtggggcagcggaaggcatgggagagagccgcctcggtgagaatgccgcacggctcggcccgccgatcgacgtgccggactcggggacgtcccccgaacctggctcgtcctgagcgtcgcccgaggagtcgggcccgagcggtgcgcctgcggcctagtcgtgggtggcctcggaagtcatcgtcgcctcgggcggagtcgggtcgggggcttggcaggccgcctggcgtgcgcgtgccacctccgcctcccgggcggacttctcggcccggcggagcctggcctcctcccgagc

SEQ ID NO: 87415 - DNA, 1022 bp, Oryza sativa
tagaaaactaaccgttacagggcaatcattgagcccactcaacctggctggtctgaccgcagtgaagtggccggtcagaccgtccacggctcggtcagaccgccatcggctcggtctgaccggttgcggctctggcagctctgtatcgccaccaaaaaccagaccagtgcaacagaccagtagggccggtcagaccggccttaccacgctggtcagaccggctaacagccccggtcagaccgacctaaggcccacggtcagaccgcaggtcacttttcagcacaaccaaccgttagtaaaacggcgatatctcttgactcgggtctcggaatttggcgttcttggactctatggaaagcttattcaaagggctatccaacccatgaacaatccatccaagaaacacaacttttctcagggagaaagggctcacactccaaagaatactccaccggacataaccacatgaggctaaccaaacctataggatgtgcccacttctctctttgtttgggacttgataaaactcaccacacttggctagacaagcccacaaaatgcacctatatgcatatgaactaatatggcacaaaatcatccacatgctcgcttcatatacccctcttgatagtacggcacatatctagtaaatccggtctacaccaaacaccaagaccgggaaaaagactaagaaaacattcttagctccattatacctttgccttgcgccatccaacttggggtcaatgcttgagccaacatcaacacttgtgaccattcggttgaaccatgtttatgccgagatctttgccatcctttgtcaagactttattctcatcacaagcttgacttcattcttgccaacatgacgatgtccttggcttggtgaccattaacccatggtgtcattcattagcctcatcgcaattagatctattcctttgcacgactcaaaggaaaacattagtcccaacaaatcggttggcaccctccacttggtgaccaaccggttgcttataaag

SEQ ID NO: 87416 - DNA, 646 bp, Oryza sativa
tctttggcttttatctactttgaaatattatggtcttacttttgagaaagtacctctctttttttataacacaagtgctactaacattgctaagaatcctgttcaacactcacgcacaaagcacattgatattcgctttcactttttgagagatcatgttgagaagggatatgttgaattgcagtttttggacacaaagttgcaacttgctgatattttcactaagcctttggattctaatcgctttgcttttcttcgtggtgaattgggcatagttcatccttttggcatggtttgagggggagtttgtacctcatggttttatcaagcgataatatgacaatgagaaaaattgagaaaatagagctttggttatgcaaatggtattttcttgtgcatgctagcaatactttgaaggtttatttgtctctagcatagcttgtatgtattctagtcttttcatgagatttagattttgcttttagggagatgatgcatgacacttaaatctatacttgaataagaaaatatgcaatgttgatgctagcatatggtttgattaataaatgctttatatatatatgctttggtggattggtattcctcaaatagccttaattgctaatgtgaaaagagaataaaaaat

SEQ ID NO: 87417 - DNA, 736 bp, Oryza sativa
  unsure (1)..(736): unsure at all n locations
atgataanctangaacacatctcggtacccctaatttttccactgtaacatgttccacaagcatggttaaaatcttgagtacttgcctacataagacttatatagttaacttatatatgttgtcatcttttgggggaaattatcaagttggacagccaatgattaatagtagctttagctgctgatggagaaagggatttcaaagattcaggcactttttgctaatttcaaatacttcagcatttcacatgtatgcccatagatttattaattagcttccttttgggagatattaattagcttcctcagctcggtagcctttcaaatctcaaacaccttgacctcggtttcatatcgaatatgtgcacaacagatatctcatggttaacccgtctgcataagctggagtacattgacatgagctttataaatctcagcacaataactgattggcctcttgtggtaaacatgattccatcccttaaggttctcagcctgtacaattgctcacacacacacacataaacctcacaaaacttgagcaccttggtctatcaaggaactactttggccatccaattgcttcaagttggttttggaaagtaagaaccataaaggaacttggtcttagtgaaacctatcttcatggtccatttcctgatgcactagggggaatcacatccctccaacagctagattttaccaataatggtaatgcagccacaatgactatata

SEQ ID NO: 87418 - DNA, 2065 bp, Oryza sativa
tgaagtagtgatcttttctcaagaaatagtatgtaccactgcttcttgtgttaattacgcccttgcagaaaagaagttattatcatcactgctagttgtggtgtcgaccaccctgacctttgaagcataccgctgccagcaccagcagcctagctttcgcggcgttgcccggctgcccagacaagtgcggcaatgtcagcatgccgtatccttttggcaccatagatggctgcttccggggaccacccttccgcgtctactgcgaagacgaccatgcggtttatctccaggagcacaagaagttgaaggtcttgcgattcgagctggcccagggcgaggttctcatccagaagcgcatagcaacaagctgcggcgtcaacctcaccggtaaagccgtcggcattccatgggtagtgcacgatggtggcttagcagatgactatccctatctgacaatctctaccaagaaccagtttgcagtagtcgggtgtggtatcacagcgatcatcgttggtcagggagagaaccagcctgattacacggtcggatgccgatcattctgtgatgatgtcgatagcaatattgtcgaagataatagcacgcaatgcaatggcaacacgggctgctgccaggcttccatcccaggtaatctcaaggctttccagccctcattcttaaaaataagcggtgtgaactactccggcgtcccgtgtgtctacgctttcgtcgtggagcagaactggttcaaattcaagacctcatatgccaaatcgatggaactttattcaaagtatcgaaataagggcaccggggttcctctagtgctcgacttggttgttggtaacgaaacgtgtgacgaagccaaaaggaacgcattatcctatgcgtgcaaggctacgaacagctcttgcatcgacagacctagccgctcagggtacctttgcaactgctctcaaggttatgaaggaaatccctacctacatggaggctgccaaggtgagaatgctctccaaaaatttccatgcccccttttcttgcaactagaaacatacaaattgacaccacttctttttaattccctggcccaacatcgtttgatggacagacatcaatgagtgcgattatccatggttgtatccttgcaaaggtaactgtcgtaacaagattggaaactatgcgtgttcgtgcccatctggaactcagagcaaagatcccaagatcataccctgcactccaaccataggtatatatataatattcactagcttttttgaaaaatatttttgcacaagtcatgtttggggaagtaacaaactattttcatgggaaacttttttttattaaaagtggtaaacaaatatctatatatatatatactttcaggtttaagcattggtataggagttggtagcgcaacaggctttatttgcattgttctcattgcaatgttccttaccagacggataaagcacaggaggaaaataaagctaagacaaaagttcttcattctgaatcgtggacaactgcttaaacaattggtatcccaaagggcagatattgctgaaagaatgatcatcacattagatgagcttgaaaaggcaactaacaactttgacaaagctcgtgagcttggaggtggagggcatggcactgtttataaagggattctatcagacctacatgtggtagccatcaagatatcaaatatagtggtcccgaaagaaatagatgatttcataaatgaggttgccatcctctcacaaatcaaccataaaaatgtagtaaaactaattggctgttgtctagagactgaagttccattgttagtttatgaatttatttccaatggaaccctgtatcaccatcttcatggtgagggtccaaggtcgctatcatggagcaataggttgaggatcgcagccgaaattgcaaatgctctttcctatcttcactcatcagttacaatcccaataatccatagagatataaagtccagtaacatacttcccgatgataatctgacatcaaaggtatcggactttggaagctcaaagtatatcccaat

SEQ ID NO: 87419 - DNA, 1077 bp, Oryza sativa
ctattctcgggttttccctaatagcacgctggatcataaggagtagaagttggcttgcagccactatatccaaagtgactcaaaatcttgtccacatagtgggattgcacaagtgtaatctcaccctcatctcctctttgtagtttaatgttaagaataacatcagcctctcccaaatccttcatttcaaaactcttggacagatagtccttgaccccctcaatcacattgaggttggtcccaaagatcaatatgtcatcgacatataagcacaagatcactccttctcccccaccatagcgatagtacacacatttgtcagctccgttcacaacaaagcctgcagatgtaagcgtggtgtcaaacttctcatgtcattgcttaggtgcttgcttaaggccatacaaggatttcaacagtttacacactattccctcctgaccttctagtacatacccgtctggttgatccatatagatctcctcctccagctctccgtttaggaaagctgtcttaacgttcatctgatggacgagaacaccatgagaggctgccagagcaagtagtactcgaatcattgtcaagtgagcaactggtgagtatgtgtcgaaaaaatccttgccttccttttgggtataacccttggccacaagtcttgccttgtacttttcgattgtaccatcagggctaagctttttcttgaaaacccatttgcatcctataggcttgcacccatatggacgctcaacgacttcccaagtatcattagacataatcgagtccatctcactgcgtactgcttccttccagtagtcagcgtcaggagatgaatatgcctcttctatggttcttggggtgtcatccactgaggtatacaatgtagtcatctccaaaggattttgcaaccctttgtctcttactcttacgagtatctacaatgttgtcctcctcaggattttcctcaggcgtttgatcattgtgttctatcggtgcaaagtgcttatggggcatgacagtttcttgactagaaaagcttagtggttgtttaataggaaaattattcttaaagaatggtgt

SEQ ID NO: 87420 - DNA, 1295 bp, Oryza sativa
  unsure (1)..(1295): unsure at all n locations
tggttgaacgtcaactttgctagggcaccttaacttgggggaaatcgatctcagtacagtggtcaattggccccaagtggtgaacatgattcctttttagggtccttggtctaggtggttgctcactcactagtgccaaccaatccttcccacaccttaaccttacgaatcttgaggaggcttgacctctcctacaactacttgaactcaatcgagtcttgttgattttggaacctagcgagcctcaagaaactcaaccttgatgctattggcttgcatggcatatttccaaatgtgctcggagacatggtttcactccaggttctagtattatcatcaaatgaaatgaccatgaaaacaacaaatctgaccaccctgtgcaacttgagggtcctacaactcaaagagtcatattcatacggtaacatatctgagctaattgaaagtttgccgctgtgcgcgtttggcaaattgcaggaactgtatttgcaagggaatcatttcacaggaaccctaccaaattggttggggcagttgactagtttggtcatccttgacttgtccatgaacaacattactggacctctgccaggtatttttgggaaatttactgatttaagggaccttaatcttgctggcaatcaactgacagggcatctgccatcccagatcagtatgctcagtaacttgaccaggttggatctaagcaacaatatcttggatggcctcatcacagatgaacactttgttggtctaaagggcttagagtatatagacttgtctcacaatagattgaagattgtgctgggctcacctccctttaggttgaagaagcacattttacaaactgccagatgggtcctatgtttcctgcatggcttcagtggcaggtggatctttcttaccttgatattacaagcacaggtatagttgacaagcttccagattggttctccaactccctttcaaaggtcatatatttggacatttccaacaatcagatcagtgggggattgccaacaaactgggagatcatgtcagtggaacagctctatctgagttcaaaccaatttaccggcgaaataccctcattgccaagaaacattatcaccttggacatctcaagcaactctttaacaggtaatctgccatcaaatttgtctgaaactccaatgctagatacgttgatgggtaccgagcagatgtcaaacaaannncaccatggggggggggnnggtgttatgacgcccggatttaatctgcacattgtantataccaaaaccagtttatttat

SEQ ID NO: 87421 - DNA, 1066 bp, Oryza sativa
tactagaagggtatagggactcaaactggatatctgatgctgataagataaaagccacaagtggatatgtgttcgcacttggaggtggcactggttcctggaagccttgcaagcagaccatcttaacgagggcaacaatggaaggagaacttacagcactagatactgcgacagttgaagccgagtggcttcgtgaactcctgatggatttgccggtggttggaaaaccaatgccagctatcctaatgaactgtgacaatcaaacaatgattattaaagtgaacagttcaaaagacaacatgaagtcatctatgcatatcaagagaagactgaaatctgtcagaaagcagaaaaactccggagtgatagcattggactatgtccaaacggctagaaatctggcagatcagtttaccaaggggctaccacgtaatgtgatagacagtgcatcgatggaaaagggcttgatacccacctaaggctgcacaataggggaaacctgtccattgagatcggagagcccgtgaatttggacggcgaaacaaactattgggtgcctgagagaagagacccttgaaaaaggctcattttcatgatgaacttggattccttcgtgaaaggtgggatggctcaaaaccattaacgtgaaccgggcggcttctccaaagcacagatgtagaggtgtagaaacatctaagaaggaaacatacctatatgaacggacctgctaatgacaatctatgaggttagggccatctctaaatacttatgaaaggcctggggtttgacctatatgcctcaaacagagggagtagcaaacggcagttccacaaccacttaagggtttgagggaacactgagcacacaacacttgaaatgtaatgcataacaccatcgttcactaggagtccggatgagcttcactccaaagggcgaagttaaaagttaacaggcattgactcaaaacacctggtttataaaaacaggcacaaagctttgagaaccatttattactgaagccccacaaatctcgcggcggaattgctaacaaaaagacggaccctgc

SEQ ID NO: 87422 - DNA, 765 bp, Oryza sativa
  unsure (1)..(765): unsure at all n locations
acgtcaccgatccgagnctcgcatngnanaanncnagctnggnacccgacaaagatactaacagatattcaacttacgactgagaaaatggtagctgtctcctgcaaaaacagactacagaaaatagtggtcgaccggttctgtttccttatcgaatttcttcagctccagcagagcgctccaggtggggattcagaattatgcaaccgcgggcatgtctttgagccatgcatcaagcggcttgccgatagagtagacaatgaagccaatctccctgagcttctcaggatcgaccacattgcgcccatcgaagacaaatgcaggtttctgcatgttgtcaaagatcctctggtagtccaaggtcttgaactcgtcccactcagtgaggatgcacagtccatgggctcccttggtggcctcatacgcatcccagaccacactcacctgcttaaaagccgtggggctagttggctgcaggtgccttgggtggtcccaatcaaacttggccatggaaaggtcccgctggatctgatcttcagttacctgtgggtcgtagatgctgatttgagccttgtcacccaacaggccatggcacacatcaatggcaggtgtctccctggtgtcaccggtgtccttcttgaacgcaaagccaaggacggcaatcttcttgccagagacagtggtgaacatggaggccacaacacggttgacaaaccggctcttctggtagtcaataaatcttgatgacctggtctcagtaggcga

SEQ ID NO: 87423 - DNA, 764 bp, Oryza sativa
  unsure (1)..(764): unsure at all n locations
gatgtcaaacagactttcnnatngnacnnngncnaantnnagctcggnaccctagtgtagcacagctaagccatataaatttgtataatgagtaaaggggctaatttagagtggttacaaaagagggtgcaagaatatcggtctacaaagaatgatattggtgagactattgaagatttcgatgaagtggagaaacttggacaagggtttacatcggccgatccattggaggaagtagacataggtgatggaactaaaccaaggccaacttttgtaaacaaaaatatgagagccgattaaaaggttaagataatcgagctacttaaagagtatgttgattgctttgcgtgggagtaccatgagatgccgggtcttagccgtgagcttgttgagcatcggcttccaattaaaccgggttttagcccttacaagcaaccacctcgtcgttttaatcctttgctatatgaccgagtcaaagaggagattgatcagttgttgaaggcggggtttactaggcgatgtcattatgcggagtgggtttctagcatagtcccggtggagaagaagggaagtggtaagattagagtttgcatggactttagagatttgaataaagctactcccaaagatgaatatcctatgcctatagccgacatgatgatcaatgatgcttcgggtcataaagtgattagttttttagatggtaatgccgggcacaatcaaatctttatgacggaacaggatatatataaaacgacttttag

SEQ ID NO: 87424 - DNA, 1557 bp, Oryza sativa
agcgcatttgaatcactactgataaccgactcacaagggcgaattcgagctcggtaccctcccttctctcttatagagggggtaaagcaatggtacacccataccggaagaaaactgcatggtgaatgggaggaatcaaaaggtaggttctaccttgatttcttcctgttaacccgtgtagtctctatacataaggaggttctcaacttttgacagaatgagaaaaaaatccaatggtgcagtatgggctcttttgttcttgttaactcaagacagcctagatttgtctgcacccgatcatgcgttgttataacactttcactcgggtttagataaggagtctgccatgtatctcaatacttccaccggaggttcgttcgcacacaaaacgacgttagaaagtagggagctcttggattgtatcctagagaacacctccttcgttcgttgtgaaaccgtcttgaaaataaagaatacacgtgaggaaccatcgacgaccgatattggattcgaccgttgaattctcacccaaacctcgagaactgaaggtagaagaaattcaacctttgaaattcccattccagtttgatgatgatctttttgaacattatggaaacacctcaaattattcctaccaaaagagaccaccggtcccgtgtaattctcccgcaccactcgatgagaatctcttcaaagagacggtgcagaaattaactaccatcatgagtgatgagtggttaatggagatggaggtttcttctgaagtaattcatattagctcccagtccttaactattccatatctgatgagagaggccatggtgcaaactctatataatcccactgttggtgcaaacattatgtctacaacctttgcattaaattgcttcgggggcgaactatttgcgccaacaaacaaaaacttctggagcccctctagtcccatcatcgaaggttatgggattcttcgtagagtgtcgatccagcacaatgatgtcgaagctatcctcgacttcaatgttttgaaagtctcttatttcgatcttttcgttggccatcccatagagaaacttctccttgatgtgccgcataccggagtccttgacattaaactcgggaaaatggtgtttttcattttgatcttgcgattgaaaaattctatgatggaacccattcctgattccgagccaattgaggaagtgatggctatctctccttttgaggcccccgaatccctcctcgaaaatgatgccaatgcattcgtcgaggagctaggacgatcatagagagatgatcgagttacccaaaactgatccacattcatgacctccagatgagctcaaatctcttctttcaggctttccttataccttcttgcatggtgatacggagtcgcccgtcaccatcagcgacaagctgtctactgacgagacctccaacctcaaagatgtgttagaaaagcatcgctctgttctaggctactcacttcaagacctgaaggggattggactggaccaacggtcaacaataaccggagcctctttgttggtcctgctg

SEQ ID NO: 87425 - DNA, 634 bp, Oryza sativa
aactcgtcccaatgatcccttagctttgggaatacgtcgaagttcggggttagtcccttcaagatgtatttcttgtacagatctcccttgaagctctggaactgtttggccattttcttacgagtccagggtttcactacgttctccgtacccgcagggagcgtgaatgtctcgagcattgtggtccacagcatctctttctttgattccgggacaaagctgtcattatccccgcgtgcccttgttctgtgccagtacaccttgctgacaggcacgttatacctcacaacccaaccgatgtggcgtacaaaattcttggctgcttctgccggggcactaggttagccgtctgtgtccacctcaattatgatgtgccgaccctctatcttcttcgcggcacctcgttgtccgcgtgccctcttctgtccagcggagggatgactttcactagcctcctcctcgtcccctccgcatccctctccacgttcccctccgcatacctctacatgttcccctccttgttcaagtactggtttggatcctcgttcccctcttcttcattccaagactggctgcttccctttacgattggatcgtacaatatctgtttctcatcgcgatcagccaactgttt

SEQ ID NO: 87426 - DNA, 756 bp, Oryza sativa
  unsure (1)..(756): unsure at all n locations
aggggttgaattcaaaagagcttcngtacctcananncncannnnactcgnaccctncctatgcataggtcaaccacctattcgccatcatggaaacaggtggtgtatgataatgctcgtatttacattcactaagaaaattgagatcatcctgactcattgttatgaaactgatgaatgacataacatgcaggtgacaacacatgagcagtataggaatatatacaatattggatatcatggatatcatgcagaaccatgttggagagtgggacatgtaagaaaaacctaacctaaaaattcatatgaacaccaaagttgcaaaaacaagattcccttatcttcctttgtcccttttgtttcaagtaatgtcgagcacaattagaaaagagctatttcatgattttcttgggaaaagagaaaatgataacccttgacccaggattacagaatatttgaaagcatatcatgccactcatttcacataaaagaatccatattcttcctttgcaaaaagtttttcggatttgttaggatgcaggcaatcaggcactattgaggacaaagcttgcaagccaggcactagaggaaatagggcagggaggggtttataaacaattgactaccttatgaatggagttggattgctaaacttccatcgcacgacgttacaccactggttacacctcaaaggtaagtcccgatgacttcttattcatttggagaagtattgatacattacagtcttactcgtgg

SEQ ID NO: 87427 - DNA, 710 bp, Oryza sativa
gactgtgcccattgaatgcactcgaactctcgccgccttcaacgccatcgggaccctcaccgtgtacctcatcatcatcggtaacgcaccacagcatatctccccccgagccgtacacccagcgaacctgcagcgctggtcgccgcgtgcagacgagtgatatttccggggattttggtgtgagtgttcctgcaggcgacgtgatgtccggcacgacgagcgacgggaaggtgcacgacggggtgctgacggagtggttcgggcagcaatggtggacagggcgggaggcggtgctggtggcagccgcggtgctcctcctccctcttgtgctccggaagcgtgtcggtacgtaagggagcccgcgatgattgttgtttctcattaggaccgacgagcagactctagatccagtgccccaaactaaaccgcattttcagtcatttggtcgaattctaaattcccatttccggaccaatttccactacgatttggcaaaactggacggtgtcgtatagtagtatatgaattttgcaaggttagaatgccttatgaatttgggaggagctacgacatttgaaaaatacctgaataccgtagtccctgaagtcataccctttaatttgctgtgacctgtgactaaatgcagattcactgaaagtcacatcagccgtgtccatcctactggcaggggtgttatgttcatcagcccg

SEQ ID NO: 87428 - DNA, 531 bp, Oryza sativa
taatataggtgagcggactacaaggtctaaggtaacgactcatgatgtttatgcaaattccgcatttgttgcttcttttgaacccaaagatgtttcacactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaagcctagtccgtaggcaggacttttcaagtctcggaaggtttcttcaatctgcattcgcttcgaatagatattaacaagttgtttgggtgttcgaatttcaacaggtaagttagttgctagaacccatg

SEQ ID NO: 87429 - DNA, 549 bp, Oryza sativa
attagaatccaaaggcttagtgaaaatatcagcaagttgcaactttgtgtccaaaaactgcaattcaacatatcccttctcaacatgatctctcaaaaagtgaaagcgaatatcaatgtgctttgtgcgtgagtgttgaacaggattcttagcaatgttagtagcacttgtgttataaaaaaagagaggtactttctcaaaagtaagaccataatatttcaaagtagataaaagccaaagaatctgtgaacaacaactagcagcagcaacacattcaaattcagcagttgattgagcaacactagattgtttcctagaagaccatgcaatcaatgatgtaccaagaaaataacatgttccactagtacttttcctatcaattctacaaccaccaaaatcagcatcggaatatccacttaagcatatagaagatgaagtagaataccaaattccaaactcaagtgtatgattcaaatactcattattcggttgaccgcttgacaatgtgaagcacgaggagaagcttgaaagcgtgcgcacaaacacaca

SEQ ID NO: 87430 - DNA, 1204 bp, Oryza sativa
  unsure (1)..(1204): unsure at all n locations
caaatgagttgaanaatgcaatggatggaccattttgatcataaatatcacgccccacaaatagaaattgatcagaatgaacttgtcttgaaaactaaatcatcacagggtttcatcatgccaacaaatactttaattacacaaatcacgagcactagaaaatatttattaattatattaattcaatgaaaactaaatcctcgaacctaacagaagctgtaaaatgttcatccaccttcatatataggaaaccagtgctcttactctgaagaaatggcagtagcatgaacagttctagttaacttgcaactttcattccagttaggctaccccaattaacaaccacaaacacatatactttgtcataaacactgtcgaagaggcgaaaataagcaatcctccaagttttcacgaacagcagagaaaagaacacaacccaggaaccaaccacgaaaccaacgccacagccaaagaggaagaacatttggtcatcagaatgtagttcaggtatctgctgatccccatgcttttcattagaaagatcaccatcctttgatgtgctattgccggggcaactcctttgaagaggaaacccacaaagaccattgttaccactatacatcaatgggttatacgtgtacagtgtttcaagttgcccgcctgatggtattggtcctgtcagattattgtaggacaaatctaaaatgcttaaatatgttaaatttgataagctgggaggaatctctcctgaaagattgttgtttgagaggtctattgattccaaagcatgcatactcccaatcttgtgagggatattcccattcaattgattccaagataagttcagatttaccagcccttcaagacttgaaatgtccattgggatctcaccagataaattgttaggtgagaagtcaatggtcgttatatccaaaacactaaaaccttagtatttaagctgtagtctcttggttattacagacagttcaccaagcctaagtcgataaaaacgaattgaggcaggaggatatggatttgctgcactatattcatataccatagcacttagattcgataggcatggaggtatcataccagataaccgattttccgcaagattcaaatggcgaagatctcttagtccagtgatagagcctggaatatgcccatggaacatgttgttgttcagtcgtagaaaccgcag

SEQ ID NO: 87431 - DNA, 1497 bp, Oryza sativa
cagttcaagaaaacaaaattagtttccggtaagattaatctattatatgcatatgcgtgcagtaaagcaatgagatgatactagacagctaaattgaagaatgggtgaatgaaccggacccaaatcatgattcagataaattttggtgagtgggggtgctttctctgaaaatattgatcccgggtatatactactatggctgagaatccccttacagtttagggaatctctgaaagtaagaacgattaacacaaacacaatgaatctgacaaagaactaaccaagctcatccacaactgatgatacaaattataacatggtggactacattacatatggttagtggtgggcagaaaattaatcaactatcagacaacattgactgtcacaccactaacacaggaaacaaaagtatacagaatgacattttcttttgagtgcctctccaccttcatttattcattcataccagtaaacctgtcagttgtaggaagcagaacaagcatatgatttgaagtgcttaatttgcagttgcctgtctaattaacctggcccaagtaacaagtgcaaaaacatacgctttgtcgtataagttgtcggcttggtggaaataagcaactctccatgatcttttgaactatatggcgcagaacaccacccagagaccaatcacaaaccctgacacaagcccaaaataaaagaacatcacagcctcagtatcctccacacttatgttttgtttcccatgctttggtgcattaacgcttgaacaattcctttgaagaggaggtccacatagaccactgttgccatcatacatggatgggttgtttgcatatagggtgtcaagttgacttccccgtggtattcttccaacaaatttgttatgtgacaaatccaaggagcttaaatatgtcaagtcggataagctcagtgggatttcaccagaaagattgtttcttgagaaatcaagtgattctactgatttcatgtccccgacattgtctggaattttccctttcaagtgattcgatgataaatttaaattcaccaatccatcgagacaagttacttgatctggaattccaccagttaattggttttgtgacaagtcaatgcccaccagatcaaaacttccttctgcatgatagttaagttcttgatgtttcatcactagcgacagaatatctgtgagtaggacataatacgttaaagattcgtaccaaccaacatcaattctcgtcggatgtagtgtcattgcttttaagtttaccaaagttcgaggaattgatcctgacatgttatttgctgctaaattcaagtattgaagactgccaagatttgctatatttactggaatatttccatggaacatgttgtgacttagctgaagaaatcgcaaattctccaagtctccaatccacacaggtaatgctccatagaacttgttccgtgaaagatctatgaaagccaatgaccatgtgtattggatgcata

SEQ ID NO: 87432 - DNA, 1627 bp, Oryza sativa
  unsure (1)..(1627): unsure at all n locations
aacgggctaacttacaatctggtgcgctgtataataatagttcttgtaggctatttatcaaatccattttaagaaatatacatttaatatctataataaanaatagatagtctgatgtaataattattaaataatatgtttcaaactagccgataggcttataacttaaaactaggttatcacatctatttagtatgggtaacccgtacatggtctcggatatataagtggctcaaaaattacacaaacttgtttctctatgtaataaaccatccctacaaaaattcaattgaatttgataagttcttatagtgtgaacatgagttcttacagagcaattgctatgcacgtaatttattcgcacgatttaaggcgacagtgaaatttttaaagtatcatggattcagtctaagcatgcgagaagtgtagatgttggatttattagcttggttcataaaaaggaaggaagtaagggtcttcatgtctggtgagtttgatttgtctatttggtgatgccatctgttattcggctatgaattagattaaatcaaatttaagacgatagatggaggtgaacatgtattcttcaggtagtctatgatgtgccagttgggaaggggtccaattcggcttcggtaagatgactatggtgataggttagatggtgtagcactgttgtagctggagtcaagaggaagaagttatggggatagcggattcttatgattacggtgagcctgctgaaggcttgtcggggcgactcatcatgacagcgaacggatcaactcaagttcaagtacacaaaggtttgtgtaggattaaatagcaagaattaagccaaccaaaggaggagggtgaatagctggagtacctaaaaccaaaatttttagcggaattgaaagaagtacgaattaccgccccgaactattgtggtcgaccgaattacccccctaaactcgaaaaccagacatcgtttacatcaataccggacgaattatccccatcgacccaatccagagcggttttgtcctacatggcgtatgggcagcggttcagtaagcattttatttataaagaaatgtgggacccacctgtcatactcctctctcactctttctctctctcttttcctctctcctatctctctctcactcttcctctctctttcttgccggtcagcggcaggcgggggacacggagctgcggcggcgggggacgagaaggcggctggggccgtagccactacgaggagccgccccatcgcacggagacggattgaagctggtgctgcccgtggtgccgtactcgggcacagacaaaccccccggtggcatgcttcggctccccatcctcggcgtggggctgtgccagtccttctacgccggcgacctgctattcatctagcatacttggcgttggcgcacgctagatgaggaggatggcgctaatgctgatgatcatcatcttccctgtggcccggcctaggtgtcgttagggatgcaagctgggtggccctctacccgatttacaccgccggtgctcgactattatttcgttgctctgataaaacttagaacgccaaatgaaattcactttgcgtttgctcggaaaacaaaggcccgtttgg

SEQ ID NO: 87433 - DNA, 2999 bp, Oryza sativa
ctagtaatagtagcagtattttttggtacaatatattccaccaaaagaacgctgctactacgcaatagcctaacgtgtgcctgacttctgagacaaggttgcccatgtaacaacaacaaacacatacactttgtcatacaccttgtcgaagaggcggaagtaagcaatcctccatgttttcttgaacaagatggtacagaaaaccacccaaagaccagccacaaatcctgaaccaagtccagagtacaagaacattggctcagaatctctttcccttctctgttcaacaccatgctttgatgcactgctgttgtctgagcaatttctccgaagaggatacccacaaagaccagtgtttccattgtacatagacgggttttccgcatagagggtgtcgagttgaccccctgatggtattcttcctgtgagatggttgtatgacaagtctagcctgcttagagatgttatgtttgataggtttgatgggatttctccagaaagattgttttttgagagatctagtgattccaatgattgcatgacactaatgttgcctggaattcttccactaagctgattccatgataaattcaaatttttaatgccatcgagaagagttagctcctccggaatttcaccagttaagtagttcaaagacaaatcaatggtcacgatatctaatactatgggtagtttgtagtaaagtttttggcccttggtgtccacagacatatttgcaatgccaacattgcgaccataacgaccagaaattgagtaacgatcgaagaccattacgatatcacaatgaccacttttcttcatacatattaaattggacaaatgcaaaggtaaaacacccgaaatagaattatttgatagatctagttgaacaagccttgtaaggttggtaatgcttgttggaatatttccagagaaattgttattgcttagtcgtactattgctagattcgacagctctccaatccagatgggcaatcctccatagaagtcatttgatgccaaatccagcatctctagattatgtctactacgcaaaaatggcgggaactttccggacaaaatattgttgctgacaaatagcttactcaaaaacactggctggaaacatcgaggaaattccccctccaaaagattgtccgctaaatctaagtaaacaaggtgatgcaaatcacacatagagtttggaatatggccagtgatacgattggagaagagatgcagataagataagacaaggtcatctccaaagttcgatggcagaggtcctgataaagagttccttgagatgtccattatttcaagtgcttttggcaacaaaggtatttgaccggtaagcttgtttgatcccatatatagtctagataatgtagtcataacctccatgttcgctggcaagctaccattgatttcgttgttggaaacatctaaaagttgagcattcaaaaatgttgtagaaaaccagtttggaagcctatcagtaatacccgcaaatgacatattaagataagtaatattaacctgttgtttcagccaaccgggaaagcgagggcccatatggcaaggtgaaaacaatgcaacctcaagactaaatagaggtaaccattctgaatccaccaaaatcttcaaggaattaccggataagtccaatgtcttcaaacttctcatactagtaaagtgttcatctgtgatcactccgttgaggttgttactgctaaggtccaagtaagttaaattactgaacatgcctatctgaggaggcaagggtccagagagtttgttatgagagatgtcaagaatgaccaagctagttaagtgatccagacgatttggtagaattcctgatatattattgtctgacaaatatagttcattcaatctgttgtacgagcaccgcggtaatctctgtagcaactttgcaatgtccccatgaatttgactccgttcgagatgtatgattctcaagttgcatagatttgttaggtttgttgtcacgatgtctatgttacatgtggatgacaagtcaagaaatcgtagggatccaaattgtcctggaacgtttggaaactggccatagagtttggtcgacccaaggttaaggtacttgagtccttgtgcattccagaaccaacaggatgcaattggatggttgaaatagttgacagagagatcaagctcctcaagattggtcaggttaaagtgtgaaaaagattgatccgcataaacaaggttgcagtaagcaagatgaaggaccttgagagaaggaatgttgttattacattcggccaaacatggtccatgctgaggctcgtatggcttatgtcgaggtgcgttagagaatgcaggcgcgctaaccattggatatccgtgaagttgatgcctgtatctgacaggccaagatagtgtagatttgtgaggttacccagctggggaggcacctcaccggaaaatggtatgccggagaggttaagatatctcaagttttgcagagagcccaagaactccggaacacggccggtctgtccctggagctggttcttgctgagatcgatgtgctccagatacgtcaagttgagcagagagggacttatctcgccggccaggtcgtacccggaggtgatgaagtcgtagtcgttgctctggtcggcatacacgttgcggaggtgaagcccgacgacatggccgccggcgccgcaccggacgcctcgccaccggcagcaatcggcctcctcctccgcctgcccaggcccagcgccgtcgtacttccatgagtcgaggagacccattatatcttcggtgatgcctgccttgaacgtcagcagcgcgtcccgctcccgcggcgagcagccggccgccgtcgccacgttgccgtgggcgggcgccggacggcgtgtggcgccgcgtggcagcgcggccaccgccgcctccacttcatggttggtcgtggccaaggcggcgacggcgaggacgctgaggatcag

SEQ ID NO: 87434 - DNA, 690 bp, Oryza sativa
ttcttctctttctctatctcttccaaagccttcaaacgcttgtcgatgacttcatcaaggttgtctcccattaatatcttgtaatcttcacttgataaatcatcttgcttgatgtaacgaagagaaccaagatttacctcaactggtaaaacggcttcttgaccataaaccaactcaaaaggagtgactttagtggcaccatgtttagatatcctatacgcccacaatgcttcagaaagcacctcatgccacctctttgggtgttcctcaatcttcttttttactatcttcaacaacgtcttattactcaactcggcttgtccattagcctgagtgtagtaaggagaagaactcaacaatttgttaccataagattcggcaaaactcttcacttccttagacataaaagaagcaccttgacccgtagttaatatttgcggaataccgaatctatgtataatatgcttcaaaataaagtcatttaactccgtatgagtcatattcttaagcggcacagcttcggcccacttggtgaagtaatccgtagcaactagcacgaacctatgcccctttgatgacgaaggataaatttgaccaatgaaatccaaagcccaacctcggaatggccatggtttgatgatagggttcaacacggcggcgggcgccaactgaacattgccgaactgttga

SEQ ID NO: 87435 - DNA, 521 bp, Oryza sativa
tgccaaaactcttggacgcttgtttaaaagtaacttaagtgtagagccctgggaggacatattgagaagtgaattgtgaaattggaacaagaggagactgacattttgccagcccttcgactgagttacgtttacctaccacgacacatgaaaagatgcttctcaatatgtgccctgtatccaaaggatcataaatttgacaaggagtttttagcagacatttgggtagcacaagggtatgtggaggctgaagatgcatcatcttgctttaatgaccttgtaaatcggtcattctttcagaaagcagctggctatagtgatatgtacgtaattcatgacttgatacatgatactgcacagctagtctccaagatgagtgcttcatcatacaacatgtgagtgacctagctaaaatcccatcaaaggttcgccatctgtcaatattcaccaagggaaatatcagctgtacagaaatagtgactatttgcacacaaaataaaaaactgcggtccctaatatgc

SEQ ID NO: 87436 - DNA, 2298 bp, Oryza sativa
gcggcgtggcgacggcggcggcggcgtggcgttgtggggccgtggcggcggcggcgtggcgtggcggcggtggcgtggcgtggcgtggcggcggcggcgtggcgtggcggcggcggcattgcgcgcgcggcggcgaaggcggcggcggcgtggcgacggcggcggcggcgtggcgttggcatgcggcggcggcgttgcgcggtgtcgaaggcggcggcgtcgaaggcgacggagagagatcgagatcggagagatcgagatgcatgaagggagatgcggcggctctcaccctagagatgcggcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaacgtttaagtgttggtgaagaagacgagggcgcaccgggaatatatatacccctggatctttactcccggttgttctcaacaaccgggagtaaatatcttttcccgctatttcgaaattctttttaaacccggttagggttaagaaccgggactaaagattcccgctattaattataagtcatatgattttcgcttacatatgtgtttataaaatagaagttaatgcattaacattatttaaagtacaaagattgatgacaattacttcgaaaaattatttttgtctgtaataaattaagtggataaatcgtaataagcaaatatatgacttataattaataaaaattccaatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctagtaatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtcgcttcatttgataggaggatgctagggtcaatcgtcaccgtaaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacataaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacgg

SEQ ID NO: 87437 - DNA, 1333 bp, Oryza sativa
gtaggtcgtaacgcttgacagagaaaggattgttttacataatgtttgcaaatgattttggactacagagttaggtctttcgtcccttgatttgtaaacaccagtgaataaaattaggtgttggaagttcagatacgtgtttgaaggatgttctgatgtgccaatttctgtagcgaaatcagtaagatttcttcctagcgcgcaatttagagagaaggaaaccgctgctacttggtaccaatgagagttttgccccccttgacttattttaaagaagatttgtggtgcgcctttgtatttttatctcaaaatcccttgcacatccatgagttttgtcgcttccttcgtcatccaaacttttcgtccgtcctttatctacgcctgttacgagtctatctgctgagaacgtaagagtccgcgttagatttggtgtgtcaaatacgtattggattgctagtttctacgtacgatttgctaaacaaatcttctcttttgagttgagtttatcaatctacagtttttctcatcagcatttctcgatgctaaatcatatctcatgccagtacttgatcccaagagaaaaatcatctcattgcagaacttgatcccatgaaaaaaaaagaaactacttcctctgtctacaaaatataagggattttgcacggatatgtcatatcctactctctgtccagattcgttgtattaggatgtgtcacatccaaccaaaaaccttatatttgtggacatataaagtactaatgtatggttactttttttcccggtgtattacaatgtctaatcaattatagaggagatgaatgcatgaaggaagtagtaggggtgaaaacggtacggaaacggacggaaaccatctttatcgttttcattttcatatttttttcgagatcggaatcggaaaccctggatacgaaaacggaatcgaatattatcaaaaccgaaaacggagtgaaaacgaaccggcgcaaatacgataacgaaaatttatcggaataaaaaacccctcaaactgataaatccaattctcaagtctcaacggtcaacaattcattgtaaaacacaatcatataagtccaattattaagcatcaacagcacatcacaaaacacaatctatgaaataaattatctatgtttaatagagtaatgttgttgataaattccaatgcatggaaaaatattctgatgtgattttagattttcataacaaataatttttaaaaaataacaactaaacaccatggtattcactattcagtgcttaaaaatgaatccacggtatttcagtcataaaatttctggaaattccgagaaaa

SEQ ID NO: 87438 - DNA, 585 bp, Oryza sativa
tccagatctcaattccccgatccatcgtcaaatccaaaccctaatctcaaatccctcccaaatcaaatcttctcgaaaaagtctattttgcctccctcgagttcgtgggccgatctcctctcccccggcccattccctctcagcccatctctcccccttcctccatccttgcccgcacgtgcgaggcacgtgcgccactcgagcgctgagcgctctctctctctctccctctccctctctcttctccctccctctctgctctcgctgtcgcttcccgccgacgccgctcaaatcaccacaccgcccgttgcttcccgcgcgcgcgcgccgtggtggccgaccggccggtcgccgccgccgtcagcgcctgccgcgcctgagcccgcgtctgccgcccttgtcgccgctccactccaaaccgccccgctgtcatcgtcgtcgtcacgacccgggccctgccactaccgcgcgcatgcttccaagagatggaggcagagctcctcctccctctgccgcgccgccctctctccctctttcttttcccaaagtggcaagaggcaagcctcctttccctccttctttcct

SEQ ID NO: 87439 - DNA, 587 bp, Oryza sativa
  unsure (1)..(587): unsure at all n locations
aggcgcctttgtttgatgacanactancttggnacccggcgtgtggtcgttcttgatcccgaacatctccctgatctgctccggcgacttgcccttgatcagctccgccgtgcgctgcgccgccaggctgagaaggccctccacgcccatgaagttggccgccatgatcaggtcgtacagcatgtcgatgcccacctccatgaactccacgtcgaacttcttcagctcctccttcgccttgcggctgctgctgctaccttcggcggcggcgatggcgtgcttggtgcagtactcgatgaccttggcgagggcgctgccggcgacgttggggagagtgatcccggcgccgccgtcgccggtgcagccgtcctcgatcatgtggaggagtatccgcgacatgctcgccgccgcctccgtcatctcgaaggcctccccgtcggagctgatcaccttgatcatcttcttgttcttctcttctgccgccgccgccattgatgatgtcacgcgagctgatagatgtctaaattgatcgacggcgaattctgaagctgatcgatctctgagacgacccacgtttggtgattgat

SEQ ID NO: 87440 - DNA, 671 bp, Oryza sativa
aagtcgtagacgcccaacaatggcggcataataggctggccgtgcaggcggaagcaccagtcagcggtggcgaaggcaagccggcggtgaagtcatagacgcccaacaacagcggcataataggccagccgtgcaggcggtgacaccagtcggcggacgaaggcaagtcggcggtgaagtcgtagacacccaacaacagcggcataataggccagctgtgcaggcggagacaccagtcggcggcggacgaggcggccgctcggtgaaaacgtagacgcccaacaacggcggcatattaggccagccgtgcaggcggaagcaccagtcgacggtggcgaagacaagctaacggtgaagatgtagacgcccaacaacggtggcataataggccggccgtgcaggcggaagcaccagtcggcggtggcgaaggcaagccggcggtgaagtcgtaaacgcccaacaacaacggaataataggccagccgtgcaggcggagacaccagtcggcgacggacgaggcggccggtcggtgaaaacgtatactcccaacaacagcggcataataggccagccgtgcaggcggtgacaccagtctgcggagaccaaggcaatccgggggtaaagatgtaaacacccaacaacggtggcttaataggcccgccgtccaggcg

SEQ ID NO: 87441 - DNA, 1802 bp, Oryza sativa
gaaggccaacagcggtggaggttttgcagcatcccttctttcaggttatttttctggttattactttccatagtacatgatgaacttatttatgagtttgcggtagttgtatatttgttattttgaaatatcataattgtttttttttacagccatgcttctacatccccccttcacttcgattcagatcaacaaacggatatgcagcaacaccaccatcaggtttgtcattatcctggcgatgtagaaactcatttttttcattattagaacattgttattgaagcaatttgaataattgatctacagttggggctaaaggagctgtggatcagaagaatgctaggagatattccgtggggcccttatctaatgggagaccagccgttaattactcatacttgagcgctaacaccccggcaagagcaggtatacccatttaagatggtttgtcatgctcatttcataggggaggatttgtggctgttgcacttggaattataacaaactataattacctccttgtagctggtgtgcaaaggaagctggagttggatcaccaggtgaatatgaattcttgtcaggctccagagggtaaccataaactgacaaaggcagaggcaatgaatcagccttggtccagaccaccaccagcagcagcagcagtaaggagcaatggtgagtgttgttttaaacaaactatgggggtgtttagatctatgggtgtaaaattttggtgtgtcacatcaagtattatatagggtgtcgcatggggtgttcgggcactaataaaaaaactaattagtccgtcattagcagatgtttactgtagcactacattgtcaaatcatggagcaattacgctcaaaagattcgtctcgcaaattagtcgcaatctgtgtaattagttattttttagcctatatttaatacttcatgcaggtgttcaaacgttcgatgtgacatggtgtaaaatttttgtgggggaactaaacagggcctatagttgaaatgatttttgtctctttatttttgttgatatcatgcatgcatctatttaacttcacttctcgcatcccttatgtaggaaattacttcactaaagaccagggccctcgtgcgcctgacattgcggagaagctgtctcagctgacagtgggctccaacagggtgccaagcttggcttcggacaagtttgtggatatgaaggcaagaacccatgggaataccatgaagcggcctttgcctcctgtgggaaccaggacatggcacgccccggccgaccccttccggcgcccatacgagatgccaggcgacagggctttccttcccaggaagctcgttagctgaagactacgatgaaacggaagctgccgccacactcctctttgctaccctttcaccaatcctcctactatcctgaaaaataagaagccaacagagccgatctccctcgaagagtttttagtgctgtttcctagtagtgtcgtattggttgtgaatctcataccccaataaaaatggagatgtgccagcctgctggtactcctatcttgccttgcattggcatccatccatgacagcacctcgaggatgcagctgatcctcgggggcatgcaagcatggccgggcgcgtctgcatggaaaccttgtgtttcgagtcggaactgtgtgttatttgctccctagtgacgtgacgcttgttgagtcgtttctgctctgcgttggctggcccctgcctgtgacatcgcagctactacagtactactactactatgtcaaatattggtataagactatta

SEQ ID NO: 87442 - DNA, 629 bp, Oryza sativa
cgcctgcacggccggcctattatgccaccgttgttgggtgtctacatcttcaccgccggcttgccttcgtctccgccgactggtgtcaccgcctgcacggctggcctattatgccgctgttgttgggcgtctacgtcttcaccgaccggccgcctcgtccgtcgccgactggtgtctccgcctgcacggctggcctattatgccgctgttgttgggcgtctacgacttcaccgccggcttgccttcaccactgccgaccggtgcttccgcctgcacggccggcctattatgccaccgttgttgggtgtctacatcttcaccaccggcttgccttcgtctccgccgactggtgtcaccgcctgcacggctggcctattatgccgctgttgttgggcgtctacgtcttcaccgaccggccgcctcgtccgtcgccgactggtgtctccgcctgcacggctggcctattattccgttgttgttgggcgtctacgacttcaccgccggcttgccttcgccaccgccgactggtgcttccgcctgcacggccggcctattatgccaccgttgttgggcgtctacatcttcaccgttagcttgtcttcgccaccgtcgactggtgcttccgcctg

SEQ ID NO: 87443 - DNA, 1976 bp, Oryza sativa
ttccttccaacaggagttctcttcatcagttcatcgtttggaggttcagttgccaatgccagtgctcatagtgtgtccatgatcatgttaacccagagcagttggacagcagtaagaggagcactccctgaatgccaagcagaagtacaaagaacagtcaagagtaagttatgaaacaaactaggaaattcttgattttccacattaataaattttatgttagtttatttttttaagttttagcacatctcttctgccactcatttgaaatctaacgaaaaatttctgctgcactaacactaaacagtatttgaacttagaaacagtaggcagcagactaggaacagtggtgaaggagaagtataaaagatgaacatgtatcagcagtgcagttattacaagaaaccaacatcaaaggttattttaatcggaacgaaactatcaattctatacagtagaatgaggtaaaaaacatcaacatttagctgtacctgtcaagcaagctgaggagaagttcactatcagagcgaccacattgactgtcagctgaaactgcacaaacttctgaatattaatgtacactgaccgaccccatttagcaacagtgactatagtggagaagttgtcgtcaagaataatcacgtcagcactttcttttgccacctgcaaacagatagcacagtgagaaattttgggagtgaaaaagtgcatagaactatgagggcatgaaatggatggtagtacaactcaagacaactaaattagcggctaaattgccacaaaaatacacttctaaaaaaatcgaagtgatgcaattcattaattatattggttcatgcaaggggaacacttatcaactaatctttgaggaaaatcacctcagttccagcaatgcccattgcaagtccaatatcagcttcatgaagagcaggagcatcatttgtgccatcaccagtaaccgcaacaacttcatcaaaagtggtccggagatgcttcaccaaggtgtgcttgtcaagtggtgaagatctagccatcacctgatacatgaaaccagaacacatcagcaaatgaaatccagaaaattcagttaaactgaccagcaaaagcaacgaaaactttacttgtatttttggtatcaactcattcagttcctctgcactcttggttctgaaatccggtccttcaatggcaatgccaccttcagtcaaaatgccgcattcccgcgcaatcgccttcgctgtattgatgttgtcacctgtgaccatcctcaccatgatccctgccgacctgcagatggcaaccgattccttcacaccaggacgaactggatctttgatccccacaatgccaatgcaggtgtagccatcttcaggaatctggtcattcgccgagaacccgtcaccgacatcgacgtaggcaaggcacaaggtacggagcgcctcgtttgcaaagctgttgatcgtggcgttcaggtgagcaacggttgcatcgtcgagtggcacgacgttgccttgatcattcaggtacttgctgcaagatgccaagatgatctctgacgcgcccttgctgtgtgcacgcattgctcctccggggagctggatgaccactcccattctcttcttggccgagttgaatggctccaccttgacgagggtgctccgccttgcgcaccggccaggaagtcgcccgccgagtgagaggcccgaactcgaggatggccgtctcggttggtgtgccaagtatctcgcgactcccgctcttgttgaagacgacgtcgccgccggtgttgttgaagatggactgcgagagcaacgtcatggcggactccggcagctcggagaacaagctcttggtgtccgaggcgctctccacgtctttgatcttgccgcagatgcatgccttgacgacggtcatgtggttggtcgtgagcgtgccggtcttgtcgctgcagatggtggtcgccgagcccatggtct

SEQ ID NO: 87444 - DNA, 1240 bp, Oryza sativa
aaaagcatagtttctgcctttttatctagcaaatccaacttatctaaaatccccttttttttcttttttgtacaagccactagtatgtttagaccaacccctaagatgctgtcttaaacgacgaattttcgcctgccaccgctccatggcagaattgcgttcatcaacactagaccatatctcctttaccatatcaacaaagccatcacgtaaaagccaaccaaattcaaacttgaaactatgttgagcattactcaaagaagaagtgtttgtatttaaaagtaaaggagtatgatcagaaatatctctattaagagccaccacagaagataaaggaaatttatgttcccactccgtgaacattaaaaccctatcaagtttctcatatgttggattcactaaattgtttgcccaagtaaatttcctaccagacatctgtaactcccggagacataacccatcaataatagcattaaaaaggaatggccatctatcatcataattatcattattcttttcatcagggctacgtacgtagaatattaaaatcaccaccaataagaattggtaaggtttcatgactgcacatattaactaattcagcaaggaattgatccttaaattcactttgtactggcccatacaccagaactaaagcccacttaaacttatcaactttattacataaatgaaacttaatgtagaaatctccctcatcaatcaaaccaatatcaacattaattaaattgatgcccaaaagcaaaccaccggacctacctctatgaggcttgcaatgccacaaaaattatttgccagcacacagatttttaagaacagccggactaaaatctttcttaatagtctctgacaaagcaataaaatcaaggtgatgttcctttgttaaatcagaaataaacttatgttttttcgggaccttaaacccatcacaattccagaacaaccctttcatttaaaaatattctttttttttctttccccttttagtctttttcttactattaggagaggtatctaaagaatataaagtggtctaagaataattatcatccacaccactaaaatccatcacctcctccattaattcaccacacaaatgttgaagtagagaattatcatccacctgatcatccaatatctcgctatcaacatttgaagtatgtacctgattaacagaagaactaacatattcacttaacatcttttcctctatactctttaa

SEQ ID NO: 87445 - DNA, 683 bp, Oryza sativa
ccccgaccaggacttcggcaagttctcgccgatgcccaccgtcacgttcatgtcgctctacctcaactccttcaatggcagcttcccggagttcgtcctcaggagcggcaacatcacctacctcgacctgtcgcagaatactctgttcgggaagataccggacacgctgccggagaagctcccgaatctgaggtacctcaacctgtccatcaatgcgttctccggctcgattccggcgtcgctcgggaagttgatgaagctgcaggacctgcggatggccggcaacaatctcaccggcggcatcccggagttccttgggtcgatgccgcaattgaggattcttgaactcggcgacaaccagctcggcggggcgatcccgccggttcttggccggctccagatgctgcagcggctcgacatcaagaactccggccttgtctcaactctgccgtcgcagctgggaaatctgaagaatctcattttcttcgagctgtccttgaaccggctctccggtggcttgccgccggagttcgccgggatgcgggcaatgcggtacttcggcatttccacgaacaacctcaccggtgagatcccgccggcgttgttcacgagctggccggagctcatagtgttccaagtgcagaacaactcgttgaccggcaaaattccatcggagctcagca

SEQ ID NO: 87446 - DNA, 657 bp, Oryza sativa
atttgagaatgaagggcacctatatgtgggtacagcgtgaagttgccttaaactatttgcttacctgagctgtacatcctttccgcctacctacatgatccatactcttaatgtccctaacccagtcgtgtgctacaagctgcatacggtccttggttgcaggaacctgtaaacgcccgtaagaaatgcactatgctttagttgcctgctatacttcagaattaagaaaacctgcagtgccacttttaatgtttggacctttgatttgtcatgtggaaagctctcactacgaactttaaagagctcgctctcatggactgtccagaaggtacggcttttctcatttgcatgccgacgagtaatgcccgaactacatcacaaacctattggatctgtatcaaccattataatgacgatggatacagttgaaaaatgatgcttcatctaggcagattatgcacatatcagactaatagaacctgcctgtgtacttatcatcactggcagagctggtaggtgcctcctgtacatgaatcacataacacttcagtgtgaagtgaatcagcaataaaactctcttcaaactacaagcttaggacaaatgtaagtgttgtatgtatttttgacctcaagattagcttcaggaacttgatagtc

SEQ ID NO: 87447 - DNA, 1109 bp, Oryza sativa
atatatagtgtgtcagctagtaatctagaaaaggaattatctcttctgagacaggaacaagaatatctcggaaatgaaaggcggaagcttgaaagccacgcagagtctgtcagcagtgagatgtttgctgaatgccaggtttgaatacaatcaccttttccctttgagttgaggcaaggtttacctcagaattgagatttagtggaagtttgaagtaaatggttttagcagtacaaaatgttaacatatgtatgtcttgtattatacaggaattgcttcaaatgtttggcttgccatatataattgcacctatggaagctgaagctcagtgtgcatacatggaaatgactaaccttgtcgatggagttgttactgatgattcagatgttttcctgtttggtgcaaggaatgtttataagaacatatttgacgataggaaatatgttgaaacatacttaatgaaggtcaattttctttctgctttcaattttactctcatttttatttcattgccagctgaagcaatgggaagtccatgtccttgctggaccttccacagctaatattgtaatacattttcaggacattgagtctgagcttggtctaacaagagaacaattaatacgtatggcaatgcttcttgggagtgactacactgaaggaattaggtgatatgctaacaagaatatgtatcctgtaactttttttgcagtttgtataaaaataagatcagaacttcatttttgggggatcctctagagtcgaattttaggcatgcaagctaatatgaactaaaaaacttgctgttccagagatcaagtgcatgctctgttttgttggacaaatttgttatgtatacagtcattaagaatacagagcattgtactttaattatgccatctcaatttcttattttgaaggggggaaaatgccatttcagtttctgttttgtccagtgtatttatttatatactgattatgcagtggcattggcattgtgaatgctattgaagttgcacacgcatttcctgaggaagatgggctccaaaagttcagggagtgggttgaatcacaagatccaaaaaactggaaaattggttggaaagtgg

SEQ ID NO: 87448 - DNA, 2050 bp, Oryza sativa
cagcaacagtaagtacaaaaaaaatgtacaattaatgatctgattaatctttcgtaataatcggattaagattcctgacgatgtgtgcatcaggtggtgcagaagaagggtaataagaacgcgcagtcaaagaaggcgcagaagggcgcgtgcagccggagcagcaaccagaaggagagcaatggcggcggcgacggcggcaatgtgcagagctcgagcaccaactacctctctgatgacgactcgctgtcgctggagatgacttcgtgcagcaacgtgagctcggcgtccaagaagtcgtcgttgtcatcgccggcgaccgggcacggcggcgcgaaggcgagggccgggcgcggggcggcgaccgatccgcaaagcctctatgccagggtaggtagaactatgcgcgagttgctgcacatttttgttgctcatctgaatctgaatttttttttaactgtcttgcttgaacagaagaggagagaaaggatcaatgaacggctaaagatactgcagaatcttatcccaaatggaaccaaggtaagttacttaaaaaccatctgattccaaaaccgcatcaatcacaatactccacaaaagcctccacgatactgaattgctctgatcatgcgaggacttgttatttttttcaggtggacatcagcacgatgcttgaagaagcagttcactacgtcaagttcttgcagctccaaatcaaggtaaccataagacccctgattcgaatccaagagcccaagttttgcttcaattcgcgcgttggtctctaatcttccataagctaaagcaatgggattcatcgttttgcgcagcttctgagctcggatgatatgtggatgttcgcgccgatcgcgtacaacggggtcaacgtcgggctcgacctcaagatctctccaccgcagcagcaatgatccacgtactccagccatggcgccacggacgctagctcaagctatggttctttgcagctggcgcagaaatacatatttttttttcttctacttctgttgatacagtacatttttccatcctgaatccatttgattcattcccaaaggatggccaaccttaattatatacctcattgatcgagttcttttttaccatttcgctccttgcctcctcgtacagcagatcctgccatggaagaacttatttttgggcaacggaatgtgaaaactactgagaaattggcagaacaccttcgctagtcggtttactattcttaaaagaaaagcaacgagagagatgaaaggaaaaagtgagcgtgaggtctcttatcttgtcatcaagtttcaaaatcatccctaaaccgaaatactagacataacacatatctaatcttgtaaaatcagatcacattaggtcccaaggcaatattactcctcggttttgatgatgtggcggctgagtcttattccatttatcttctctctctttccatctcaacccaaacctctggggcatccgacaacaggaggggagaagagtagcggccgttgggcggcgacgccaagtagaagcctgacggtgacggccggcaatgggtgggagaaggctggcgaccggcgagaagcttgacggtggcgggtggcgggaaagaaagcggaagcgttgaggatgacgcgaccacagcgtggagtaaatggagttgacctcgaagatgatgcagtggagctgtgcgtgcgcctccgcgggggagagacaaagctcgaggacacctaaacaaatcggcttttgagcagctcagtggagatggctctgagtttggggaataagagcttgggcagcatgacgtggcggaagccccagcccctgtgtgtgcaggtgaatacattgcaattgcagttgggtgcgcagtcaggtacatgacacgagcactcccggctattgggagccacactagccggcagtctccgccgtcgagcttgtccccgccggctggcacccttctccccacccgttgtcggctgccctagaggtttgggttgatatgagaagagagtcgagagaggtggaagaaaattgatgg

SEQ ID NO: 87449 - DNA, 692 bp, Oryza sativa
ccgattccatcctcactgcaccctcaaggcgtgaactcagaattcctcaattaatataaaataacggtcaactttctagcttgcttttaaatgatttttaaaatgtaaagcaatttgcaggaactggtatcaggctgttggtgagaatggaaccccaaagcattcagctgaaatgtccaagtaagaatttcttttccgtcccttaattcttgaggattttagttcattacactacttacaagggatctgcaggcatttggacaagcaaaatcaagccctaatggaaacttaccgagcaatgtcccacgagttgcataaagttcaggtgagctttatatggagagtattggagtatgaggcgtcactatgtcttggaagtaactttttagatagtaatactttgaaaatgttggtctgtacaggtggaagaagaaacaatcatgcgcaagttatatgagctgatgtctgcagaaggacttcttccgaaggtatgccgctcaccgacatgctaatactttgaaaatgaaatgttacacttctgatgctattttcccctaaatattctcttggagctgctgacctcatcattattcttccattaagtgatctgttgatatttcaccatgaaccaaatgctgtagttcattatagatgcaagagaaaaaaagaactaattgaaagatgatgggaga

SEQ ID NO: 87450 - DNA, 4531 bp, Oryza sativa
  unsure (1)..(4531): unsure at all n locations
ccgcacgacgaggtggtcgcggccgggctcggcgggcccgacgcccaggagtcgcaggccgtcgtcgacctcctcaacgatgccctcgccgcgctcctccgcgataagccccgcgagttctggcgccagggtaaccgaaacgctcgcttgtgcattactgtgctcatgaaaccgtgtagctggaaggcgtgaattgttattttgggattgggaaatcagagctgaaagcttgaaagcgataactagttaaccacttaatgttcggtgtttactgcttgtttgcttcaattgtgtttgttgaatgcatcttctgatgcttcggtctctgtgattatctaggctacggattatgtgtaaaattctagtgtatgcttgttcaaatgtcagtttgcacttttaagcgcaagataaaatgcgtgcagttaaatttattactacatttgcagttgaagtggctagtagttgcataagcaaagcaaagcctatgcaatcatattcttatcactatcatgacctatgatcctttgaaatagttttaatgggaaggaattaatcctagtcccttcagattgacaggaacttcagattgacaggaataactaccctacaatcagaggaatatggcattttttcttatgcaaactaagcctgaacaataattgagcgagtagatgagtcaacataaaagcttgagttgaggacacgcctagatctgtgattatccattgtttcactcctagaatttaacttatgaataaatccgcgtgcatttgaactttaccaatggtttcctaatgcttatcgttaccttttcccagtggcacagaatacttccctgcatgagttcctggacagttacctacaattcaggcatcggtggtatgacttgcctcatcgtgcacccaaagggacagttgctggcttagttgtcggggagcttgagctttgccgtcgagtctttatggtcctgtaccgcatgtgagatttataccatttcgctatctttcttgtatacatatttttcataagataatgcacactgttcagattcacatgagatttgtcatgatatggctcttgtttgggtggtagatcttcaaacaaggatcctggagcattcaggggtgaatcccttagcatgaaggagcatgcaggtgagattagaactactcatatgatcactgtttgagtttacctttttttagagcagaatggatagtgaccattggttcaaatatactatattcacgttgttcggttgtagccctcctgcaggagaaaagattgcttgatttacccaagttgttggacatttgtgctatttatgggcatgacaattgcaaattgacaagttcactggttggttcctgaagtgtttattattgttgttgtttttctccttttcattttgcagacagatgctaacttaaatgcaaattctaattcattcccttagtctcagataacctttttctattcattggcatgaatacttttataattttattaataacaagtgcacattttctgtatctgtaggttgaaaacgctatcaatgtccagcnnaatatctgnnatggcataatattgtcctcnnccanttctgggcattttccacacaatgcagagagggtgcatgaaatcatacaaggttattttgtgatcttcttcataaatcactgcacatagctgttataggattctgtattcctttatctggtatgaacatccatatgatatcattataacagctgttttcactttagtctgtagtcccaatcgcatatgctaaaacttttatcgttttctgcaaaggattcaggttattcatttgtgctattgacgaatatacttgttattacttgttatatctgttattgtttcaaatactttcttcccagttcctttcaacaaccatgatacattgcttggtaggttagatagaaagtgacgattatgatgtttactattaatttgtctctgtttcttttttatcctaaattgagattgaagtatgttttctcaccacgattaaaagttgaggacctatgatattgatataaacttgatcttgtagtttcacaccttcctgatctgatgacagtttagtagtttacagaagatcttggagaactatgcataaaaagaacttaaccataataaattcattttaggcgctcacttcatctggacggaatgatagtggatatacccaacttcagaaagatttctcacaggcaagttttacctatactgcatagtttatgatatgtctgctgtcctttcatctgatttttctatattgttgtaaaaccaacttccttcaggtgttggattttgtaaacgatgcaattgtcactctggatgcctttgtcgatgcttatcaacctgctgctttattattttgtacctcttttgagacgaggtgcgcttctactcatccaacacaatatttgttcgctgttcccttaataggcaatgatgcttatctaccacttaatttgcagctatggagttgaggaactactgaacactcttccaagattgtatgactcatttgtgccatctttgcttcatgggtttcaagttatgtccagttcccaaagcaatggagagactgcatctgacattatactgagtgacatagttcttggtataaggatgctgtcaaggagaactgtcagtttcgaatggagattattggagttctgctatttgaacaatcaacttgtggagcgtgatgttaaagcttgtacaaagatgtttccagctaaagtcgaagatctatgatcaggggtgacatcatatttcaaacactcaaggatattaatagagaagccacattttcacaagatcatcctggaagacattcctccaagctcttgaaaaggagttcaagttgatgaaccggattggagatattcgcaagaaaggtaaatgataaaaaatctcaattaaatgcttggttattttcatgtttgtaaaattccacactttcttagtatcccactattattatttcagccaaaattgtctctttagtttttcatccataaacaacatatacgatctaggaactttattcagaagttgtcatacaattattctacatatatgtactgaattgcctatgattctatattctgttactatgcctgctctcgccatctatgcatgagtggttcttagaaagcttaaaacttccagcttgatccagcatattgatctcaatgaatggaaagagaaagagccaaaacagaatcttatctatatttatatctatactacctaaaatgtatacgtgggggtgtctgttctgccacaccatccttaccactgacatttgggtcccacaatctatactattacatcaccctccaacaaaggcttctatttcactgctggttcttcccaacatttgaatcacctacttgttcaataaggaaaatcataaaagtactacttggattaactatgtgcttaattgattaactagaaactcaatttgttttccgttgcaacgcatggacttttggctagtaaaaggaaaagatgctctagcttctggtgtttggtctcataaagtcaccaataatattcccgtattaccctacatttgatttatttctgctcgcgcttgatcattctggcactcttgagttgtgttcataagacatcacttttccggttttgccaagattctgttgtgaagactgaaagagtttgctaaactgtcagcattattctgttgacatatatgctgtattttcttgttatctcaagtttattgattgtgtcatagttttatattgatgccaaaacctttggttgatgtattcaatatgttcctccaatcgtaaacaggatggatacacatggatgatgagcagttccagttcattgcacgcttgtgtggatctactctgacatcttggaatagtgtgcctgatttgcctgtctcttcctatggtggtgaactacaacataagaatgaggatactgccatcactgagtccaagattactcaaataagggacctctttcctgattatgggaagggtttcctcgctgcatgcctggaagcctacaaccagaacccagaggaagttatccaaaggattttagatggaaccctccatcaagatcttctagctctggatacttcattagaagagatgccgcagctaaagcctgcagccactgttgggaaagataagggcaaaggaatacttgtggagactgagcctcaaattatgaacaaaccccataaggttaatactgagatgcatcgctatgttgaacattcttcatcttcttcagttccatcagcatcccagggaccatcctcatctgtaccatcagtcccgcaaggtagatttacaaggaagaccaatgacgacgtgcctgactctgcaactctagactcacagaaagcaaaagatgctgttagatcagctgtgcttgaatcccagtatgaatatgatgatgagtatgatgactcgttcgatgatcttggcttcagtgtggtaga

SEQ ID NO: 87451 - DNA, 600 bp, Oryza sativa
tgtatgcaacttggacttggtggtttagaggcaacaacactcaagactaaaggatctactgtcggcagtggccgcaacgacgagcggcggcaacaggcagtggcatgtggagaccgcgacgagtggcaggcaggtgacgacctgcgacgaggaagacggatgacacgctcgacgagcaacaggcgtgggacgacgacttgtcaacttgatgcggcgaatgagggcatacaacgacgacggttggccctgcgaagcgcaccggtgaggatgacgacagccagatccacaacagccggcgaggacggagttgcgattgacgacgagccgcagctgggggacgactgggctgatgacatggacggggttgccgtcgccgatgcgcgtggatgcatgtggacgaggcaaggacaatgctcctggctgctgcctgcaacttggcggatgacgacttgatgagacgacgaacgacgatgctgtgcctgcaacttgacgaagatgacggatggcgacttgacaagaggacaagacgatggctcgccgacggcgagcccgccgccggcgcgccggcgagaacatcagatcgacaactagagtttggat

SEQ ID NO: 87452 - DNA, 1202 bp, Oryza sativa
ctaaattgcctgacagatcatcataagtagtagctacttttgttgcaaaacggcgttcaactcttgcattcatctgcagaacaaaggactagaagtaagtagtagttgctagcacaaagaagctactctattgagccccttaaaatttcttgtatatcattttcttttcggcgcaagctagatggactaaaattaaatacaaataagtaattttcatggcattactgttcccgacattgctttcctatacgtccaggcaaagcttgagcaatggttaaccatttcttcggtccaagtttgtttaccatctgaacaatgatctcatcttcctgaaaaggggaacatgtcattgtgagtataagatgactaacccatattatataagaaatgaaaataaatggactagcatgcttacttctttggaccatggcctttgaccaatcagggtgtagaaccttttaattgccacctgtgcaagcattgtacatcggttctattcgcaagctggaaaattagaaggtcctctgtcaaagcttggatttttaccaatatacaggaacctcatcaacagggtaggaaaaagaatgccagagaagcatgactagagtgtaagctaatgaaacagcacaatgctttactgtacatgagttgtgatagcatcaaagagggtaaaaaaatgcttgcgtggcttaagatatcctactgcactgaagtactaaacaattgtagcgcaaggtgggcttgagaacaatatggtaaaaatgtattatatatcaagtataatattgtgaaatattactcctgttacaacctgacatgtattgacatataactgtatgtaatcacaaagctaatgtgtaaaaattaaaaaaaaaatccaagggagtccaacatatgcatggtaggctatataaaatgcagtgatatagataccaaaggtcacacttttgaaggtgctccccctatgttatttcatctctcaaaaaaaatcagtaaaatgatatatgaattggactttagaaggctattttgtttatattttccagcatacaaaaaacaaccgcaacaaagttgaagaaaaacaaaaaatatgacagctaaaagatagtagaaatactatgataaagagtaaggacaaagtatgccaaatagaaccaatgcactaatagaaccaatgcatgggtaccgagctcgaattcgcc

SEQ ID NO: 87453 - DNA, 6762 bp, Oryza sativa
ttcattttctgtgtcttcgttatcctcagataaatgtttggaatcactaacagcattggtaaattcccagacattggaggatgctattcgtacttcaataaactcaatgccgaaggacagttaatcggtggattggggggcttacaataaaccttaccaggacatttgaggggatgaaaacctgggggcttttggattgtaaattggaaaggccagggggatcatcccttgttacaagggaatcagtgtttggtcagagagctgaacttctaggaaggcatttatcggaaatatacacaaatgtgctcgagtcaataactgtgaccacatcaaatagtacactcgttgcaaaatctgttgaaaggttggttgatgcaatcagaccaaatttatgtcatttggtgagaaatgaatcaaatagttcaagtgagtttgtttactcagttataggaaagcatatctctaacaaacaaggtgccaactggcagaagatcccaagtttatcttggctttatgtcttcttttttcgcatatatatgtcatgtagaagtttgtatctgcaatctattggcctcatgcctcctgattcagcgatagaagcaacagaactagtggggaattcattcgttgtatgctgcgggaaggaatggaccaattcagccaatattctcgcagaaggctactttgcttggattgtccaaaattcattccctctttttgatgctatcgagattttaacacaatctctttcgagaaattgttctgggtttactctgcttgttttcatccttcatgtgatggctctgcagagactaaatgaccttaacaggcagattaatgcttttgattttttgcttgaagatgatacagatcaatttgacaaggagaatagtgaaggcattgagttattaaagaagtctagctgtctcgaggccacacaactcaccagttttatgatgagctatgtgagactattatcatcaggagaacccggctctttttggtgttatgagattagttcttcctgggattcaagtctatgctctttagatgaattttcatttcctatagcaacttggcaactgctgtgtgaaaacattgatatttggagcccccatgcatctaaaaaggatttgaaaacttcttttctaatctgataaagtttgcttttgttgaaaagaggtcatgcaaagatgtggagaatagtgacagccaatcttctcaccgagaaattactctttgtaatgtttcagtgcagctcctttgtgatactattatttatgacagaaaggtatgtcctctcttaatccttccaccgaaagataatataggaccatttatctatgatttattgagtatgatgccaatattgatgtgctgtaataatgaccaatgttagtctttagttctatgtgttggtgatttctttcttgtgccctcgccaaattgcttggtctaatgcaaacttacaacttcttaggttctgttgaaaaatttggtgtcaggtttttgccatgctctgaagaaatcggtattgtcttttgttactgatgctaatgaagataatgacttgttggactcgccacctgatttggtggatatattaactaaactggaaaatgagaagttttttagtacaaattctgatgttacacacacaaatggcatagataaactatggatttgtgagaatttacttaatttttttagtacagttcctggatttcatgcaaactccaagtcattgttgcaacttatagcttacattctccatctggaaaggtaagttcgcattttatatttttgttcatgtgtactaactacaatggctattccttgtataatcatagtacaaatgtatgcacgccctttgtttataagtactaggcacttttgactgagagtagttcacaaatagttatcacttgttaatttccccaatgcataatttttcatgctatgctctatatcattgccgttaattatttgtctcatggcagtaattggagggcacaaatgtgaaacacttgagacttgagagaaagtgtccaatgtttatttgttcttatgaagatcttggtggtctttttagttgaacttcttgtttattacaacttaatttctttctttgtaaataattgtttctctgggttatttctagtggattttgtgttgtctttattgatattggggttctctagtctttttcagtatttcctttttgttaataaggcctatgatcagtttttgatgcaacgaattgtgatggtgaactgcgtgcatcctagttagtcaaaatgtcctgggaatctgtattgacaacaattttgggaaagtgcatggtgatatgcacattgcacatttcttagctgcaactgaaatcttttggttatctccttgctgagaatgacattttttcaattttcttgcagactgctgctattggcaatggtatgccatcgttatgaatcttgtaattccatggggctacttcgtctgtttgtatgctgtcgaagagcaatgaaaaatcttatcttcaattttggtaaagaatttccagagttgaagcaatactcagcattttccaaaatttttggtggctcctgtctgatttggcttttgaggtctgttcaggaacttgtcagtttgtcacacaaaatatttgaagagcacactgttgagatgaaaaatacaattttctccctggtagataagacatcagaaatattttcaacactaactaacatgaattctgtattttacttgttgggtgcaaagaaacaaatcatatcttccagcggagaaagcagtactccaaaacatgatgatcaggcattcagcatactagaaaattcagctttggagcatgtcaaaattatggctgaactgttagagaagtctacaactggcattcctgtaactgttaagggtagtcagtgtgttatcaaattagagaactgttatgacactgtatgctgggatagattattatgcaccatgtcttgcataagaggattcttggggggtcttatttcagcactagaaggcacatgcaaagattatctatcaagcccagaggaaaggaacgtgatgtttcagtatgcctccagattcagtgggtgtgttgctaagttgaggcctttgtagatatttgcatgcatgtcttgttatggagaccaaggattgcgagttggctgatttaatctctggtcatctttcacaagagctggactgcgagaacaactctctgatattacttgcatcatggatgaatggactaggcaccaaccctgaggagatcggatttcactcagatggtgtactaaatatttcaactgagactcgtggttttgatctgcccaaagtacaatttgtgaaaggatttcttttagaaaaagttttaagtggtgaggggccatccatagcatttactttaagggagctctacaatgcatctgctgctattgttaagctgaagggaatcctatcatttccaagtgaggtatgtagacatatatgcagtcctttccaaaagcttccattgggtccaatggttgagccagcttacatcgctctacacaaattagcagacatgtctaactggcctgacatgttttctcttttatggattgacggaatattaagttatcttgaagctgtaggaaacattttggcattacctgagatcaacatgtcaaaagaattgtacactcaagtagttaatgctcacttgagagctattggaaaatgcattttgcttcaaggaaagaatgcaactctgcctacccatgagattggatcaagtacaaagacactatatttgcagaatagatctggtcatgttgttgctaaaggtatcatcaataggcagaacagattaaattcactgaaatcaagacttagactatcactgggaaaatatgtcaatgtttcatcaaacatgcatctaaatacagctgtgcaagtcattgaaagagcattggttggagtgaatcgtttcagtcattcaatatatgaaataaacacaggaaattgtgatggtgggacagtttcttctgatgttgcggctgggatttattgcctctatctggttcttgaaactgtgccaggttagtagacaattttctgtctggtacttccagattcactatgtttgtaatgcaatgtggttccatgcactgcttcaaagaagtcaataatctactaaatattttcaaacatgatctcatgtgcaatagaattgtctgccaacactgagtgtgtttgacaataccaaaaattatcatgactaatctgtcttttcaaatatatgctcaaacaccaactagttaatatcaggtaataagcatggtcctcataaaatatatgtaggtcttcaataattaggaatttttcacagaaatgcttgacacactccttttcatattcatggcacctcttttggtagcatattaatatgctgtcggttcttgtcagtctaaataaactatcgcgttacatggacattgtccagaatgcatgaattattctcaactgagtggagtagttgagcaattcaggatggacctacttctaccagttcacctccacctgctgaccctccaaaatttaactgtgtttgcctcgatcttgttttgctcatatgtatgcgtataaggatttggcaggtagggcctaggactagctgttgggttattttggaatggagacaaatagttccagtccagaaagaccaaaaaaggtggaggggggggggggggttgggattaaacacaaggggtgtcagaatcatacatgcaccaggtcatgttcaagtcctatcaacttgcaccaaaactgaatggatttgtcggcaggaaaaagatttatctggtattgagagttgagggatgagctttatatggttttgagtcaagggatgatgattaaacgacactaagagttgaggacgaaaagtatatgttcctaaaagaaactgttgtatgatttttcctagagttatttcaaacacaagtcttgctagtgtcattttaaccacatgtccgcagccccttgcaatgcattatgtggttatcctacttcatggcagcacatctctttagaaaggattgtttttatacttgttttgactgattttcaacttatattgcaggaaataaacgtgtttttaagagaaccgtcccaggcctaattggtgctttattcaatattgtcttacatcttgaaaaggcttttattttctacacagagaggatgcctgttcattacccttatttgcacccagatgctggagccattgtcctaatgtgtattgaggttataccagcatttgtggggagacattcttttcaaattgattcatgccatgtctctcagtgcttgcatgttcccatgacactttttaagggccttaaacatcttctttcatgtcggaatatgccccatcttgcaacaagagtgaagagcacctgcagctagtaatgaatatatacttgatagacatttttcagttgacatgtatgcttcatgttgcaaattgttatgcactactattcgacaccaacagcggtaaaatattttgcctctcgtattttcattctgtagttatatattattattttcattccatattgttatatttcctccttttatgtctagtgaggttgcacgatgcgtggctgtcctggaagattcagtaaacatacttctaagttgtttggagtctccaaatcccaaaatggttagtagggccggttatttttcttggaacatggaggaatcaatgaaatgtgcttccttttttagaaggatttatgaagaggtcagtgatgcttatatttctgttatttgagatatatgtatcaatgtatactccctttgatcacgtttagtatgcgatgcacctactccaccattagccgcaacgtaggatgttagtatccaaaaaagagtatataaacatgaaccccgtagaagaaatggccctgtggacaatgtataccatatatatttaaggttggtaagccaacaaatcatatgcacactaattatccttttttgtggacaatgtagatgcgccagcaaagagaactcctaggaaagcactcgatgtactttcttgcaggttacatttctatgtattctggacagggtccatttcagacaggcataacacggtatgcccttcctaatgaagctctttcatttatgctttggatcagcaattttacttttcttacatcgcagagaaattgatgaggccttgagacctggggtttattcgcttatcgatatctgcgaggaaagtgatcttcaactgctccacacatatctgggtggtcagtaactcctgcttaaccttttcttaaaatgcttaatctatttacgaataaacaaatgtaactactataaatacaaactgatccccaagataattccttttttcattctttggctttgcagagggtccatgccgaacaacttttgcaaatctggtgcaggactacaaattacacttccagtatcagggcaaaatctagtcaaacttgctaaaggctttttggagcatttgatgttgatccgtcttattctgcataagatatccaatgcatcatctgcatgatcttgggtttgtgcttgtactattaattgctgactgcttatgcactgaattttcacccttcagaacggaaagggaatatcgctgttgctgaaggttttcaatctacccttttaacttaggagccaaacaaacaggatggg

SEQ ID NO: 87454 - DNA, 831 bp, Oryza sativa
  unsure (1)..(831): unsure at all n locations
cggcactgttgacaccttcgtataccnnncaattcnagctcggtacccctccatgcttaaactcggcagtctgataaggcaatgtacacaattcttccggattaatgaatatccattatctaaaaatgtacacaattcttatgatggatccttgttttgctggcagggtctgttgtctgatggcaccattattgctgtcaaacagctatcatcaaggtctaaacaagggaatcgagaatttgtgaatgagataggcatgatatctgcactccagcacccaaaccttgtcaagctttatggctgttgtacagaaggaaaccagctcttgcttgtttatgaatacatggaaaacaactgcctagcgcgtgctcttttcggtaatcttactttctaatttnctggtttcccctcttaacttatttcatgttagaactcatgtgcaatttctgtgattaggtacagtcgaacaatacaggctgagcctggattggccgacgagacgtaagatttgcctgggaatagcaaggggtttaacatatctacatgaggagtctgcaataaggatcgtgcacagagatatcaaggcttgcaatatactgcttgacacaacttgagtgccaagatcttcgtttttggcttgcaaagcttaacgatgatgatcacacacacttagttcaaggaatgctggggctatttaagtttctttttgatttcatcccccctttccccaaattaatttcaccggtcccaattcattgtttccattggaagttttaattacctgccgttgaacttaataaaaataccattcacactttttttgttttttgt

SEQ ID NO: 87455 - DNA, 790 bp, Oryza sativa
cataggccaattcgcataagcacaatcctattttcaaccagcgagagcaatcgatacccagagccccttgagccaaaatctgcaaatggcaccttggccaatacatttcaaattatcaaacatcacaaagtacaaaggtgatacagatccaaatgaatatttgagggtgtatgagacggcggtagaagcggccggaggagatgacacaacgaaagcaaaaatacttccaactatgctagaaggagtggcattgtcgtggtataccaccattccacctatgacaatctactcgtgggagcatatgagagatacttttcgagcaggtttcattggtgtatatgaagagccaaaagaagcagataacctatacgccatgaagcagatgccgggagaaaccttgagaagttttatggtaaaattttcaagaataaggtgtcagatcaggcaggtagatgaagaaatgctcatagcatcagcaaaaagagctttgttgcctggccctctccgtttcgatcttgcaaggaataggccaaagacagcaaaggacctatttgaaagaatggaaagttttgcaagaggagaagaagatgagctaagagtgcaagcagaagaggctgcattgttgggaaagaagcagacgaagaacaagcaagtttctttaggggaagaacaaaaagcagaaaacactgcaaaaccatggaaaaaaaattcaagaacgattacaagcaagatcagaaaaaacaagtaaacttcattggagatgactcaaataatggagaaggaaaaggga

SEQ ID NO: 87456 - DNA, 1726 bp, Oryza sativa
ttgattttctctccgaagcgtgcggagtgtttactcgatttgctatcgagtttgattttcctctccgaagtgtgcggaggattttctcgatttgctatcgagtttgatttttctctccgaagcgtgcggagtgtttactcgatttgctatcgagtttgattatcctctccgaagcgtgcggaggattttctcgatttgctatcgagtttgatttttctctccgaagcgtgcggagtgtttactcgattcacaaacacacaagacaagttttttatacaggttcgggcctccattatggataacaaccctacgtcctgtttatatgtattaacatcgagaagacaacagaattttacaaggtggtcggtgttgtacacttcgagcaacatgttttcctttttttttctcttctttttttttcttttcttattttttttcttttcttcttttttttcttttcttcttttttttacacatagaatttcttcaaggaaatagcattccaagtgtgctttaactcttctccatcgaggtgtgccagcttgtatgctcctgtttctaacttcctttttactatgaatggtccttcccatttcgattccaacttttcaacagccacttcattgagtgttttcttgaggaccaaatcaccttcttctatttgcctgattttcacttttttgttgtaatagcttttggttccttctgtgctttgtgccattttttctaatgcttccactcttatctcgtggagcatttccaaggtgatttcccttccttcctcgtctttttgatcaaacacaacttgaggtgaattcgctcccacctcgcttggtgtcattgcctcatctccatatactagcctgaatggagtcatgccagttgatcgaacaactgtcgttcttaaagcccaaaggactgacaacagatcttctggccattttcctttggtagaaccttccagccttttctttatagcttctactattttcccatttgctctttcaacggcgccatttgtttgagggtgacccacagaagcaaagttgatttgcaagttaagacctttgcacatatctttgaatttccctgactcgaattgttttccattatcacacactatctccttgggtattccaaatcggcatataatgttcttccaaacgaatttttgtaccgaagcagatgtgattcgtgctactgcctctgcttcaatccaccttgagaaatactcaattgccacaatgacaaaacgtaaatctccttttgctcttggtaaaggacctactatatctagtccccatctgtaaaatagccgaaccgggggaattggttgcaactctcttggtggtgcttttgacgttgcaccaaatttttggcatgccttacatgttttaatgtacttctctttgtccttgatgatcgtgggccaatatactccttgtcttatcaccttcgatgcaactgatcttggtgcttgatgggctccggacaacccttcatgtatttctaccaccattctcatcccttcttctcttgttacacattttagcaaaggggcagtgactccgctcttgtacagctgcccttctatcaccttgtacttccttgacattaactgtattcttcttgcttcttcttccttttctggaagttgttcactaaccagatacttcagaattggctctctccaatctatctcgccttgtatgtttgccacttctct

SEQ ID NO: 87457 - DNA, 511 bp, Oryza sativa
gctcggtacccttgcaaaaggcatatctggaaaaagtactaaagaaatacagtatacatgcgagtaagcctacacctgctcccatagtcaaggacgatagatttgggaaatttcaatgtcccaggaaccagtttgagatcgatcaaatgaaagttgttccacatgcttcggctatcggaagcttgcagtatgctgaagtatgtacgcgccctgacttagcttttgttactgggatacttggcagatatcaaggaaatccaggaatagatcactggagaatggtaaagaaagctttgcgttatgtgcaaggcacaaaaggcctcatactaacgtacagaagatctgattccctagagatagaagggtattcagatacagattttgcgagagatgtagatgatagaaagtccacatcaggctacatattcactctcgcaaaaggggctatttcgtggaaaagcttcaagcaaaccgtcatagcatatcatcgatgatgtatgccgagtttgta

SEQ ID NO: 87458 - DNA, 846 bp, Oryza sativa
cgcgtgatgatactacttattcggcgaattcgagctcggtaccccagaagtggagatgactttcggtctggtcttttcaagctctctaatctgtttgatcaaccgcttctcctcatccaagggtatgctctcatgagatatgcggtcgttcaatctcttgatctaataggacaaagcaatggagaaggcacaaacatgtaatcaaatattggactgaagaacagaaaaataaattatcataggttaaccgtactgccataccgatttctcaagctcttcaattgaagaacatatgcctgcaccctgtgcccggatagcattgttttcatcgcggaactttcctaaacggtttctaagaggttctatcgccttcaacttctcacttacggcttcgttgtattgcttgttctcagcagccaatggcttcagctctgagataataccgaagcgctcattctgcagattaagttccaaaatcagacatatcaccaaaatttcgtagtctgctcaaattggcaacatattctaggctctagcatcaatagcagatgacagtcgttttaaacaagttgtaaggaatataacttcttgctgatttaggataaaatttaaacaagcatgaccatatttatatgtactagaacttgtagaactaagaccataccttcttggcttttatagcctcaaaaatttgagaacgagctttgatcttcttctggaagtccttttcttgctgatcaatcttcaatttcagcttagggtccttaagtaagccgatactgacaaagaagaagctatgtgttttctagcttaggccagtcttctttgcttctttggggtgccaat

SEQ ID NO: 87459 - DNA, 599 bp, Oryza sativa
gattctgtggcttttcctttttcttgaacaatatattcgatcctacctcgcatcgtgtcaacggaggtagttggggcataaaagaaatccttgttcctgtaattaatgcatgttttaaatatgaacatttgtaccctgcatctgaacaccatgttatagaaaaatgtgccatgagctcagtacttaccacagccagattttgctttagacacaaaaaggtgtaggcttctatcaagtccaaacatcatgtcaggaagaagaactggatgcattggaatgggcaattggaaaaatgcatctaatgtttcaccaaccattcgaagcatcttcacacaagagggagcaatattctctctgttggcagctgaattccaagtctgcatgaaagacattgacagacttagtggaattttagaacaggaaaatcaagctaagttaattcaaacacaatatgtcaagaacaagttggactcatcattcaagaagaatattcaggacaattacatctcacaagttgactgagccaatctaacatttggtttacacatagcatgcatctggatgtgactcaactagctataattttttttccattctga

SEQ ID NO: 87460 - DNA, 837 bp, Oryza sativa
  unsure (1)..(837): unsure at all n locations
agtggggtaggactaactacttcnnnnccaaccgagctcggtacccattctctcctaaatgagttgcaggcttgtgttctacatgagcgaggaaatctcctggagctggtagatccagagttaggctccgattactcaacggaggaggcgctcctcatgctgaatgttgccctcctgtgcaccaatgcagcaccaacactgagaccaaagatgaccaaagttttgagcctggttgaggggcacataccacttcaaccatttctgtcagacctcagccttgctgcaaacagcctgagctcaagcggtcagcgcaggaacttctggcaaacactaagtgatcagagccaaagcatgactgcagcacaagcatcatccagcaacaccaatgagtcatcatctttagatattgctggtagcctgagaccttaggtgagtttaaatgtcagaactcaaaagtgtttcatgagctctgtacatgtaagaaccattaggagtaggtcattttgtctcttttagaggtacagtgtaaataccaaactagtgtcagatcctactattaagatggacactctgctttaaatctttaggaatagtgaattttatatatgggcagtgctttccaattattggatggacttagaacgtacaactagcattaaactgcttcatgggtattgtacactagatgcagcattctaaaagtcactgggtagacaatgtggctaaccgagaacccaaaggtggcacctgagtcgccttcggatttaaccaacaggtggtaacgtttcttcaaagacccacaccagttgttttccaacattttacacgaaaaccgga

SEQ ID NO: 87461 - DNA, 670 bp, Oryza sativa
attgattgcgccgtctggttttggcgtcttgtttgtcttgctcactttcttgggtggctctgctgtggcaggcgggctgggcgtatgctcgaccatgtcgaggctccgcttgtaacattgtactaccagcttagcgttcccttgaatagtgattgttcccttcagtcctgtcatcttgagcacttgatacgcatagtgagatgcggcaatgaacttcgcgagtgcagttctcccgatgatggcattgtatgctgtatcgaattcagcgacatcaaaggtgatttgttccgtttggaagttgtttgcttggctgaaagtcacaggcaacgtaattttacccaatggtttggacgatgactgaggagtgattccatggaagggttgatcggtgggcatcaactcgcttcgtaggatccccattgcgtccaaagtgctggcgaagagaatgttgattgagctgccgcagtcgatcaagactcatgcgatctttatattacgaatagtgggttcgaccatgatcggatatcgccctgggatgatagcagtcttggggtggttctcttctgagaattctatcttctgctcggaccacttcatcttgggcgcagccccctgccacgtcgaacagacttcacgttccgctttcttgtaatctcgctttgaggagtat

SEQ ID NO: 87462 - DNA, 873 bp, Oryza sativa
tgtttaacttaattcttctgcacttttttactgtcttcgatgcataatcatcatattcactgtcactgaatttatgtgcttcattttagcgacatggggaggagctaagttatctgatgtccttcagctcattggtgtgccatatcatactgaaattactccatcaggaggaaagcatgttgagttcactagtgtagatcagtgccctgtgagtttcttgagacttcatttatgaaaaaaaaaaatatatatatgacagctttagttattttttctataacatctttttcaaaatattattaggaggaaaaaggtggcccttacaaagcatcgatttctttaggccatgcaacaaatcctgcagcagatgtactggttgcatatgaaatgaatggtgaggtaggaccataggagataataataggttatatcttatataccatccttacatccatctatcaggatatttggttatttcatatatctgtgcatttttctaatcatatccctattatgtgtttttgttacaaaggtgctcaagcgtgatcatggataccctctccgtgtcgtagttccaggtgtgattggtgctcgttcagtcaaatggttggacagaattgacataattgaggaagagtgtcaggtatgcattatctaacttcttgtcaatatgtaaatatattttcagtttgccaaaaagatttttgaaactcgttcattttcagggtttctttatgcaaaaggattacaaaatgttccctccatctgttgattgggacaatattgtgtggtcaaccaggaagccccaaatggactacccagttcaggtgttaattcttaaccgtcttgtttccacacagtaagagcaagagc

SEQ ID NO: 87463 - DNA, 508 bp, Oryza sativa
ctggcgccggcgctggggttctgcaacgcctacggcacggggctcaccgacatgaacatggggtacaactacggcaagatcgcgctcttcatcttcgcggcgtgggccgggaaggacgacggcgtggtggccgggctcgtcgggtgcgggctggtgaagcagctggtgctcatctccgccgacctgatgcacgacttcaagacgggccacctgacgctgacctcgccgcggtcgatgctggtcgggcaggtggtgggcacgctgatggggtgcgtcgtcgcgccgctcaccttcttcctcttctacaaggcgttcgacgtcggcgaccccaacgggtactggaaggcgccgtacgcgctcatctaccggaacatggccatcatcagcgtggaggggttctcggcgctggcgaagcactgcctgcagctgtgcgcggggttcttcgcgttcgcggggcttgccaacctggcgcgggactttctggcgcgcaggtacgggccggacatgc

SEQ ID NO: 87464 - DNA, 1925 bp, Oryza sativa
ttcaacaacctcttcctgaactgatgtctattatacactcacgtgcaccatcctctaaatcagatgcagcctatttttggacctttagacttcagcacccaaactttcttcctcggtgaactacctcttccttgtacaacagattgattcttgctagacggtcatccttgccatgtgactgttttgcaaaattcaatcgacttacattaatagccgattgtattttctgataagtattacaatcactagtagaatgatcaaacaaattatgccacttacaaaacttggcatatttatgaatattttggttgtttatatagtactattttaacttggcaattctactagggaattatttttataattctatatatttagctcttctcttatgtcagttatattacctaatagatataattaaatattactaaataattcatataaagtctaaaagatgtaaactcgtgtttatgcttcaactcaattatattgaatgcacgtgttggaaacttagactataaaatcaatactcctcatcgaaaaatacatgtacgaggacaaacttgttattcatccctactagtttatccaatattcctcgtatttgccattcattcttcaattgccagtggccgataaaaactgccaatctataactgtatagttagaacacccactaaaacataatgtataccatactaaccaactatataggcgcatgcaaggataccaattacatctaaaactcaagatataagtatgctaaatctcattccacatatcattttcacatctcaactccatataccatttgtacaacatcatatagattcatgcatatatattccacagtaaagcgcgggatgttgtccattatatataaaaagttacaccacacttatttatttggaatgatcacaattaatcacaaacaacccaagcgagcacacacaattttgtctagtttcacaacaataaatatacatgatatagactagccaacggacgtctgctcattgaagaatgagtaacaagttcaaggatagacctcgatgattgacctgaagcccatgactggcatgatcttgtagctactaaatccagcttcaacgaaaagtttcttccactcctgttcatctcgctcaacgccattgacaaacatgatgagcgcgtcaaacaagatctgcacatctctgtgcttttggtcagatgggccaactccgaccactatatccatgattatcacctttccaccggcgtctctagatgggatggcttttttgcagttccgaagtatcttcacacagtcattgtcactccaatcatgcataatccactaaatatagaggaaacacatatatatgtatcaataaaatctgtatgtacatgtatacttctattgataggacactttaagaatattccaattttgataaatggtgaaatagggaatatttttagccataaacattagtgggaccaaactgtaatgtcttaaaataaaatttagagtcgatatcaattacaaattgctgattactattggactagtcatcaaccttaatttgcacccacaagggaaacatagttttgtaagataaatttagagaatttcagtgtagggatatatggaattaattgcggatatgtattttgagagtttagggatctagatgacacaccccttcatatatgtgtcaattagtgataaaataatttacaacaaattaaatgactgattaactccgtagatagaagagatagaaatatacatagatagcaactacatagaaaaaaagttggctaaagtccagttaaacatgtggttcgatatttttagacaaaaaaaccaaaatatacttgagagaatttcgagccaaaccaatctatgtaccttgaggaagacagcattggctgctggaata

SEQ ID NO: 87465 - DNA, 696 bp, Oryza sativa
atccaggtccttccttataaacttgtttttggacatgagtctattttgccatgggaagttagaatcggctctagaagaacggaattacaaaatgatttaacagccgatgagtattacaaccttatggctgatgagagggaagatctggttcagttacgattgcgagcccttgcaaacgttaccaaggataaagagcgtgttgctcggcattacaataagaaagtggtacccacagatttttcggaaggggaacttgtatggaagttgattttgccgattagaactcgggatagcaaattcggcaagtggtcgtcgaattgggaaggaccgtttcaaattgtgtctaaaggagcttacatgttgcaaggactcgatggagaagtttatggcagagcactaaatggtgaatacttgaagaaatattacccaagtgtttgggttaatgcatgattggctgatgttgccgatacataatagccgatgagttttcgtcatcttgagatggtcgatatagttatatcgcccttagttatttttccatattgtaatcggttgtggtttgccgatatacagccgatatacaatggctgatattattatatcgcccttagttgtttttataattttatcaatgcttttgacattgtaaaattaagggggcacatatgtacacaaaatgaaaatgaaaatttttta

SEQ ID NO: 87466 - DNA, 1450 bp, Oryza sativa
ccacgggggaaatcaaggccgacaacgccatcaaattcatcagagggatattctgcaggttcggattgccccaccgtatcataacagacaatggctcccagttcatcagtgccgatttccaggattactgcatcaggctgggagtcaagatctgcttcgcctcggtttctcaccctcaaagcaatggacaagtctagagggcaaacggcatagtactacaaggaatcaagacccgcgtctacgacaggctcatgtcacacgacaagaagtgggtcgaagaacttccatcagtactatgggccgtgcgtaccacaccgacaacttccaacaaggagacattcttcttcctcgtgtacggctcagaggccatgctccccaccgagctacgacatcaaagtacatgagtacagaagtacttcgatgaggatcaggaggagcagcgatacgacgatgtaaatctattcaaggaacattgcgaacgagttgccgtttgagcagccagctaccaacaagccctttgccgttaccacgagaagcgcatccgagcacgcacactttcgatcggcgactacgtcctccgacgggttcaaagccaagcagggcgcaacaagctctcacccaaatgggaaggaccgtacacgatcacacaagttctgcggccaggcgcattcaaaatcgcagacagcgatggtcgcgagttggcaaattcctggaacattgatcaattacgtaaattctatgtataagtcaatagtatccatacttgtaagacatcttacagcctcaataaagcctatttttcaggtatagactacaatcaaagtgttccttcccgatgatcccttacccagatgacacctagcgttgaaacctatcctcatgtccctttacgccgtcttgacaaggcctccgaggaacctaagggaacttcggctggggacgcccagagccgataaggtcttgtcggatcctgtagagacgaaagaccatgtaagatctggtcgtgtaagagttctcgccgtgtgtattaaccaagccgtgtaatcggaaataaactttccaacttcacggctgggggctaggatcagtgcttgttcaaccaaggcaggtcaaaggtccaagagccttatcttccgagaagaattctccgatgacaaggctgggggctagggagagtgtataactcaaacgactgatcaaagtcgcgaagtgagaagacactcatacacactacatccagagtaagaaagcttagttagatattccacaagtatttcttacaatcccatcaaaatccataactatattacacttttttcctaagacatttgacacaggacatgggaactaccaggaaggccaacgccaatccatcgactggaagaccttctccgtcagcggcgccatcgacttcgccaggccatctatctccacaggggttcaccgagaa

SEQ ID NO: 87467 - DNA, 1003 bp, Oryza sativa
ttcattgatggtagcaatcaaaagtaatgaagtcgcatagccatggaggcgaagaaaccagtcggcagcagacaagttagccaacagtgaagatgaaggcgtctagcaacatcgacaaaattgagcagccatggtggcgaaataatcagtcggtgacagatgaggcagccggtgaagaagatgaagatgcccattagtggcgacataataagccatccgtgaaggcgaagataccagtcggtggtgacgaaagcaagccgacggtgaagatatagacacgtatcaaaggcaatgacgaaatccatcaatcatgaagatgaagaaaatagttgacgacgacaaacgcaactgacatgatgaagatgacgatgtcggtgatctagccaatagcagtgtagcaaccaatgataatgacaaagacgctcatcagcatttgcatagtaggtcaaccgtgaaggtgaaataataagtcggcgaaaacataatcatccattagcaacagcggagatgtcagggccgatgaagcagaggtgctggtgatgatgtcagtgacaataatccatcaaattaatgttatagctgttgtagatgcttcacttggaggagagttgatgttgttgtccaactcgtccaaaccgaaatatttgaagttgttgaagtagaatgtctgctccgaatcaaagatgaagataatgactcctggagttgactcgttggttgattaattgatttcttcagcttgacataaaatttgtcaaattttgagccttgtatttgtgtagcccccgactctttggttagttgggaaacaactgaacatagagtcgagaattatagcttcttgtcgtcgagtagtcattgcttgattgaagatatgtgttgaagatgtccaagtagaaatcctgaatattggagagcctcttgttgtagtaaaataacatggcattcgcataccgagatgtcgaggcttacacagacgttatggttggtgaagtagcataac

SEQ ID NO: 87468 - DNA, 1939 bp, Oryza sativa
tgattgaaattcggggcttgaatgatatgtccaaagacatcaactccaaagcccacttagcaatccgtccgtttgcttcacggttgtgcagtatatcaccgagtggaaatgatgtgaccaccgttaccgagtgaccttgaaagtagtgagatagcttcctggtagtaattagaataccatataatagcttctgaacctgagggtacctcgttttggagtcggctaggacctcgctgacaaagtaaatcggtcgctggactttctggacatggccttcttcctcacgctcaacgaccaagactgtgctcacaacctgggaggtggctgatacatacagcaacaacggctcctgcgggtgtggtgaggctaagaccggtggctcggtgaggagtttcttaaaatcttcgaaggccttctgtgcttcgggtccccattgaaaatcatctgttttcttcagtagcttaaagaagggcatcccccgctcgccaagtcttgaaacaaatcggctgagcgccgccatgcatccagtcagcttctgaacatctttctgggtacttggcggtttcatgttgaggatagcagtaactttctccgggttggcttggatacccctatgagacaccataaaaccaagcagcttccctgacggtactccgaaggtgcacttttcagggtttaatttcatcctgaaagcgcggatgctcgcgaaggtttcttctagatccgagattaaatcatcattttgtttggtcttgacgactacatcatccacataggcttcaacgttgcggccgatctgcgttgagaagcatctctggatcatacgttgataagttactcctgcgttttttagtccgaacggcatggtgacatagcagtatgctccaaagggcgtgatgaatgaggtcttcaagcagtcggattccttcagtcggatctgatgataccccgagtaccaatccaaaaaactgagaagctcacagccggcggtcgagtcgactacctggtcaatgcgaggcaatccaaaaggatctttagggcaagacttgttgaggtcagtataatcaacacacatgcgccattgccccgttttcttccgaactagaaccgggtttgccagccagtcgggatgatggacttctttgatgaagcctgccgctaacagcttggttaattcctccttgatcgcgtccttcctgtcttgtgcgaatcggcggagtcgttgtttgataggcttggcatcttctttgacatgcaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggattagaaggatctaggggaatcttcttagtcttggcttcgctttctccactttttgaagtcttggtagcgggcacttctccttcgcttgccgtggctgcagccagtcggatatcctctcgggcagacgccatctcgcgggtttgggccatgtcgcaactctccttgtcgcatgtgacggcttgcttgatgtcgctccgtagggacaggactcctcggggaccaggcatcttcatcatcatgtaagtgtagtgcgggacggccatgaacttggctaacgccgggcgtccgagtatggcatggtatgctgtctcgaaatcggcgacttcaaagctgatattctctgtgcggaagttttcccgagtgccaaaagtgaccgggagggtgatctggccgagtggagttgcggataatcctggaattactccgtgaaaaggcgcattgcttggttttagctcggagcgaggaatctgcatatcatccaaggtcttggcgaagaggatattgagtgcactgccaccgtcgatgagggttctgcg

SEQ ID NO: 87469 - DNA, 1623 bp, Oryza sativa
tctaccaggctcaatgggcatgctttctatccaactccgctgcccttctgcaacttctccagtggcctgtgcaatccttttccacatcttttgtatttggtgtccaatctacctaccctagccaaggctttacattcttcatagcaccaagcaagaatttttcatccgcgttgccagtacaattcctgggactcctcaacagcgagaacaatggcgacatgaaaaaccaaatctttgcagtcgagtttgacagcataaaaaatattgagttccaagatatcaacaacaaccacgttgggtttgacatcaatagtctcatctctgtggactcataccctgctggtttctatgatgataaagatggtatcttcagtaatttgaccataactagtagtgaagcaatgcaagtttgggtggattacaatggagatatcgcacaaattagtgtcaccatggctcccatgggtatggcgaaaccattaaagccattaggatcagccaatcgtaacctctcatctgtacttagtgagatggcatatgttggcttttcatctgctgcaggcagggacaacactcggcattacattctcgggtggagttttggtctaaatagtgctgctccaagtattgatatcaccagtctgccgaagatgcctcattttgaacccaaggctagatcaaagatcctagaaatcattttaccaatagcaacggcagtgtccatcctttccgttggcaccatcattcttttacttgtacgaaggcacctaagatattcagaggtacgggaagattgggaagttgagtttgggccacatagattctcttttagggatttgtttcatgccacggaaggattcaaggacaagaatcttttaggcattggaggattcggaagagtatatagaggagtgcttccagcgtcaaaactagatatagcagtgaaaagagtgtcacatgattcaaagcagggcatgaaggaattcgttgcagaagttgtcagcataggccgcctccaacaccgtaacattgtgcatttacttggttattgtcgacgaaaaggtgaattatttttagtgtatgactacataccaaaaggaagccttgacaagtacttgtatggttaagaggacaagccgatccttacttgggctcaaaggttcctgatcatcaaaggaattacatctggattggtctatcttcatgaggagtgggagaaagttgtcattcatcgagatatcaaggcaagcaatgtgctccttgacgccgagatgaatgggagacttggtgactttggccttgcaaggttgtacgatcgtggtgtcgatgcacaaacaacccgtgtggtaggcaccataggatacatggctcctgaattggcatcaagcagcaaggcaacccctctcaccgatgtattttccttcggtatatttgttcttgaagtcacatgtgggaaaaggcccatcaaggaagatgtcaacggtaaccaaatcatgctggtggattgggtgctagagcattggcagaagggatcacttactgatacagtagacacgaagctccaaggtaactatgatgttgacgaggcaagcatggcactaaagctgggattgctgtgctccc

SEQ ID NO: 87470 - DNA, 693 bp, Oryza sativa
ctacccgtgcactgccacagggcgcaccacgtgacagcataccggacggggagggcgaagtggcaccaacgtggcgccacggtggcatccacattgggcggcaccggaaggccacgcgggcggcccggatagagactggggccgatccgacagcccagatcggccgcgcggcagggaagccgccagccggctgtctggcacaaccggcagcggcgcgcggcggcggcgactcggccggacgaccaccggcgacggcggcgcgtcacgagcaagcccgggaggcggccggtgaaggggttgaatgggggtgaggtaggggagggagtcctcaccgtgctcgtgtaacggcgagaaggcgacaggaaagcggcagcgggctcctcggggaggcacgacaacggcggtccagcggtgttccgcgagcgggaaacggcggccgacggtcggagggacctaagggagataatggagctattaggagagggaagggagttgcggcgcgatgagaaacgctggtcggagggggaggaaacgatggagcttacagacgtgcgaaggaaactgggttccggcgaggattggaggaggaggaggggtggccgggctgcggacgacggctgtggtgtcggggaaggagacgacggaatgcggggtcaactagggcggcgagaagcggcggtcggaggcggtaaa

SEQ ID NO: 87471 - DNA, 608 bp, Oryza sativa
acttcatataagatttgattgatgtttatgtaggcaacggcgagaagctggacttcgcggcgcgggcgcgcatcgcgctggcggtggcgcgcggcgtggcgttcatccaccgcggagggccaatctcatcgcacggcgacatcaagtcgtccaacgtcgtcgtcaccgcgacacgggacgccgcctacgtcaccgactacggcctggcccagctcgtcggcggcgcggcggcgccgccgactacgaagcggggcgcggggtaccgcgcgccggaggtggtcgacgcgcggcgcgtgtcgcagagcgccgacgtgtacagcttcggcgtgctgctgctcgagctgctcagcggccggccgccgctcgacgcgacgccggacggcggcgccgccgtcgacctgccgcggtggatgcggtcggtggtgcacgaggagtggacgtcggaggtgttcgacgccgccatcggcaacgaggcgcgcaccgagggggagatgatgcggctgctgcagctgggcatggagtgcaccgagcaccaccccgaccggcggccggccatggccgaggtggaggcgcggatcgagcccatcttcgaggacgcgtgccggaac

SEQ ID NO: 87472 - DNA, 700 bp, Oryza sativa
ctcggtaccctactttccataacattgagtgcattataatgagacatgctcaacaatgagttaagcgctattatgaaacatgtttatgcaaatacctttttttttctcgaaaacgagagaactgcatttcatttcatcaaggggaagaaaacaaaataaaaatatttacaaagtgtgcaaattacctttcaagcacacacttttgactaaggtgctaacaggtttgggctaatttgtgattgttaaagattgttaataattttacctaattaaacatccacatcagattgcataaaggatccgactaaaattgtagacagcaggatgaatgggaccagaattttgaaaaataaatcaagtactcagcatacctctaagatagtatttttgaattcggaacagacaacaattccatcaaaaactggaaggcaccgggtgtttcgataatcaaatccaaccatggctggggcaaaatcaattccaagtctctttgcgacctggaatattcttggtaacctcaggtgtacagtaccaggcggaagacatttctctgaccacacatcgacttgaccacgctcattcttggacatattttagcatttaatcagcatggaacaccacaaaataagcactgatagctacctaatgaaaatcaatagtcataatcaaggaggtctacctttggtacaataccatttac

SEQ ID NO: 87473 - DNA, 683 bp, Oryza sativa
tcgagctcggtaccctgtggactaaccgttgtctttgagctatatattttaagttaggttcacgtcatatgtgcgcatggatgattatcgatggattaaaattgacggcgcaaagtaaagggaaaaaagacggtaaaactagtgcttttgttttgaattaatcgaggtgtagggcgatcaaatttgctagtttatttttagtttcgacgtactattaagaggggtaatgatctagcaaagagatgattttaattgccacattaggtcattatgcatttagacttgtgctcacatttcacacaacacacactaacaccttgtattcactggttttcggcctgaccaagggcggtcagaccggccaccttgtggcggtctgaccggcggtccctggccggtctgaccggccccaagcgggcagtctgaccggcgcacaaggtcggtctgaccgacggcacttgtgcggtcagaccggccccctgaaggccgggatggtgttgctcggggtggccgatatagagccgacggagccgtattcggtcagaccaagttgagggcggtctgactggccaccccatgtcggtctgaccggccaggccgattgggccctctgacagggctacaacggctagttttctagccgttgcaaaatagcacgggctgaccggcctcatacctccggt

SEQ ID NO: 87474 - DNA, 1897 bp, Oryza sativa
ttaggccaatgcgtgataatggaactattataactcaggtgatcaaagtaaccaaagctggtcatataatgtggtaagatatgcttctgcccctttacaagatattgagatataccacgtttaggcggttaatgcatgacagtggaattataactcaagtggtcacagtaaaccaaagctggtcatataatgtggtaagatatgcttctgcccctttaggccttattcagtttgatggggattgaagaggatcggaggggattgagagggaataattccacatcacaataggtgtggaataaatcccctccattccccccacctagggatttaccgaacatgaccttacaaggtattgagtaaatatacctgttgctaaacttctcgatggcagtagatgcataaagaagtgtttcaccagccttctctaacgccatataaagttctcttcctcgggtaactttagcaatgacccatgcattatttttggctctgatgcatacttcaaaatccttgtcatgacaagagtcagacctcttggcccttgacttctccaaatctatttcttctcttagtctattcaaggaaagtagagaatcctgcatgatttcattgcagagcacggttaaaagaaatgcatggcaatccaattcaacacaaaaacgtaaaattgcaaccgaagaacaatagtgaggaagaaatgaacaggagatacgaattgatcatctaaaacatattagtctacaaaaacagaccaactttaacaatctttaggatctaaaatttatggagatattgaggtgaagagaagaacagaaccattaacacatattgtaggaaacatcgtatgttactctatatgcaagtatgcaacagaacaaacctttgagagggtggtgactttcccaggtggggaggctcttgatacttttctatctggatcaacaagtaagtagcgatatccaccaacatgataagcattttctcctccccatcctcgtgataatttcagctccagagtcacaatgttctgtgatgcctgcaatataaatataaaaaaatgagcatgtgttcacaaccacagtatcaatattttgcaagccacaccagacatgagaatatttcttattttcattcaacatggcctgcttgagctcagtaccgcatcaagaaatcatgaaaagggtggaaattatgcaagggccactcacattttcaagaagatgtctcttcacatgagcaatgccatcatctccatttattagagatgaagctggaatcagtagcagaatggttatgttcttgtgctgataaacacagagatgcatgcggtcttctgcctgctggaaccacagtatgggaacccaagccacagcaccacgaacttttgaagtagtggaaccagcggcaacaaaaccatcctttcctttgtatagtttctcacgctggagaggcctgaaataatgatgcatctgattttgtccgccaggagaagtatcacgagatcgactacgatacctttctactgaagctgttccatttgatgaactagaagtggggccagcatgaaccgaagttcctttccgcagataggaccaggaagttgcattggacaataaagcacgaggagttaacctcaagatagcataagtatataggtttagtgtatcatcctacaaagtggtaaaactacattaatcacatgggaactgctcaaagccatcaaagaaacaaagttataaaagaagtgatgattaaagggagaccccgtaccggtggaagtgttgtggacaccaagagatcttcaaataatacaagtgattggcacatgacatttccaagacatgacccaagaactgtggtgagtgactgcaaatattcatgcatcaatagttga

SEQ ID NO: 87475 - DNA, 801 bp, Oryza sativa
aatcaggatgaacctaggctttgtacaaaggcgctgccatctagttcttttgttgcaggccataatgagtataataacctttcacctgtcctgtcacaaaacaatactgaaggtagcatcaatacaactccaaaacaagtcaaagttcaaggctgcaggaaaagtttgtctaaaaaattgtcgaagtgcaaggcaaatcagagagatagctctgcatcactatcaaaagatagctcatccagcagccaatatccttccacctccagtaatgctgaagtaccaagacgaaaaggggatttggaatttgagttgcagctggaaatggctcttttagcatctgcagctaaaagtcaagacaacaagctagcaactcaattaaatcagtcaactgatagcttactaagttcaactccaccattgaagaagttacgaaaaagtgaagaagcctcaagcaactcgagcgtggtttggtcgaggaatagagcaccgttattttgggctgaggtattttgtggtggcgaggcatcgtctggaagatgggtccatgttgatgttgcaaatgatattattgatggtgaacaaaaagtagaagctgcttccgctgtttgcaggaagcctttgagatatgttgttgcctttgctggaaatggtgctaaagatgtgaccagaaggtttacctctttcataattcctaacttagtagctatatagaatcatgaggatatattctttgcttttggaaatttgtaaaagaactggtttgagaactgggttctatattttcctagggattgcctgcaa

SEQ ID NO: 87476 - DNA, 674 bp, Oryza sativa
tcgagctcggtacccatcgtgtcatcgtgtgtcttgtggttttactttgcagctgaaatctgttactatggtcttgtgcatatttttgacatgtgccttgtttatcatgtagagtgtcaagtgttgcgccatacccatcctcaaagagtccactagagagcagtgacaccattggcagtcccagcacaccgagcaatcatcgtgcacggacatcaccccttcgaccaacaactgcgaggactcactgtgcttaggtcagccaaggaacatcagcttcagcagccaggagccccccagcacaaagttacagatatgagacctggtgatcattgtataccgaagattcagctcagcgagagtcggctgaccttgatgccagatcggacgccttctttcgcatccgtgttagggtatgatgagacatagaagagatcactagatgctgtttctatcctggctgcaaaatctttctttggctagagctgtttataagtgctgatctagccacagccgccgccacttagtagtacgagagctgtgacattgcaggtaatttcaggctgttcttgattatttttgccctgagccatagcggcattggacttgagaggaaaagaaatgctgctgagttgtataggattacagattcggcgtatgtaattttgctgtttttt

SEQ ID NO: 87477 - DNA, 550 bp, Oryza sativa
atgtccaagctcctgttcgccagagttaaatacgctggaggattctgtgacttgtttccagttgacactgtgaactcatagtagggctgggagttgctagatcctgcaaatgcatagagcccatccgaatgaacagttaaataatacaggtcgctggcaatcagatttactgccaatgcgttaggcttcaatctcattccttgcaccaatctctgtccagggagcaaggaatccgttgggtggtcgaatgactgccagaccggtaagttgttgtgattatacagcaccaggttgccggactctgtgagggtcattcctgcaacagactggccggaagtgttggtagaccagacaaggctgccatccggatgctgaagaaccaggtccccctcagccgtgaagcttagggtggagttctgccggatcaactggtccctgttggccgaccatacatctgccacgggttctgggcgccaagaggtcatgtctgcaaattcaccggcgtcagtaacagtgtagactccaaagatgtaggtgttaaccagggggg

SEQ ID NO: 87478 - DNA, 744 bp, Oryza sativa
gagatacatagaaatggaaggattactcacgtcataacaactgttcttgtaggtctgccattagaagccccacccacatttatgcgaggtgtcataggcaaacctaagtcacttccaataacttctatcttcatagctttaccatcaagcagaacattattgtaacgtttcaatgcagcaattgcatcacttctcctagtaaacaccacttctgctgtgccctgcagaaatttaacaaaaaaagatattagcacaataatcgaggcaagaggcagttagcaaaagtttcagtgatcacaaaagttcatttatcattttctttttgcagaataagcaccgcaaatggacactgtttacatgctgttaatttgctaggccagctaattagtacataagattgtgtatatataaatttttttgaccagaaaacagagagggaggtccccacgctatatatagtacataattattacaacaaatacatgtattttgcaaatgtactctaagcagatcaccattttatggagtttcaaccagaaaagctcagcaaagttcaatgtgtgaaagaataagaaagacataatccctacatatatattactaaaaacaaacatttcctatgtttgtcttcttgctgttatctcaaacgcaagataatcactaagatacatattatcctattgttgttttattgttcttggtaaatctaatgcaaggcataaatctgtgcactggaagttttca

SEQ ID NO: 87479 - DNA, 4751 bp, Oryza sativa
aataatcgaggatttaggtgcactaatatgtgtacatatgtatatattagaaatatacttgtttttcgataaaaaagttgggtattcccgggaatacccgggaatcatggtagctccgcccatgaacccatgctactaactcagttgttacgtcaaccaaaatcaggagagatattgcctaaggatccaatatgatttggttttgcaagattagtaatgtgttatatatgttactcccttcgtttcacaatataagtcattttagcatttcccacattcatattgatgctaatgaatctagatttactccctccgtttcacaatgtaagttattctagcatttcctagatttatattgatgctaatgaatctagacatatatatctatctagattcattagtattaatatgaatgtggaaaatactaaaatgacttacattgtgaaacggaggaagaatttcggtttagcgatgattctaaaactaaacacttttccataagacgagggaccccgagtgaacattttccttagccgctcgcagggtccagctggggcgcgggagcgcgagacgcaagcccgcaacgctggcgtgctcgcgtgaactgggtcccgcaccgatttattgggtcgacgcacaaattggcatcgttttagctggcttcgttgtagatcctataataacgatacatcattaattcgatcatcccttggatgcggcctgcggcttacattaaatctcgatccaaagaagcaaagatgatgacagacagaaattaattaagctagaaatctcctcgatcgatcacacacacacacacaattaaggtacatacatacatgcactgctgcaactgcaactgcagggtcggtgcgtggctactacaagtgtacacatggtacgttggttggcaccatctcgatcgtgtcgttgtgctcacttgccggggacgaagttggtggcgtatgcccaggcgttgttggcgacggggtcggcgacgtggtcgaagaggttctcgatggggcccttgccggtgacgatggcctggacgaagaagccgaacatggagaacatggcgaggcggccgttcttgagctccttcaccttgagctcggcgaaggtgtcagggtcgtcggcgaggccgagcgggtcgaaggcgccgcctgggtacaccttgtcgaggccctcgccgagcgggccgccgccgacgcggtagccctcgacgaatcccatgagcaccacctggaccgcccagatggcgaggatgctctgcgcgtgcaccaggttggggttccccaggtagtcgagccccccctcggagaagatctgcgcgccggccttgaaccacaccgcctccccgaacttcaccccgttcttggacaggatctccgggaagacgcagcccagcgcccccagcatcgcccaccgcgagtggatcacctccagctccctgttcctcgcgaacgtctccgggtcggccgatagccccgccgtgtcccacccgtagtctcccgggaactctccggtcaggtacgatggcgtctgctccgagaacgggcccaggtacttgggacggtcaggtccatacctgcacatatatatacttgtatgttagcaattgcagtgtacatatatacagtacttatgtttgtatatacatgcatgtacgctacgtaccagatgctctggggcgcgctcttgacggtgcggcgcatggtgatgcggccaccggagtcgccgacgcggcggacgagctcatcccggcgaggggcggtgccgagaaagctggtggtctggtgcagcgccgacgcggccatcgttctaacgagggcgatgcggcggcggttgggttggttttttgtggtgtgtggtggagatgggcggcgcggaaggggagatctttatacggcgtacgagtggcggagcggtggactggtgaacgcgcggcgcgccacgtccgcgccacacaattggccgccgcgcccccgcgactggatatgggtatggcgcggaatctcctccccgtccactccaccaatccgctgatgccacctggacggaaagatctcgtctcctgcatccaacactatctgcacccaccaaccaactcacctagctagaagtagcttgctgctgaagtgctgatggtctaccggaaacaaaaaattgtacagctagctcagcatataaaaattaacttgttcatcagtgaattcacttggaaaaagttacttgttctttttgcaacacgatgaatcagactatcgccatagccaaagggtggcatttcttgcattcaaaatgatatgttaattacttcgtaggactaccttgccactaactatggtttgatgtgggcccactagtgacaaattggtgactgaaagacatgatgaaaactctttcaattaagacataatacatttttattaatggacgctagaaataacaaattgttacaaatacggtcttttctttttggaattaatatttttcatgtaatttatcatgttgtcaaacatgctatattttaagtcatatatattgagagaatttgctccatgtcactgagtttatcatagtttaacgatttgctatttgctattgacattatctttttttcataatataccagtgagtatatcaattgttctaaaatatgtcattaggctgattttttcttcaaaattaccaaaaatatccttacaaatgtacaaggttaacaataggtttatccatttagaagtttccaaaaaattatgaaacatttgtgtagtatctttacacaatataaaagtttctgtataggttttaaaatttctacattctgtttttcaaatataattcatccattatatgctatacataatactttcaaattgttgtttttaatgcaaataatatttcatatccaacacaaaatatttttaactacttttctaaaaacatgaaacttgtgcgcaaacttccaagttgtgtaaggaggctaaataaaaaatgatatattttttaaacttccaatgggataaatcaattcttaacattgtatgtgtataatagtgttttttttttctaaaaaaaaggcttagctcaatgacatattgtggaacaatgtcacatcacatttttcgtgttttctaatttgcttgatttgaaaattttacattcatatttattcgcctaaaatagcttaataaaaatttcataaatgaaaagggtttaatttgactaaataaattattaattatgccacacttttattttatcatttgttgattggagttatttgatttttatttgccttttggaagtggagctaaattcctaaaatctcataaaattgctaatccagaaaatttccccaacattcttaaaatgtccaaaattccaaatccttcaaatttagacttttctaaaaaaagttcctgttcttttctttttcctctctttctcctttttctttctttcttcgtcccgttgcctgctgtttatctgtcacgatatctcctcctatccctcgatctgtttctgctcatgggccagcatccaatgcccttcctatcccgtgaaggaataagttcactttgactcccttaaaagtgacctgaatctaattcatcaacctaaactacaaaaccggatatctcgaccaccgaactattgaaaccggtgcaatttgattccctaggcggttttattgacgtggcgcctatgtggcagtattgcccgggtcttctttacacgtggcgttaacgtggcgcttaagtggcattagaattaaaaaagtacgtgggaccaatttgtcaattacacaaaaaaaattgcgggacccactgacaggtagggcccacatgtcagtttatcccttcacccatctctctctgtctctcatttcgagcttgacacggcaaggctatcggcgccggcgccggctgcctcaatggcgtccactagagcaccctcgctgagctccgtcccgctgccatcatcaccagtcgcagtcccttgcgagcaagaaaaggagattggggagagagagagagagagagagagagagagtccctcaccgttgatggggtggctgagaaggcaatgggcgcgtgccgaagtggcggtggtggtggacggtggccggcgtatgggcgggcactggagcagcaccaggcgagggccacgatggcggcggcgggcttgagggcgggcgttggagtggcggcgacgacaggctggcgagggccgaacaactctccatggccacccctcttgtggacctcggtgtccgcgctgctcgatgccgccgccgctccaggtctaggggtgcccaccaccaccgttggtcgatcgcctcgccctttcgttcccctcagattcacttgccgtggtggcgccatatcgaagatggaagaggaggcgacgctgctagagaaacggagaagcctggatgccttgcgtcgccacctagctcttttcccctaccggctactgctcaccgccgctgccgagggaagtaaaggtgggagaaagagataaataagggagagaggaggaggacgaggggcggcatctctggagccacgccggttgcatttggggcagtgccgccactaccaatcgctctcgttggccgccaccgaaggggagagaaagagaaagaaagagagaagggaggaagaagggaggaagcagaaagagaggatgacatgtggggcccatatgtcagtggaccccacaaaatttatgtgtgtgaatga

SEQ ID NO: 87480 - DNA, 2129 bp, Oryza sativa
cgatcttttcgagcatgcggttgtgccgcacacccccctgaacgcgtagatcaccgcgtgtgcagggatgcatggtatggtgttgcggacttgacagaaccactgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgaccctgtcgtcacccccggcggcctcgatcccggtcgtgtagacctggagaaactcagcggggttgacgctcccgtcatatttttcggcgatggtgggccggaaccttgggggccaacggacgttccgaaggctcgccacaaaggctctacagccaacaccaccaaccgggggcacggagggctgatccccgcgtccgtgttgatgtgacactccggacgaggaggcgccctccgttgcgtgggcagcacgtcggccattacgccggcgctcgatactgatgcgggcatccggccccccacgcagatcttcctgggtcggaggcgctgacgaaggagtggcggccgaatggcgagcaaccaccgccgctcgccgcgccctccgccttgacgacacggagccggtggtagcagctccagaggtcttggtggcggaggactgcccaccagcacctaggcgctgccgtgccgtcatgaccaagttggccacgtcgtccagccaacattgggctggagactccgggtcagggacaacgggcgggtgacgtaggagcgcgcccgcagcttggagtgcgccctggggcgtgctgccgtcgccatagacgaggaggcgacgctccccatctcggcgccctcctccatcacccgtggatgtcgaagtcgcggatccttcgaccctctcgagcgcctcctcccgcctaggactttggcgtggagggggcggtggagtacgagctcgacggcgtgggtttggctccccgtcgtcaccgctaacactcggagagaggttgtgcgcctttgcttgttcagccattgggttgaacaggaaaagcttggcgcacacgaaagagtgcgagagcttagaagaacacacgcagaaccccctacctggcgcgccagatgacggagcgtggggctcctcaccgggagaccgcgcaggcccccctttgccggttcggccgggggccctgggtgagattctaagctctcggtgtgtggaaggttcgcgagaatggaaacacacaagacacgggcgatgtatacaggttcgggccgctgagaagcgtaataccctactcctgtgttttggtggatctatgtatgaagaagctacaaaagagctggagaaccagagagctcttactctctccctctctgatcgttctggatcccttccaaacaaaatctcccccttctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctccggctagggacgagtgcttggaggctctcatcctgacgggatggggcgaggcgtgcgtcagaccgcctgtcgtcacctaacccacgatctgatcggtctgtgactggtcacagaccggataaacgagtgcgctgcactgcgttacatgcggcgtgacgcgctcgtccaaaccgcaataaatgtggttaggtgagccccgctatgctcacctaccccatatacgcggcgcaaaacccacaagggg

SEQ ID NO: 87481 - DNA, 3857 bp, Oryza sativa
caacactgactgcgcacgaggccgcctgtgccgaagaggagtccgcgctccgcctccgcgaggacgcgctcaccgagcgggagcgagctctcgaggaggccgaggccgcggcgcaacggctggcggacggtctgtccctccgcgaggcagcgtgggaggagcaggcgcgccgtaatctggaaggtgcccgcgccgagagggccacgctgaactagcgggccgctgagctcgaggcgcgggagaaggagctggacgcgagggcgcgcagcggcggggcggccgcgggcgaaagcgacttaaccgcccgcctcacagctgccgaacacaccatcgccgatctgcagggcgcgctagactcgtccgccggggaggtcgaggccctccgcttggcaggcgaggtagggcccggcatgcttcgggacgccgtctcccgtctagactgcgccggccggcaggcgggcctctggggcgggcggactgcgaagtatgccgccaaccaggggggcctcgcccagcgcctctcggagatagccgggactctccaacggctccccgaggagctcgagaggacgattaagtcatcctcgagggacctcgcccgaggagtggtggagctcgtactggcgagttaccaagccagggatcccgacttctccccatggacggcgctggacgagttccctcccgggaccgaggacggtgcgcgcgcgcaggtccgggacgccgccgaccatatcgtccacagcttcgagggttcggcccctcggctcgcgttcgccctcaactccgacgaggaggacgatgacggcggagtgggcgacagtggcgacgaggctggcggcccgggtgcattggagtgagcccccaggcccccgccaatctttaaatagtttcttcttttcttcttccgaggccttcgggcccccttcttgtatagactaatttaatctgcaatcaaataaagaggaaattttttgtgtcaattctatttgttgtgtgtatgagacgaggatgtctgtgccacggtccttttgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgtcgattcccccccggagttcaccacgccccggggcacggctcggttctgggccccgtttggcgattttagccgacccgagcccccgagggcaggattgaacacgagtgacctatttcaagtcaagatccttcaaaaggaaacaacagcacagatacagcctttaggaaatcgaaaatgcttttattgaaatacagatataagagaaataagaatatgcatatgtggtagcccccggccaaccctgcacgcccgaggggggtgcggggttggcccgagcccgaaacctgacacccgatccccctttaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacatggcgctgatggtagcgccacaggctctgctggtagcgcgcggctcggagggccgcgcgccgccttcgctcttccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggcgtggttcggttcgcccagagcaccgctggcaactcctcgatccacgaatcgccgtgcttcttgaggatgttgaaggtcttggttttaaggcctctgaggatttccgcattggcgcgctccacttggccgttgcttctggggtgggcaggtgaggcgaagcaaagcttgatgcccatgtcttcgcagtaatcgccgaaaagttcactagtgaattgggtgccgttatccgtaataatacggttaggcactccaaaccgggctgtgatgcccttaatgaatttaagtgcggagtgcttatcgatcttgacgaccggataagcctcgggccacttagtgaacttgtcgatcgtgacatacagatactcaaacccgcccggggcccgcctaaaaggtcccaggatatcgagcccccagacagcaaatggccatgaaagtggtatgatctgcagggcctgggccggctgatggatttgcttggcgtggaattgacatgctctgcatcgccagaccaggtcgaccgcatcattgagagctgtcggccaatagaaaccttgtcgaaaggctttgccaaccaaggtgcgcgaggcggagtggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatgcaaccggtgacgcattgcacatccctaagcttgctgggggggcgcatccgctctatagctcgtatcttctcggggttggccttgatgcctcgggcaaagaccaaaatcccgagaagcttgcccgcaggtacaccgaacacgcacttatcggggttcagttttatgcgggcggagcggagactctcaaaagtttccgctagatccgagagtaaggtctcttggttgcgcgtctttacaaccaagtcatcgacatgagcctcaacattacgtcctatttggctacccaaagaaattcgagtagtacgttgaaaagtaggacctgcattctttaacccaaagggcattgtcgtataacaataagttcctatgggggtaatgaatgcagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctgccgccgtactttctgccggaccggccttgcgcccgaccgcacggcgagacggtgctcaatcacctccctggggaccccaggcatatccgccggtctccatgcgaagacgtcagcgtttgcccgcaggaaagagacgagcgcgtcttcctatttgtcgtccagaagaccaccgatccgtgtggtcttggacgggccgtcgcccagggcaacctccttgaccgggacctcgtcgcatgtgactatccgctgcctcggggcggcggaggcggaggtgccaagcctctcgtcgcctccctcgggcttggacgcggcggtgaggtggtccgcgcgctgctccatacaagcaagcgcgactttaaggtcgccatggacaaagatggggcccccggggcccggcatcttcatctggaggtaggcgtaatggaccgccgccatgaacttcaccaacgcgggcctccccaggaccgcgttgtagggcagactgaggtccgccacatcgaagttcacccg

SEQ ID NO: 87482 - DNA, 830 bp, Oryza sativa
tctagaggatcccctcttcagtccctttagtactatcggccatcgtttgaaacctctaacataaaagaaaaagttatccctcacattttaaattactcaaattagtacaaacaactttaaattgcgaaattaattactacttactattatgctagtatagatatgttattaattagtacttactattatgctaaattaattagtacagacaaaattaaattgcaaaattaattactacttactattaagctaaattaattagtacaaacaaatttgtacaaaatttgaaaagttattatcaagtagtgcactaattcacaattacatttcctcgacatgttgtttaacaaaaaattaaaaaggcaaacatatcctccacaatttttttaaaaatatgttaacataacctcctacatgttatttaaaaaatttgacaaattcacatatcctgcaaaattgaacataccctcccaattccattcacatatcacccacattcccaaattcacattcacaatcacatataacccctcattcacatatcacccacccctcattcccaatcacactgacggagcgtggggctcctcaccgggagaccacgcaggcccccctttgccggttcggccgggggccctgggtgagattctaagctctcggtgtgtggaaggttcgcgagaatggaaacacacaagacacgggcgatgtatacaggttcgggccgctgagaagcgtaataccctactcctgtgttttggtggatctatgtatgaagaagctacaaaagagctggagaaccagagagctcttactctctccctctctgatcg

SEQ ID NO: 87483 - DNA, 578 bp, Oryza sativa
tatgagaatgtcccaactgttgttttgaccgtcatctttaggccttaatcaaacgggtcgcatctctgcattttgccccatgggctatcgcctgaatatataggggctagccaatggggtcatcgtacattcttgagggcccgtttgaattggaggaaaaacatatgaattttagaggattttaatcttataggaaaatttcctatgaagccctttaaaacaaaagattggatcctatctaatcctttaaaattcctatggaatggacaatcctatagagattttggaggaaatttagcaagagcttcaacctcttgataaatttcccttgagtctatctctctcattcaattcctacgtttttcctgcggttcaatcaaacggccattcctgtatttttcctgcgttttgcaatcctctgttttacacttatatttctattaaaatcctacattttttctattcctacgttttctcaatcctgcgaatgaaaggggcctgaactgtgtcattctttggagtcttgtttcacaactttgggcggcatgcaataggctgtaggctttagtcacaagtag

SEQ ID NO: 87484 - DNA, 707 bp, Oryza sativa
tcaacctcgctatggcagaaagaaggaagaagacaggagaaagaaggaagaaggtggaaaaggaaggaaattgacggaaaccgtgacgacagtggcatggttctaattttgtaaaatttcagtggcacggttacggatagactgagttgttgacgatcttgagttgtgcatctgccatccagccaaggctggtaagctgctcaatggtaagatcctcgaggcctgcgcagcggctatagaaggcttcaacgatgagtatcttggtctcgctttcatcggcatcacgtcttaccttgtgcaacttttcttggagcttgtcggtgcgctccttgatgaagccatccagatccatcgtcttcttgtatctgtctagctgtggcatggccttgaagcgctcaagaaccctcgtcgcctcctgcaccgacagccaaacctctgttgcttgcacctcgccctcaccatacaccatgaggcatgtatccacactacatagtgtcgacaactcgcttgccttcttcttctagcccttgagccgcttcttgaatgccgcccgccacttcgcatcattgatgatccgctgcaacttcaccttgttgcgagccatggccttcacgattcaccactttctagcaagactgcacctatggattgatgggaaatggttagattgatatgagttcaaagaaaggggaatatggtggttttat

SEQ ID NO: 87485 - DNA, 624 bp, Oryza sativa
ttctctgaaagaaaaagaacaatcaaaggtgtttgaggttctagtaagattttttgtacgggaaaaatattcaagaaataatcacggatggcctcaattgttccaagcaaatttatcatttatgccatgtggtgatcgctgcagagaagaggatgacgagtacttgtcattgctgtgatgttgtgttgccaggtttacacacacatttgcttctgatacaagtatcaccgaggaaaaagaaaatcaaacctccatactcatcaatttgaccagatcagttgttgagtactccaactccttttctttttttagaccagagcttcttaagcatgtgctttctcgtttctcctttctacctgcttgctgctgctgcatgagagttgagatagtaataattatggagtcctagcagtaattaacttaaccaatgggtctttttttaaaaaaaacaactgggctgttttggtcattccattttacgttacggcctgaccgcaatgtggtccatcagtggacgaaagctggtggtaaaccaccagccacttttatattgcactcctacctcacttttgacggtgatagtacgtactactcctatatcaatacatattactgacatgtggg

SEQ ID NO: 87486 - DNA, 1048 bp, Oryza sativa
cgtcgcctcatgagtaggggccgcggccagaagctctcgcttcatggccttgaggctccggcgagaaacgtgagcacacactcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctccctcctctcctcctcccacttcctcgtccgctcagccaaacttttgactgcgcggcagtccgcgaggtcgtgaagggaggtgttgtggacgatgcaccacttgccggttgggcgctccccactgggagcgccggcctccttctttttgtcgctcgcaggcctcccctttcgggtggcccgcgaagcgccctcgacggcgaggacatgaccctcgtcgtcggaatgggctgacctcttcttcctcctcctgtcacgccgccctgtccgagcagcagatccgggggcggccgaagctgccacaccggaaccggaggggttccaggtccatgcctcttccttacgagccactcggtccgcgagctgaaaaagctccgcggtagtctggggctctttggaggcgatcttttcgagcatgcggttgtgccgcacacccccctgaacgcgtagatcaccgcgtgtgcagggatgcatggtatggtgttgcggacttgacagaaccactgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgaccctgtcgtcacccccggcggcctcgatcccggtcgtgtagacctggagaaactcagcggggttgacgctcccgtcatatttttcggcgatggtgggccggaaccttg

SEQ ID NO: 87487 - DNA, 2202 bp, Oryza sativa
ttaccgacaactctggaattcttccgacttcttctactatactctcttcctattctagtatacaatatagtacaatagagcctcttataattcactcaagcttggaggtgtgtgttgaagtgagtgagatgatgtccttatataggggtaggtatgatagttggcgaaggggaaatgtccgatgttccccgcaaccgccatcagggagtgatttgggacatccatgccaaaacctgggatcaacgatgatcaccagggttcggccgaacctgggctgggcccccctggcctggcctttggcctggctcatcctctgatcctcctctatccattcttcggtgttttgggctgattttctggtgtttctacgaagttcacaacccatccttgtatggatacatatttctcctcactttagtctagatttcctcccaacatcggggtttatcacctgcatacaaatatacaccaacactgtgtaatatgtgagaataagcacctatcactatgttggatgttttattatccgaattttatacaggtgttggcggtatagaatcgacatttaacagccgccaacatggagtatcacgttgctgcattgctccgtcagcgtgaccacctccgttgttgtgagcggtctcttgttgttgagtatgtccttgagataacgggagtatgttggcacttacatagcgtccaacaatggcacgttgatgtggatcttctggataacttcaacaaaacgagcgagctgctcgtccactgacggtttcctactccgttggggaaacgacagcaaccgtgtgtcgcagtgctcctgcggcatggtcttctctggctgaacctctttgtcagccgagtcactagatgacgcttcttttgatatcccattagttcctgcagggttaggatatggcggatcacgagtggacttacctccccatgtcgtgatcgccttaacattttcaacggaggagtcgggttgccccggaatcctcccagtttcatttgtagagaccaaggatgctaactgagctagctgggtctctatcattttattgaagctcagctggttttggaaagcagaagcgaagccatctaacttaacatttatattatctaggatcttgtcattggcagcaagctttttgcttagcgcatcagtggttttagcttgcgcaaaaacgagatccttcaaggagggctggttagaaaagttaccgttgttgttacctccttgataatatgggtgtggttggttccacccctgacctccttgtggacggtacgcgttgttgcccatgtacatcgcctcctcacgggtttccgggcagtcattcccagagtgactgtaacgccccgattttcggtcgggattaaaaatcattaaataatgcatttttctagaaatttaataaaagttaaatcaatttaatcaagtgaattactgagggaattaaaaatttccttttaaaaatcattggccgggaatattttgtaatattctttgtgccttaaaatactctccggttttttctgtgaattttcggagctcaagaaataattttaaagtcacaaagttcattttatcaattaaaataaaaagaaaagcaataaaatttcctcctctttgtttttgggccgcccggcccaatccccctcctcctctccttggcccgctcgcctctctctccctccctcctccctctcgggccgacccctcccttctcggcccaatcgttttcccctcgcgtaaagtctaaataaccccctgggcttccccctctctccctccccgacaggtgggcccggtggccccacctgtcaggtcctcctcctaccttcggcttctcaggccgaagccgccatggccggcggttgccgcccatgtcccgccaaatccggcgccctcccgctcgcgtcctcgcgcccaaaccaagtaaaatcggtccccctccatgtcctccaccatctcccccactttcccccaaaaaaacggcgccggtttgacctccccacgagctccacgtcgcctcccatttcgacgccggttgccgcccatcccggcctgagccactccctcccgagcctataaaatcactcccccggccatcctctcccttttccccaactttcccgcactccccgcgctctctcccgctctccccacgcgagcccaagcgccgccgatcgccggcg

SEQ ID NO: 87488 - DNA, 731 bp, Oryza sativa
agctgcccgtcaacttctcctggatcgtctcgtctaatcttgtatcgtagtgctttgcaaacagggcatgcttctaggttctcttactcctcaccgcgatataggatacaatcattcggacatgcgtgaatcttctgaacttccagtcctagagggcagactatcttcttagcctcgtacgttgtctcgggcaatttgtttccctctggaagaatgttcttgacgagtttcaataaatcgccaaatgccttgtcactaaccccattttttgccttccattgcaagaactccagagtggtatccaactttttgggcccctgctcgcaacctgggtacaacgacgttctatggtcctttaacatcttgtccaatttatgggcccccttttcactttcgcagtcctccttggcgtcctgcaacatctgaccaagatcatccgcaacgtcgttaccatcagcatccctttcctcctcacctgtttgatttccttcaaatccaatgtactgagcaaagtccggaatattgtcgtcttccacttcatcttctttcatttcaacaccttgctctccgttggatgtccaacaattatagcttggcatgaaccccgactcaaacaagtggaaatgaatagtcctggatgcagaatactccttctaattcttacacttattgcatggacaacaaataaaacccttttgcctgttagcttcggccactctcaaaaaataatg

SEQ ID NO: 87489 - DNA, 791 bp, Oryza sativa
atctattcctgcagccccgatcgcaggttttctcgaagattcgagaagctccgtgaagaccttgagctaggaaagtcacctttgatcatcttgcacctataatttaaatctaagtatttcttttgcgcaaatattgcatgaataggtttaacacaagtatttcggccgcggcttgcgagatagcctgccggccccaatcctaattgctgcaattaccctccttgaattattgaacacttagacctcctttgtcgactgttgtgcttcgatgcatgggccttcgggctcgagcatcggaacacttcccttcaaatttaaaatatccaacgatgggtaaaacttggggttttacaaaagaattggaaaacccgacacctgggtcggtgcttgcaaactaaatgaatttccaaaaccgcggaccggaggacgttccaggagtacggtttcccgctcttgcacttaaggaccgtttccttggaatttcatccaaacataagataagtacaaccacatgggtggaataggacacccctagctgagtaattagctaatcgggggagccatgatgccaagagacatgtggattcaacggggtggtgccggggagaacccccgggcttcctggcacagtatggtctgggacctaacctattgtcggtctgggacccctctcgttggcatatggagaacctgtgtcggcttttgaaatgccttgtcgtgaaagccccaagtcaccaaacgtgtctgatcacaccggctaggtgaccaaggctagtaatatatgtgggtaa

SEQ ID NO: 87490 - DNA, 693 bp, Oryza sativa
cttaatagcagcggcaaggtaaaggtaacacgattggtaagagtacattttgccattggttcttatcatgattcaatcaactgtgatgttgtgcctatgcaagcatgttctatgttattaggtaggccatggcagtttgataaagattctttacactttggcaaatccaatcaatactcctttgtgcataatggaaaaaaacttgtgttacatcctatgtctcctgaagttattttaaaggatgaacttgctagagctagcaaacaaaaaaatcaggaacgtactaggagtgagcatcttattgcggctaatgaacttgagaagcataagaagaaacccaccaactctgttcaaaataataaaaatgagattaagctgaagggatcttgtttcattgcaacaaaatcagatttggatgaagttgacactgacactgttgtttgctatgctttggtttgcaaagaaaccttatttccaattgaggatactcctatttctttgcctcctccggtcactaaccttttgcaggagtatgctgatattttcccaaaggaggttctaccggggctgcccccaattcgagggattgagcaccaaattgacctcattcctggggcctctctaccaaaccgtgcgccatacaggaccaacccggaggaaacaaaggagattcagcgtcaagtgcaagagtta

SEQ ID NO: 87491 - DNA, 2332 bp, Oryza sativa
tttgggagttaccctattggaaattcttggacgtcccccacgcaatcgacgtgatgcacctcactaagaacctttgcataaaccttcttggcttcctaggtgtatacggaaagtcgaaagatacactggaagcacgtaatgatctgaagcatatggaacaacgcggcgaccttcacccagaaccaaaggagaaaggaatccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacatgttgatgacacaactgctaccagttgtaataaggggtatctttccagacaatgtccgggcaacaataacaaagctatgtgcattcatgaacgcaatttcgcagaaggtcatcgatccggatagattagaagcccttcagaatgatgtggtgcaatgtctcgtcagttttgagttgatatttccaccttcatttttcaatataatgacgcatctgctttgtcatcttgtcaaagagatcagtattctcgggcctgtgtacctacaccaacatgttttctttcgagaggtacatgggcgttctgaagaagtatgttcgtaaccgtgctcgtctagaggcaagcatcgccaagggttatggaacagaggaggtcatcgaattttgcgtagaatttattgaagaacttcgcccaatcgaggtacctgaatcacgccataaagggagactatggggaaagggaactctcggaaggaaaggaataatgacggtagacaacaatttattccgtaaagcccatttcacggttctgcaacaatcttcattagtagctccttacatcaaggaacacttggctctagttcgcgccaggaacatcggtaagtccgatgcatggattacatggcatcacattgatactttccccgcgtggctacgacaacatctcatgggtaacgagtcgatcaaccaacaacttgccttcctggcgaggggaccgtctgggtcgatcgtgacattccaaggatatgagatcaatgggtacacattctacccgagagcccaagacatgaagagcacgaaccaaaacagcgttgttcgtgtcgatgccatgggacacgatggaacaactggcacgtattacggtgccatcgaggacatatgggaacttgactatggtcctctcaaggtccctctgttccggtgccaatgggttaggttgactggtggaggcgtaatgattgatgacagtgggatgacaacggttgaccttaacaaggttggatactcggatgaaccttttgtccttgccaatgatgtaacgcaagtcttttacgtgaaggacatatctagcaaaggaaagaagggcagagggcctgacgagcctaagcgtcacgtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgtagcgatcacaaggagggaacaatagtgaggagaaagtacgtgcggtcaaccgtcaccgccaatgtattgccgtaattattgtgtacacgatgtaaactattttggatgtattgattatccatataaatcaattgttgtatggcatatgttaattacgcacgattattagaggttttaacaattttaaatcatgtatatgctagttatatgcgataattacaatttttaaaagttttaaatcacgcaggtggcatttacatatgttaattagagtttttaacaattaatttactatcattcatatgctaattatatatgactattcgaatttttaaaagttttaaatcatgcatgtggcatttacatatgttaattagtgtttttaataattaatttactatcattcatatgctaattatatatgattattacaatttttattaattttacatcatgccgtatgtatatacatatgttaattagagtttttaacaatttaatatcattcatatgctaagtatatatgattattagaatttttattaattttaaatcatatgtttgcttattacgttttatccacttaatttattacagacaacaataaattttcgaagtaattgtcattaatttttgtactttaaataattttaatgcattattttctattttagaaacacatatgtaatggaaattaatattcagtgcgctt

SEQ ID NO: 87492 - DNA, 2490 bp, Oryza sativa
ttgtttggttagtgactaaggttgccacgcctaaggttaggcgtttgccgctagtgtggcgaatgatttgctcgccgcgtctttgaccagaaaaccaatggcaaatcaactacgttgtggcaatttttttgtggcagccaaaaatctggacaccaaacaaacggtaggctaagcaagtgtggcatgcctaatatgaggattagctggttgaggcaaccatccaaacagcccttaagtcctctaagtgctagaattcgattcggccacatgctacattgctaacttcaaatggccgccagatttgcatacgagctccgttttcagcccatgagtacttgatggaaagatctcggagtactctttcaaacggatccagcctcatcactaaattccatctaagtcatctgcaattgatgaaacaaggtgttgcatcacctatagtgggtctatggggtaacttcgtttgggaccccggcccaagtggggcccatgtgtggtgcgccccaaccaggtggagcacgaccctagggaccatttggtcgtcctcccacctccttaaatagctatgtactccttcagggtttctcggattttgtttagattaaagtttagcttcactactttgccgtgtaatcctgtgataggttatatcgccagtttcctcattatggaaccccaacttatcatttgtatgtaattcctatttgcaatttagattgcttttatgttgttcttgcttgtttcttcgatttgtttgtaggaataagattgatctacaccagcaagatcaacaacccacagagaggtgtatcgatctctaaggcgcaacacaacaacgtctcgtacagttgtagttgggtcgcaacgtttctcccaaatgcattaaagatcgtcccactgaccagcactaaccccgataaattcgtcaagatcggggcgacgttgggcagcaaataggaactcgagctcatcaccttcctccgcgacaatgcagacgtgttttcttggcagtcgtcagacatgccgaaagttcccagggaggtgattgagtacaaactcatggtgcgacctgatgccaagccagttaaacaaaaactgcggagatttaaacctaatcgaaaacaagccatacgagaagagctccacaagctcctcaaagctggcttcatcagagaggttctccatctagagtggctggtgttggtattacttaacgtcatagatagaatgcgcaagtggcatggaagataccgatgtagcacttcacccgggagtattccaaggtatcgatttccacagtgaacgtgtttgctcagttcttctccatgttcatcgaaggacacaaagcaaagataggcaaagggcagagaagatttcctagtgagaaaaggtgtctacagaaagctcagtttaatcctaacgcgatacttcgggcactggcagcctgctgctcccagatatggctctactgcatacccggatagagaggacttcagtgtgattgaggactgtcaccgcctctacacccacctgaaacctactgtgggttacaaagcaatcatcggaaaattaactacctagacaccgcgtctacacaattaataactactctattgccggccaaacactaaagtaatcactataaattaatggacgatagtgaacaatgattcagcatgctaattatgaactaaccaagaataattctcactaagcaaatcttaattacttagaataatatttctattgaagcagagtaattaacaaagtataagaataaggagaggattaccgacaactccggaattcctccgacttcttctagtttactctctccctaattataagtatactatagaacatataaagaacctaaagtatacttagagcctcttgtaattcagctctacatcttggtgtgtgttgaaatgaaggaggtgagggggtatttataggtcgaggtgccttgggagtgtggagatcctccatggactcctaagggcgtattcatcctctccttgccatgtgtccatttgaatgatggttggagcgccggaaacagccacaaccgtcatcaggaaagaagttgctatcgaactcaacttgggcctaggccaacggcctctgtcaaggttcggtcgaacttagggttctgccaaacactgaccagctccgttggccccggttttcggtctagacactaattttgggccctttattctattggtatggatgtttggctcatttggaagtgtttaatttggtttttgggtccaaaactttataagttagggtacggtttgattctcctcctccttcatgtatatttcttctcagcttaggtagtttgtcacctacatacgaatatactccaacactcgtgaaaattgttagaaataaactctaccactatgttggatgttttatatttatggtcttacgcaggtattaacggcgttaatttggcacttaacagccgtcaatagctgg

SEQ ID NO: 87493 - DNA, 2603 bp, Oryza sativa
tgttttcttctacactagaatgcctttcgggttgattagcgtaggcaacacgtatcagcgcgagatccaaggagctctcggtgaccaaatcggatggaacgtcgagacatacatcgacgatgttgtcgtcaagacaaagacgggcgacacactgattaatgacctcagggaaacattcaacaatctccgacgacatcggctcaagctgaatcccgagaagtgcgtgtttggagtaccatcggggaagctacttggttttctcgtctccggacaaggcatcgaagcgaaccccgagaagatcaaggccaccgagaatatgaagtcatccacaagactcaaggaaatccagagactaaccggatgcatggcagcactaagccgcttcgtagccaggatgggagaataaggacaacctttctttgatttactcaaaaagcaagacaaattcgagtagactcaggaggtcgagaacatgttcgtcgcgctcaaatgctacttgtcaaatccctatactcattgccccacaacatgatgaagagcttttcatatatataactgccactccttattctatgagtacggttatcgtcgtcgagagggaaacaatacaacacctggtgtatgttcacggtcgttatcgatcagtttcgaccgtcaatattaccaaaatagaggagaactagtgatgcttgcaatgcatatatctgttagaataataatattccactagtattaggtttactaaccttttgcagagaatgaccataaagtggaggagaatcgacatcaacacggacgataaatcaatcggacgatgtcgagaatcagacttatgtatgaatgggccaagaacacagaattgacatgacaaaccgggccaaaattcacaagtctacataaaggagcaatagaggagactgccagccgaaaggtgggctggttgggccagcccctggttcagccgaaccaggaggttcggccgaacctccctcgcctccgttggatccaggttttggctggatggttgagatgaagccctaacgacggttggagggtattaccgaccaatccaaccgtcacaaccgtcatagtttagctataaaaggagctcctcttctcacttcacacacacacctcaagcaagagctctctcatttctctcaagtttagtttagtagtatctagctggtggaataggaatagagtagaaatcaggagtccggaatccttcggaagagttcgggtatggctctagtagtttttctcttctcttttgtaagctttgtacttttattagaatactcttctatatacatttatggattgaaatactttccgagtatatgagtacctgctttacattatgttcatgttatactgaatatgttgctagcttatctagtagatgctttggtgcgagtataatgtttgcttatgcaattactctatgtcatgacgatgatattagagtagtatctggtagtttaggtgtggtgtctagattacgggatatcattatttggggttatatgctgcggatgagaggtgggccgctgatggtgacagcttagtacgggtattcctccgcgcctgtatataatcctaagttaattccctagggagggtattcctccgtatttagcccggttgtatggtcatgacggactgtcgtaaggagctcggcagtctggggtgtcttctcgaagtaccaggagggcatcggatagagggtattagctagtatatcagttaactagaatgtatgtatactatgtatattagaagtataggaatagattatctttctcttttctttccatttagcttagataatatattatgagaatgagtagctcatgcttgtgtgtcactctacccttggattatcttacccctgcttaaaatataattatcacaagtaatatataaactattagtcaagttctctctacatgatcttcccacgggataaaataaatacgatactcttggaatactctcgggtgaaatgctacaatggtacatccgtgcgcttgcggattaactctgtaaccataatatactagaagtatttctgcgctattgctaggaattatatttctagtaatggcgcttccttggctatcccattggtccctgcagggttaggatatggcggatcacgagtggacttacctcccctcgtcgtgatcaccttaacatttttaacggaggagtcgggttgccctggaatcctccccgattcatttgcaaggactaatgaagccaattgagctagccgggtttctatcattttgttgaagctcagctagttttggaaagcagaagcaaagccatctaacttaacatttatgttctgtaggatcttgtcattggtagttagctttttgcttaatgcatcagtagttttagcttgcacaaaaacgagatccttcaagtagggttggttagaaaagttaccattattattacctccttgatagtacgggcgtggctggttccacccctaacctccttgtggacggtacccgttattgttgttgcccatatacatcgcctcctcacgggtttccgggcagtcattccaagaatgacccgtgttg

SEQ ID NO: 87494 - DNA, 640 bp, Oryza sativa
agaaacatgtggcttttgaacctggtgatttggtttggttgcatttgagaaaggataggttccctaatttgagaaaatctaagttgctacctagagctgatggtcctttcaaagtgctacaaaagattatgacaatgcatacaagcttgagctacctgccgattttggggttagccccacgtttaacattgcagatttaaagccatatttgggagaagaagatgagttagagtcgaggatgactcaaatgcaagaaggggaggatgatgaggacatcccttccaacgatacaaccacgcctattgcacagcaaggaccaatgactagagctcgagctcgtgaacttaattatcaggaatatgggagaggaaccaaatcgcaagcagcactagcagcgctgatttgatgaagtcaatgctcttcactccggagggcaaacggggcaaatgagtacttgttggaaagatctcgtcgtctactttcagctatgtgtggcctcaccatcaactttgacccaggctgctcagaatgacgaaaatagttctttacatcagaaacttgggcttgggccttgtatcattacagccatcattacagcccattaggggtccacaaaacctagggtttgctcccacctcct

SEQ ID NO: 87495 - DNA, 529 bp, Oryza sativa
gcattaatttcagctagttcagcttccagttctccaagctttatctgttattcaaaagtgttaaaataatactagatttatattctgcatgcaatcaggaaaaatccattcgattgacacacctccaaatcatcaaagtccaacgaaatttcagttaattgtgcagaagttgatatgccagctttggacatttgttctttgaaaaatcttaatttgcgagccatttcaccacacctttttatctgcacaacgagtagatcccagcatgaaaacagggaaaattaacataaggcagtaaggtaatgaaaactatgaacatgagatatactatatagatagaaatccatatagcaccctaaactttaaaaagtccaaataccatcctaaactttagatagaaatatgaacagttttacaaagttcagggggttagatgtccggttttaaagtttagtgtactagatggactttcattcaaagtttagggggggatatttggactttttcctcatttataccaatgtcacat

SEQ ID NO: 87496 - DNA, 693 bp, Oryza sativa
accccaggatcactttccacttcctcgaatagaccaattggtggattcaacagccggttgcgagttattgagcttcctcgacgcttactctagctatcaccaaatcagcatggcaaaagaggacgaagagaagacagcattcatcatgccgttcggggtattttgctatgttaagatgccgttcggactgataacagctggggatactttccagcgcacggtccagggtgcacttagcaaccagcttggcaacaatgtcgaggcttatgtcgacgacatcgttgtcaaaaccaagacaggcgactcattgattgacgatctgcgggaaacgttcgacaacctccgacgatatcgcctcatgctcaatcctgagaagtgcacgttcggagtaccatcgggcaagctgctcggattccttgtctctggcagaggaatagaagcaaaccccgagaagatcaaggcaatcgagaatatgaagtcgcctacaagactcaaggaggtacaaaagctaaccagatgcatggcagcactaagcagattcatcgctaggatggcttaccacagtacatcttttaaattgctaactgtatgtttcgtgaaaaacttcttatatgctccttccgttttatattatttgtcggtctagcaaatctcactcaaaccaaggagaaatggcagattacatgggtaccc

SEQ ID NO: 87497 - DNA, 1000 bp, Oryza sativa
acatatgcttcttatagagcacacacttcatgataaacatgcaggggtcttcgagctagtgggccgagaaaagcaggaattgtgagtgggctagccgacataggtttaaggcctcacattttatatttatttgatattatatctttcataatattagagtttttagcacggacttcattgggaaattgtaaaaagtacgaattacccccctgaaccacaaaaccggacattcttcacccccaactatgcaaaccggatgaattaccccccctgacccaatccgcggtggttttggtctacgtggtgtacgcgtggcggtccagtcagtattttatttattaaaaaaatataggacccacctatcatactcctataccactattcccatctctctcttctttctctctcttcctctctctcttttctcactctctatctcacacgcgcacggtggcaggcgggggagcggcggcggtggcggcggcggggtgcggcggaggaggcaaggcgagcggcggcagcggaggaggaggcaaggcggcagcggcgagcggcgggggatgaagcagcgaacggcggcggggtgcggcggagggggcgaggcgaggctgcggcgacagcggaggaggcgaggggcggcgggagctcacactgctcgaggcgaggcgaggtgagcggcaacggggtgcggcggaggaggtgagcgtgacggtggaggaggcgagcgcggcagtggaggaggcgaggcggcggcggcagttggccggggggggcggtgacagacgacgacgcgcggcgcgggcggggctagagtggagatggcgacggcgcgcgggcggcggggttgagatgccgcggacagggcaaccgacacccttcgttgttttttatagtgatacctaagtcatactcccaccttttagtcatgatatcaactcatgcttgagattcttgtcctatatataagaagagagaaattttaagattctctctttgttac

SEQ ID NO: 87498 - DNA, 1732 bp, Oryza sativa
atactcaagcttcgctcactcacttgcagtgtcagtgttgctgattaagctatccaagggtatatatattattagattgttaattgattaagaaatggaagggctgataccattggtgtacaaggccatagtggagtacaggaacaaggcaagcagcaggcaggtcactctgagaagcttcttcttcgtcaccgtcgtcgacgaccagctgcacggcggcgactccggccggtggtgctacgcgccgtcgccgccggcgagtgccgcccaccagctggtgtcgccgctgctgcgatcggcgccgcgtcgccaccgtgcaggttgattaaatttaggtggtcaaatgctcaatcaacaagaggttagttagcctgcatatcatatcatatcatatcatgatcatcatagtgcgtataaataagatcaataacatggaagattgaacttagaatcattcttcctgatatatattcaatgaaatttcgtactgtctaagtgccggtttgtttcgtttttttttttaaaaaaaaagaaataacatggaagaatgcatgtgaggtgtgcatggtccagatctccaaagggagtagtagcaccagccacctgcaggagcaaagcaagcttcagaatctgcatgatccagtgtgtgtttgtgtgtgctggaacagcactagctagcttaattagagtgatggaatgaacatgatgctttggtggtatattgcacatatgtacaaaggaataaggatgtgcttgtactgtgtaaattgatctagcaaatttgtgcatgatgtcatatatactgtgaataaatgaaatgtttatgtatctggactctgggattcttccatttcttaaaagagcatttcaagatcctctgttcttttgaaagaaaaaaaatgattatattacatttttattatgcagaggacgaggtttaattaatccttcgttatactacctctatttttaaatatatagtgttgtgttgacattttgatacgatgtttggttattcatatagcttattttattattaaaagcactttaagcattcagtttttcatgcttgtactaaatttttaagtaagataaatgatcaaacatcgtgttcaaagaatctcatatattttaaaaaaggaaggagtatactccatccaggtaaaaataactctttttgaattttttatttgaggcgaaactttcaaagtttgactatcaacatatccttttatatccttttagtttgaaaacataaaagatatagacttacaagtattttcgtaatctcataagattattagattttatgagtttattccaaaaaagtcatgattaaatttgcacctaaaaatagtaaaagaaaactaacgtcatttaattatttttgaacgcagagaatatactttatatggagagcaataggttgtgttgagctaaataattaatgataaagctaacttttttacagaaaatgatcgagctaagttgattagaagggtaattttatcatcctttagaaagtgcagggaaataccatattttaaagtataaaatttcatacctttacgtgctaggtatctcgaggtaccaaatcttttagtgtaaaatttaggtatctcatgtattttcttaagtactgtaaaatttctaattagaaagtctgatttgtgattcaaatggacctctgcaaaactctggagtattttcttaaggagcgatatcaaaacgg

SEQ ID NO: 87499 - DNA, 3696 bp, Oryza sativa
aaatagtttcttgttgatggcaaacgatcaatgtgtagcaaatgatccgattttttattattccatggtctcgaactgaaaaaaaaaagtagttcgattttacttgactaaattgctgttcacgttgggctggttctatgcacatactctctgctcctgacactaaatgtcgatttcttgtaggattcagagatgacggcgagatgcaaatttgtcaggcaatgtgattaagtagatatgcatcctggttggtcacaaggtgttatgctcacgcctcgatatggttcttgcgtagccacagaaaggagcagctactatgtgcttactccagccactggagttgtatacaacttgcctgtgaatccagcagaggagcatgtgtaccatgtccagttgatcacctgcacagaccttaccctcatttgcatttgggcatgttgcttccatgggagagtacaaggtgatccatatttacagacctagagctacatcagctctgtgagttcattactgtcaagtgtggcactcaccatgcagacctatgttgaaacacaggcaaacatcaatgttatctcttattgggtggtgtacttgatggatattggattgtgtatatgagctatgataatatgtggtgtaggtaccttcatccatcagtatttcatctgttgtttcaatcttgggatggagcaagaaacgggatgtccagggaccaattagcagcattttattttattttatctttttgagaaagcgattttcctgaggagtatatgtcaattggcatcaacagtttcactgaactgaaaggctacttagttttagtataccaccagcattactgttgaaccatggattaaagagtatacattcagtctggatcattcatccctgttattgagtaggatataaagccaataagccattgttggcgttagatgatgggaggatattcttctgtctaggatggactggattgctaagcatacctgatgagacattttgcacttttccaagaaccagcactttgcagaagtggagatgagacatcttgctggaaatagcacacagcaaaacagatgactttacaaaatggtgatgtagtgcagtattgcaatgtattgctactcccttcagtttgcagttgatgaaatttgcaagaaccatccattgcttttggaattgatcgttgggcagaatcataaattttggctgtgattcttttctactgttgaattgaagcctgcaaagatgtcttcgattcttgaagatgatagttttttttctctttcattttgtactatcttctgagattgtaatataaggtgtacttgtcagcatatatcatagtatctgacataatttagggctgctgcaactttgttttgcagtaaaaaggtgacagattgccagtgccacttgtgttgtaggtgaaattcgctgtgcatgtaaaaggatgcggtttgaatgcttatcatataatctctgttactgttatctagatataatgcacaagctctttgagctcatatattattcaatgagggttgaaatgctcttgtgtattgtgatgaatgatgaggagccttttgttgtatttgtatgtcagtctcagtcaacaactctgtaacaaggctgcatgcctatatgcattgctcagcccgccgtcaattcttgaaaatgaatgctgaataaacctgaaggatccaaacatggagagttacttatattcaagtcaaacagcaacctgttgtgctaccaggacactgatttgataatctgattgttttacttcagaagataatcaacagaaaaaggggaaaaagagttacagtatcagaataatgttacattgaattcaatgagcaagcccagggtaatgttacttgcattgaattcaacaaatcagcagtaatgtcaactgaaccacatgttttgcatacatttaattacattcaattgaaccaatcaagaataatctcagatttgcataataagataagtacactttgtcaataattacaacccatcagagcacagaactcataaacacctcaattctgagctaccgagtatcattaaatctatttctaccaaggcggacaaagcttttcataatacagtttgtccataaatacaagcatcagagcacatctcgcttctgatctacagatattatcatcaactaaatctcttcctacaaaggactaagctaatcagcctacagatcaaactgaattctctacataataacatcagcaaatctctctcttgcttcaggaggctaatcagccggcggatcaaagtctaagaggtcgtccatggagaactccatatccaagcagctcgggtcggccattgtgaagttgatgctgtttagaacctcatcaatggtctctgggaactcgaaatcagacaatgccggcgcctcactgtcgatgatgccctgtgaggagtatttttggttgtccagcgacggcgcaggcgctgcactacaagcatcggcttctgcttcctctgctggtagggtaatcaggtcttcaaggtgactaaacaccatggaagaatcatccatcacgttggaagagcactgatctgcgccgtcagcatcaccggcaacatcgagcagagggtactctgggaactcgaaatcagacaaggagtagttctgatagtctagtgacatagtcccagccggcgcatcaggacgatcagcttcttcttcttctggcaggacgatcgggtctgacagatgagtaaacaccgcagaagaatcatgcatcacaacggagcatccctgatcagggccttcagagctatcggcaacttcaaccagagcagccagaggaggaacaagcactggctgtggctgcggaacgaactcctcgagcagatcagactctattccagtgctctggggctcatggaggtcgcccatggagagctcaatgtccaagcagctggggtcagttgtggtgaagtcgatgcagttaggcaactcatccatgttgatctctgggaactcaaaatcagcccaggagtagtccatcgacgccagcgctgcaccaccggcggcatcaccttcttctgcgggcagggtgatcatgtccggaagatgactgaacaccattgtggaatcgtccatcacgccggagcatccctgattggcacagtcagcatcatcgacagcgtccaccagcgctgcgggaggggaaatcgacacggtctgtggcggtggaacgacctcgtcgagcagagcaacccctgttccggtgatctggggcgcggtctgtggcggcaggacgcactcctcgagtagagcagactctgttccagcgctctgtggcgcggctcgtcctcgaacgtcctcagtgccgacgtccagggcatcctctgttccggcgataggagggatgggaacgggctgtggcggcgggatgcgctcctcgaccagggcatcctctgttccgacgctctggggcgccggctgtggcggcatgacgcgctcctcgagcagagcagtctctgttccagcgctctgtggcgccgcgcgtgctcgaccgacaccgtcctcgccggattgtggctctctcttgcgcttcttgccgtggccgctgaaccggacgcggtagagccggatcggcgacgcggcgagctcggcgggggacgtgacggcgtactcatgcatcacccagc

SEQ ID NO: 87500 - DNA, 828 bp, Oryza sativa
tcgagctcggtacccattctcttctttgttagctgcccgtcaacttctcctggatcgtcccgtcgaatcttgtatcgttttgctttgcaaacagggcatgcttctagggtctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtactcctttggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgag

SEQ ID NO: 87501 - DNA, 633 bp, Oryza sativa
atgaagagtgatcacaccgatgctctcctcacattcccgtgcgcgtgctctgaacacacagcttgcactgtaacgaaccccaagggcgatctcagtgtcacggagtacatcggcaagatgaaaacgctagctgacgagatgtcatccgccggcaagcccctcgatgacgagaagatgatgtcgtacatcctcgccggactcgacgacgattatgagcccgtcgtctccactcttgtcggcaaggcgaaggctgtaccagtcgccgaaatctacacccagctcctgagttttgagagccgagccaagctgcgacagcaggctaatggttcctccgtcaacagcgcacgacgaggaggcaagggaggcggcggcggcttcagcaacaacgtcaacaccggcaacaccagcacgtttcgcggccgtggcggtggtcgcggcgatcgcggaggccgggggcgaggaaacggtggcggcgcgcgcttctccaacaaaccgcgccccacctgtcagctatgtggcaagattggacatgtggtggcagactgctggtacaggtatgatgaaaatttcattccagattcaaaaacagcagctgcggcttcctatggtgtagatacaaattggtacatggac

SEQ ID NO: 87502 - DNA, 719 bp, Oryza sativa
  unsure (1)..(719): unsure at all n locations
acgatacgcagtctannnnnnnnnnnnnnnnnnnnnnnnnnnnnnnnnnnnnnnnnnnnnnnnnnnnnnnnnnnnntttatgcgaaaacttttatatagaaatcgttttaaaatatcaaataaatgtatttttaaaaagtttgtaataattaaaatccgattaatcatgcactaattgtgttttggtgtatctggaatatttgtccttcaacagacactagaaagttacggcacctcacaaaagggaaaatggagttagaaaaggaaaaggttagatgagtattcaaatagtctgaagttcaaaaccaagactttccataatacttttacagaaacaatgacaaatgttactgaagcggaaacatgacactcaataaacagtaagctggcatcccatttcccatccaaggaagcaagaaatgtaagaaattggaatttataagccccagctagccagctttaaagtctcaaacaggtaaataatcagtgcaggtaatcagagaagcagggatataactcaaaactatgttgaacagagcccgagagaatgcatgacaatgttgagtacacaatggcaatgtttttttctttctctggatgacttgccacataagaatttttcggcagtacatgcaacagttttgcagcctacaacagtaagaatgcttgacatccatccttaaacagtaaacactatcatatcgacctctgaatcttgg

SEQ ID NO: 87503 - DNA, 664 bp, Oryza sativa
atattatttgctgatgatgaaacatactacctcaaggcgtctctcatataggaaagtggcacggtttgagaagaacgtcaccaagaggttctgttcctgagacagtcaagaaaggaaatgattatcctgttggacccattgtgcttggatttttcgtctttgtggttgctggttcatgtaagctacattctttgtttatatatttgtggtgaatggttgagctatttatcttcactcatactcttcataactcagaatgcctttaccaacctaaatagattttaactattttgacccttagttcttgtttttatgggtattgcttctgagctctctgcaggactaaactgtgctaaattgcgaaagtgctaatctagtactattatcagttgtcgtgtatgggggtagctgaagtacacatcattagttctgctttaagatgttatcactttgtgggaaagtatctatgtgtgttctgttttgatcttaagatactcaaatccttttcaaagaataagaaactcgattcctgctcttgatgagtccaaaaatagactcatggtttactccacaaattgttgttaactggtggcagtaccacacccatggacattagctactaatctcgtgacacgcgataaaaccttatatgcttataaacttc

SEQ ID NO: 87504 - DNA, 562 bp, Oryza sativa
ctccgtgaagaaggtgtaccgcgggttcgaccaggaggaagggatcgaggtggcgtggaaccgcgtgcggctgcgcgcgctcgccgaccgcgacccggccatggtggagcgcctccacgccgaggtgcgcatcatccgctccctccaccacgagcacatcatcggcttccacaaggtctggctcgaccgcgacgccggcgtgctcaacttcatcaccgaggtctgcacctccggcagcctccgcgagtaccgcgtccgccaccgccacgtctccgtcaaggcgctcaagaagtgggcgcgccagatcctcctcggactcgaccacctccacacccacgacccatgcatcatccaccgcgacctcaactgcagcaacgtcttcatcaacggcaacaccggccaggttcccccccacccctcattactgcatccagtttcttcccagattagcagatttgacaagctcacctatcccaaaaatttagggctagaattaattacaatcaaaatcatgataacgttcgatctgttagactatattaggagcaaagcaatagcttaa

SEQ ID NO: 87505 - DNA, 594 bp, Oryza sativa
atgggtccatggctactacaggttgcccacagtattgctatctgctagccgaggcgaaagttgttgcaggtcgtctgccgcaacgggaggtatgagctgaaacccagccgcgacccctccaggtcaaactccagcaggttgtcctccatcatgtgcccgccgatcaccaccgatgacggatacagcgcggggccgccgtccaccacgccaaggcagagcgcgccgcccttggcgggcaccatcgagtttgccccgtacatgatccacgacacggcctccctctgcagcaccagctcaatcgtcggcaccgctggccccgcgcgggtgctccctactttgcgcccgtcgtagcacagctcgaacggtgccacggccggcacacgggggatcgtggccgtctcggccgcgaacgcgtcgatgaccgccttgtagatggaggtctccagcacggtgtaaggagacgccgtgctcagcgtggtgccggctacgccattcttgtcgattgccaagagcgtcgcgttcagtggcacgtcgcggccgttcaccttgatgcccgtcaagccgatgaggtactcgatcgacgtcttccccgtt

SEQ ID NO: 87506 - DNA, 1871 bp, Oryza sativa
agatccgatcctggtgatcttcagccccggttggtgctaccaaccgggactaaagtcccacccctatagatatgtcttcttccttctccagctgcctgagcaagcttcaaaatttcttcaaaaaagaggggaggtcatgccaaaatttttattgaatttattttggtgattacatacaaatcggaggtgcctaaaaggtttgcaacttcatcgtccaatgttttttttgtcatactacatttgcacctatgttttgcacacttttttttctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattgtttaaaactttacaaatagtatttaagaattatttagtgtaatattttatgatttttgtatgaataaagatatcttataattattgtatgactgtcattattgtaagaataattatttgtgtacggttttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactatttatttccacttgtttgagtcggggttcatgccaagctataattgttggacatcccacggagagcaaggtgttgaaatggaagaagatgaagtggaagacgacaatattccggactttgctcagtatgatggatttgaagaaaatcaaacgggcgaggaggaaatagctgctgatggtaacgacattgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttcttgcaatggaaggcaaaaaatggggttagtgccaaggcatttggcgatttattgaaactcgtcaagaacattcttccggggggaaacaaattgcccgagacaacgtacgaggctaagatagtctgcccgttaggactggaagttcataagattcacgcatgtccgaacgattgtatcctatatcgcggtgaggagtatgagaacctagaagcatgccctgtttgcaaagcactacgatacaagattagacgagacgatccaggagaagttgatgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacacccagccgatggttcgcagtggcgaaacatcgacagaaaatttaaagaatttggaaaggatgcacgaaacatacggtttggtttgagtacggatggcatgaatccttttggagagatgagtagcggccatagcacttggcccgttacgttgtgtatctacaacgtcccccctggctatgcatgaagaggaagtacataatgatgccgattattattcaaggccccaagcaacctggtaacgacatcgatgtgtacctaagaccactggtcgaagatcttaaacagttgtggaagaaggaaggtgtccccgtgtgggacgaggacaaacaggaggagttt

SEQ ID NO: 87507 - DNA, 918 bp, Oryza sativa
attcatcgaccctcggaaagtaaacgtcgcaatgctcgaccaatatccacaagaaacagaggcaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaagaatttatcgcggcggttcaagaacaactcatgggattcatcaacgaagaaatccttgatcccaagggtgaattctactacgacggaaacacaattcaccggtccttagcttctgagct

SEQ ID NO: 87508 - DNA, 985 bp, Oryza sativa
ataggggataaaggatccccttgcctaagtcctttgtaagtttgaaaacaattaccaatttgatcgttaacttttataccaacatgaccaccttgaacaaaagaagctatccattcacaccatctaggagaaaagcctttcattctcaaagtttgttgtacaaaaggccatttaactttatcataagctttctcaaaatcaatcttaaaaattacaccacttttatctttgcgatgtaattcatgtaaagtctcatgtaaaataaccaccccttccataatatttctcccaggaataaacgcagtttgagtaggactaattaccttttgagcgacatccattattctatttgtagcaactttggtaaaaatcttaaagctaacattaagtaggcatataggtctatactgttgaatctttaaagcctcagcatacttaggcaaaagaatgatagttccaaagttaagcgaatataaaggcaaactcccagaatgaaagtccttaaataactctaaaaggtcaaatttaatgacattccagaaaacttggtaaaactcagcaggaaatccatctgggcccggagctttgttatgttccatttggaaaatagcatccttaacctcattttcagaaaattccttagttaaggcttcattctctaaatatgaaacttgaggaatgtcagcaacataattctcatcaaactgaaggttatactcatcaggagggccaaaaagacctttataataagtggtaatatgcgactttaaattggcatcaccacttattaaatgatcactctcctgtaattgataaattctagttttcctatgttttccatttgccactaaatgaaaatactttgtattagagtcaccctctaaaatatccttagtcttagcccgctgataccatttaatttcttttctcttagaatgacagataacctactcctgaaaaaccatctaatatcaacttcctcttg

SEQ ID NO: 87509 - DNA, 3740 bp, Oryza sativa
gcccccgacgccgaggacccgcagcggcaggtctgagatgagatctatcttcttttaccgcttccttggattttaggattcttgtgttagactgtagcggcattcccaaccataagctaagctaacgtagattttttttccactccaaattatccaatcttatttggaatccatctaaccgtttagtttcttgattccatcatcacacaatgcttagttaggacttcgatgcatcggttggtagtttggagcattccaaaattttagttaccaaagcagttgatttgcaaccactgggatgctgcgagaatacccttcatggtagccttttttttttcttttgtttctgcagggattaaaatcgaggtattgcgataaatgctgcatgtacaaaccttctcgaactcaccattgcaaggtgtgcaaaaggtgtgttcttaaaatggtaagtgtggctaatgtttgtcggtataggttctgttggttgcaaaatgaagcttttgttagaaatacttggtaacaagttttaattataattgcaggaccatcactgtgtctggattaacaactgcgtgggctatgcaaactacaaatcatttatcatctgtgttctaaatgcaaccatcgggtctctttactcatttgtaagtgatatcagttggaataaaatttgggaaattcttcgccaagcatcattcacggtcattccatttttctccaggtggtatttctatttgatctcttccagacagaacatgaatacgatgttccttatgtgaaggtcatacatgtaagtgcactggcctttcttctgaattaatatttcactatacagtcaggaattctccaccctgctactgcgctgcataaataatgagtatatgtttactcttatttttagttatcaaccattactaacctttggcacacagcacactacattgtttttcccactgtgttgtcttaagagtcaataagaaattttttgaggaatccctgtttgttgtatcatgccagaagtagatagtttgttttagatctcttatgagttttgagtttggatttcaactcaattgaaagtgcttattatgtatttactgcagaaacatcaaagacatgatagatgggaataatccaaaattgcagataaaactcatggaataataatgaaaactgtgggttttcctttctgctggtctaacaagggagtttatagttaaaataatgattttgaattttaaaagatggaattcttggagaccttgcaataacgtggtggaatatttggctagaacgaaacagaaggattttctgtcactcttcacaaaacgagaaccaggtggcctccttaatcaaggaaaatataagccaaattaatttgtccagatgttaaatgttgttgttctttaagttgcttgtatcctgaggtttttgcctagttgacaagcctctccgttcgaccgctagacggtctctgcgtttctgtttatgtattctgaccttttattccctctaatatattcggcaagtcttttgccgcttttcgtttcaattttttttttttaaaaaagatggagtttcatgtatcgagtggtgtcactgagatattgtggataaacatgtcacgcagatatgcatttgctctcggttttagttttgtggtacttttccccccccaattttcctttgttccttcctataagaatcatgattctctcatcaaaatcctgtcatgcacttactcggtaatgtatttttttttgggtatagttcccccttttttctggtctaactactaacaaatgactaacgaatgaagaaatgcaggtcttggtcggtgttcttttgttcttcttaagcttgacaataggttctctgttatgctggcacatatatctcttatgtcataacatgacaacaatagaggtaaattactctttggacaaacacatttttttcttggtgggtttatgccatgtttgatttttactgtcacctttacttcagtaccgagaggcaactagagcgaaatggcttgcacagaagagtggacagaagtatcggcaccgctttgatcttggcacacgaaagaatattcaaatggtacgaaatcacgaatagtgcataagatcagatcttccttctccatcatcattcatgataactgctacactttcaagaacttcaacactgaagattctttatgttcaattttattccgttgtcactccatttagctgatacttttgggtccttttgtaacagatcatgggcccaaacatcctgtgctggctttgccctactgcaacggggcatctcaaggatggcactgagttccagatcacaaacaactgatcggatcaacaaggaagcaattgctgcacacgtacatacttcatacatacattgtagatttgcgagtttatttggcgaccaaagttcttggccgttccatttgcttgttgcagtagagagctccacatttgtcaccagaatctttgtatgacagcatgtgaaatgttccatttccctcctaatctccatgtattctcttgcttcaatttatttgtgtgcagagctgtagatagatcaagtgatttgagttttgagcattgtgtactgacatattgaacggcaaaactatcaatttgaccagaattttcatgtcaatttcgcttattcggggaataaacgaaacgacatatttgcaaacgaaatacaatttgtgaataaaatttttatatatgtgttcttagcgatttaaaagtaaatgctgaaaaataaacttcgatgaaaaaactctaaaaacaactttaaatttaaagttgaaaatttaaattttggctgataatcataagccgaaagaggaggccgttgatttggaaatggttcagtacactctctcggttttgcgtctctctggtggttgggccccacctgcagtgtcacgtgtccgccacaaagaacacaaacctgacgacttggtgtcagctagtattgcagacggcttccttcttcggttcttcctgccgccgccgccgcctctcgccgtcgccggcggcttctacctctcgtttgcccttctggtgcgcccgatctcttgcatagcctacgacaatggccacctccgcctacgcagccaccgtcgccggggaagcagcggcggcggcggcgtcgccgtcccgtcgtgtccttgccggtggccgacctcctccgccctgcatctccttcctctccaaatcgccgtcctggtgcgcctcgatctctctccctccagggccccgccgcgccgccgccgcggccgaggagagggtggaggaggaggagccgacctgggtggagctggagccgatcggcagcgagcagcagctggagcgtgccctcgcggaggcgcagcagctcggcctccccatcgtccttctctggtaatactaataccctcctctctttgattgtgatgagcagtaaattttgtttcatttgataaatgcatcgttgtagcaacaccaatcctggatcttggatgacatggttactgggtagtagtactactagtactatcctgcaagttcagtttgtttttttggatggaaattggtcagtttagagttgaatttggtagtgttctgaatgaaattcaggggctcgattaggtgattgttcattcggtgcatctgaccttattaggtgaagtgggctagatcatcatcttgcttgaaatgattgtttcgcctttcatt

SEQ ID NO: 87510 - DNA, 1196 bp, Oryza sativa
atcttcagacattatcttaataagatcaatcatcttcatcttcatttttccctcatccccatgctaacatgaaagttgattgcatgattgcaaacacacacactcattgcataataacataatcctatgttacctttcaagaaaaaggcaaaacatgagtagcaaagttaggacaccatcacacacgcaaccgacaaaaatgcatggttttagttagttgcaccaaaaagcaaggattgattactaaattaattggccattgttgcgagtagaaaggttgaaaagaaaaaactacaattaaagaaaactaccttaaaagttgcaaagtttaagcccctggattctgtggagttgtgtgatgagtccaaaagaattgtgatcctcgattccaacgcccacgggaatcaccatacatacagctcgatcgatcgatctccatccatagtgatttgatttaagtatactatatgattgtttgtttatttcaaggcaaaaagaaaggacagctagcctacctagtacgaggaggaagaaggaaacctcccaagagagcttaacctatcatgtggctggcttctgccctactactgtactacgttgtacgagtaatacattagcatgatcactttgcatctctatttgtgagctagctacaatacccacaaatggtaaaacctaggagaacatcttagcatcggactaaccatttctaggatgagtattctctccaatcagaacgtgtcttggtgattagtttctacgaatggttttacgggcttttaaattaaagttttcttagccaagttgaaaaggctataagaaggcaacaataacatgtgagacggtgtaccgccaaaaggagtgacgtggatcagtaatagtgcttgacataaattgtttgaaaattacagatctaatcgtacaagatattatagatgacaataacacgtgaccagtgtgatggcactactacagagatatcaatgctttgtaacagaaatatgtacgaacggcgaatatttggtgagatacctgctagttggatctaggtgtgtagttaacacttaataggtacactaacacttttcttaggagccactttagctcttgctcaaagagatattaaaagaagcttagcctattctacaatgtctcaattacaagttgcgtgacctttccggtcaatatccacagct

SEQ ID NO: 87511 - DNA, 614 bp, Oryza sativa
atgtctaatgtagataatgatataaagacaatcggctgatgataatataatataatataataacaatataaatccaatagaaaccaattggctaacaatgagatggtaaaacaagcactgatccgatggttaaagtatacatcagctggaggtccgatgtcataagatcaaatcgatttagataaacagtgaaacatttgttatcatcggctgaatccaacttatatgtgcaatccttataagccgatgtaacgtccagatacctcatcggctgaaaccccgatgaaacccttattataaccaaagacatgctagactttatgattctaagcacgacttaatagatcaaactcaactgatatagcactaagtatgcaaagaagcataaagtctaaacaatcaagcctttgactaattttcatggtggtggataccttagctaatctaatctagcaagataatttagccgacaccagcataaaccctaaaacaaatctcagctgatacaagtaaattaagattctaaactagattaactaagatatatgataaataggtaggtaaatatatcaaccaaaccagagaaatccaagaggtcgaatgtactgatgcag

SEQ ID NO: 87512 - DNA, 550 bp, Oryza sativa
actcttgccaggatgttcaattgaggggaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcaatgtgtcagattattgaccttggttcatatgtgagattatcgatgacatgcacatacatctcagatgcaacaaatgcacatgtaatgttcctgtggtatttctgaacaccaggtagaaaacatgtatgcttggtaacaactgacactgtccaataatccttccatttccccttatacgcgtgcactctccagggacaaccatctttttccttaacacaccgaacttcatattgcggccggttcgacttggcaacccaaaactctctatgaagtgacactgcaaaatgttttaccgcctccttcatatcttctgctctactataaatcgctccctgaataacctcattttctttg

SEQ ID NO: 87513 - DNA, 689 bp, Oryza sativa
ctgcagccccagtgatccaggcgaagccgacagcaaggtctaaataactactggatgtttctacagctgggagtcgtagcgctgctgatgtcaagaagcattagctgagaatagaagcatacaatggtgactatttacttccatttttttttacatatgcacgcagtaaaaccaggacggaagtaattatcacaggcagatgccttgatggttaacttaatcacaaccaacatgatataatacaatgaataactgtcagatgttgaaatttgtttacatgtaatttaacctcacattcttgattcttccattagataaattctaggattcaaaaatgccgcaaaaaaatcaaaaaggcgatgggtaatagttgccaatatagccagtaatgtttaccaggaaattgaacagtcaaaatacttagaacatcaaagaaaactaaatatcaggcaaaacggatggtcctgctgccaaatgcagatcagagggatttttttttgcaagaaagaaaacaaattcataaaattaaagtatatagcaaaagaagcatctagtttattgttaccttctgcttgattctctgaccagcagcaggatcctttttatgaataatctcataagaaaccagaataacatctttcaaaggcctaggcgtctcttcaacttttccagccaagaacatgcaaact

SEQ ID NO: 87514 - DNA, 711 bp, Oryza sativa
ttttgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaattaagtggataaatcgtaataagcaaatatatgacttataattaataaaaattccaatatatatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatggttaaa

SEQ ID NO: 87515 - DNA, 666 bp, Oryza sativa
ggggagagaaagaagaccacaaccgttgcacaggctgccgaaattggaagataaagaagagacccttaaacagttacaatccaatccgactataagctgctacagcagatacatccagggcagctgctattttatcctatatgttatgagatcaattcgtgaacgagcccggcctctttcatctgcacatttcatcctggattaaactgaacaactgccaccatcattttcgctccactctaaagatgcgtgtttgtttattcctgactaaccatcacatcatcgaaagaaggcttcaatgatggggctttcttctgtcattgagccggactgcctgaggcttgcgtggcctattaccggtccttgaatttctgaatgtcattactgtgagctagtgaaagtaaaattgtgtgtgaagctgaatatccttttggtgttcaggcataagcttcgggggccaaatcacctgtagtgtctgcagatcaaggtttttgcttgtgattgtacatgtgtgctccctggaaattttatcgtactagatgcatatgctagtttgtccaccattttcctgatgcttcttattcataccactcttggatacacagtggaactcaatctattgttcacgccttctgtaatcgtattcagctccatcctttttctgtt

SEQ ID NO: 87516 - DNA, 1644 bp, Oryza sativa
tcaaacatttttaaaaaagtcaacggcgtcaaacattttgggatagagggagtatattgcaagaatgctttcaaaataagtttgcatggattttgcaggggagccaaatgtgcatcccgttaaatcaagggcagaatcgaaaggtatccatcccaaaggttcagcagcaggtgttctatttcacatcctactcagtaaattagtggtcacttctttcctgatgcctcatactcccacacatcctactctgatgcaacatatacagcttcaatctctatttgcttttccattatcatgttagttttatttcgcttgctagtcgctacaaaatgcgctatatatatatgcaccagaaactgcaatgtctctgacggctaaaaactgtcaggaaaaagcaaaataccgtcaggaaaataggtccttacgtgtcatcgtcaggaaaataccgtcacaactagcttgtcggggaaaaattaatttgcctgacgtgtgtccgtcaaggaaattattcctgacgtgaatgcacgtcagggttaattttcctgatgtgaatttcacagtcagtgatatttcccatatcactgataggtttgaccgtcaaagatatttttctaatttttctgacaggtacaaccgtcaggaaaattggtcatccgctattgtgataatttaccatatacagggatgatccatatatatacattatctaatagcaaaaatggtcattatgatattcatcacagataacatataaacagctcaaattccatatttcattcagaaaatagaaagatcaagtccatcatagaatagttctagttcactatttcaacataacacacaagttgaacaactagagtttgcatggcctaagacacctaatagcacgtactttcaaagtctcacactccatctatatggttagaaccatatagacaaaatatccaaaagcattagtatgccgcaactccacattggtatatcaaaaaccttagcccatcttgcatgacatgtgctgtagcagcatcaaggagaagcattcaaacaaccgatacaattgttggtcgatgttgttactgccaccattgcttgaagcaatatcacatccatcattgttgtggtagccattgcagtcaacttgctgtgagcctaaatgggaggaatcagttccctgtagcagtttgaaaagtttatgattaattattccaattctaactagtaataaaaatgcatgcccatgcagcaactaaaatagcaataatggtcatccaacccctgcagcaagttggactaattgtaactatctaaactatttccattttaagcaagattcatatcatgacaaaaagttctattttctactactgactctaagattacacataacagaaaaatacagctaatataaatcaatcactaattcacaatgattattacatgatgtcaacaaattattcattgcaatcacaaatttgcacgcatgattaatgtagcgcccattctgtcgtggcgcctagcgggaaaactatctcttaaaaactctatttgcgaaatccgtttctttgcttgttgtctagtgtccgtgccatctcagatctcaaatccccgatctatcgtcaagttccctccccaatccaaatcctt

SEQ ID NO: 87517 - DNA, 2584 bp, Oryza sativa
cttgcatgcagtacagcgaggcgatgatgagtcgcttcgctcgtacattcagcggttttgccaagtccgcaatactataccatgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaactcctccggttccggagtggcagcttcggccgcccccggatccgccgctcagacagggcggcgtgacaggaggaggaagaagaggccggaccgttccggcgacgagggtcatgtcctcgccgtcgagggcgctccgcgggccactcgaaaggggaggcctgcgagcgacaaaaagaacgaggctggtacacccagcagggagcgcctcgccggtaggtggtgctctgtccacaacacctccctccacgatctcgcggactgtcgtgcggtcaaaaacctggccgagcgaacgaggaaatgggaggaggacaggaggcaggaacgccgtgagggcaagtccccggcggttccttccggcaaacggcgaagtgaggccaagcagaaggcccccgctgttgacgtcgatgatggtgatgatgacctaggtttccaagaacctggggccaccattgccaccgtcgatggaggagcgtgtgctcacgtctctcgccggagcttcaaggctatgaagcgagagcttctggccatggcccctactcatgaggcgatgcgtcgggcgcggtggtcggaggttgctctcactttcgaccagaccgaccacccaccgtgcattgcccggggagggcaggttgcgatggtggtttcccccaccatctgcaacgtgaagttggggcgtgtcctcgtagatggaggagcggccctcaacatcctttcccccgcggcttttgatgccatcaaggccccggggatggtgctccgaccgtcccagccgattatcggtgtgacgccggggcacacgtggccattaggtcacatcgacctaccggtcaccttcggtggacccgccaacttccgcacggagcgggtgaacttcgatgtggcggacctcagtctgccctacaacgcggtcctggggaggcccgcgttggtgaagtttatggcggcggtccactacgcctacctccagatgaagataccgggccctggtggccccatctctgtccgtggcgaccttaaagtcgcgctcgcttgcatggagcagcgcgcggaccacctcgctgctgcgtccaagcccgagggtggtgatgagaggcttggcccctctgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggaaaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcaagacttctggaggccggattcatccgtgaagtcatccatccggagtggctggcaaacccggtggtcgttcccaaggcgaacggcaagcttcggatgtgcatcgactacaccgaccttaacaaggcatgtcctaaggatccttaccccctgcctcgcatagatcagatagtcgactccactgcggggtgcgaccttttgtgttttctagatgcatactctggttaccatcagattcgcatggctagggaggatgaggagaaaactgcgttcattacccccgtaggaacttattgttatacgtcaatgcccttcgggttaaagaatgcaggtcctacttttcagcgtactactcgaatttctttgggtagccaaataggacgtaatgttgaggcttatgtcgatgacttggttgtaaaaacgcgcgaccaagaaactttactttcagatttagcggaaacttttgagaacctccgctccgcccgcataaagctgaaccccgataagtgtgtgtttggtgtgcctgcgggcaagcttctcgggttcttggtctcagcccgaggcattgaggccaaccccgagaagattcgagctatcgagcggatgcgcccccccagcaaacttagggatgtgcaatgcgtcactggttgcatggccgccctaagtcgttttatatcaaggctgggagagaaggcgctacccttgtttaagctcctcaagcgctcggggccgttcacttggacggaggaagctgaacatgcccttactcagttaaaggcgtatcttagctctcccccggttctagtcgccccggagccaaatgagtccctgttactttacttagcagcgaccccccaagtagttagtgcagcgttggttgtggagcgcgatgaggacaatccccattctgcgcacccccactctatggggattggg

SEQ ID NO: 87518 - DNA, 1401 bp, Oryza sativa
ttgcgcctgtctccgccgggagtggaggtaggtgtgggctgtcccatcagaagggttcccggatggaaaccgtaccgatctccgcccattaaagagaaaaagaacagtccagtttggaaagagagagggcatgtggtatccccttgagatataaaaggaggaccttgcccatttagaagggggctctttttttgacttcttcccttttggaaggctgaggggaaagggagttaatcctttgtaactcgtccatacacaaatccacaaaaacacaggagtagggtattacgcttggcagcggcccgaacctgtatacatcgccggtgtctcacgtttcttgcgaggcgggtgatctttccacatacagagggagagcgagagcttgagatttcaccctaagcccccggccggactggcaaaggggggcctgcgcggtctcccggtgaggagccacgagctccgtcatctggcgcgccaggtagggggctcagcgtgtgttttctgagctctcgtactcttccgtgtgcgccaagtttcccttgttcagcctaatggccgagcaagcaaaggcgcacgacctctctccgagtgtgagcggcgacgatggggagccgaatccacgccgacgagctcgtactcccccacctcctccgcgccaaagccctaagcagggggaggcgcttgagagggtcgacaaatccgtggcatcaccagtcgcaggtgatgcaggagaacggcgagatggggagcgtcgcctcctcgtctacggcgacggcagcacgcctcagggtgcgcttcaggctgctggcgcgctcctacgacacccgcctgtcgtccatgacccggagtctccagcccaacgatggctggaagacgtggccaacttggtcatgacggcacagcagcgcctgggtgctggtggacggtccgccaccaccaagacctccggcgccgctaccaccggctccgtgtcatcaaggcggagggcgcggcgagcggcggcggctgcacgtcattcggctgccactccctcgtcgacaccgtcgactcgggaggatcagcatggggagccggatgcccgcctcaacatcgagcgccggcgtaatagccggcgtactccccgtgcaacggagggcgcctcctcgtccagagtgtcacctcgacacggacgtgaagatcagccctccgtgcccccggccggtggtgttggctgtagagcctttgtggcgagccttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacagg

SEQ ID NO: 87519 - DNA, 1100 bp, Oryza sativa
gggaggccgagcgcgggcgacgggtggactgggccgacggcccaagaagaggaaaaaaaggaggaaaaaggaaaaagaaaaagaagaaaggatttttcctgggatgaaaattgcactttggtgatttttaattggttaaaattatttccaaggctctgaaacttccattaaaaatcttgttaatgcattggagcatggggaactcgagaaaaattccaccacgccgaattcaattattaattgcatttattaattaaggaattagctctaggttaattaagataatttcttcggacaatttatttaaccaatttttttaaagcaagcaaaaggggaaacttccgggcgtgacaaacctaccccccttaaacggaatctcgaccccgagattcggaagagctggcgaagaggtgcgggtgagtggccttcaactcatcttctctttcccaagtggcctcttcctctgagtagtggctccactgaaccttgcagaatcttattactttgtttctggtccttctctcgctggtttcgaggatacgagtcggcttctccacatacgtcagatcttcctgaatttcgatgtgatccggacttgcctgttcctcaggaactcttaaacatttcttcaactgagagacgtggaacacgttgtggatgccaagcatgttggagggaaactcgagctggtaagcaacttcacctctacgttccaagatcctgtatggtcccacaaagcgtggtgccaactttcctttggtttggaagcgatgtactcccctaagcggagtgacacggagatacacataatcccctgtttcgaaagcgagctcccttcggcggttgtctacatagcttttctgccgagactgcgcgattctcaatctttccctaacagctctgactttctcttctgcctcatttaaaacttctgtaccaaacaattggcgttcccctgtgtcggtgatatgggaccgggagtatcgtgaccagaggcttgaggcagacgcaatcgcccacgtggcctggcaccttcggggacgtcgggcccgagggtgaggtgtccgccctcctcctgatttcccccgaggggggggggg

SEQ ID NO: 87520 - DNA, 722 bp, Oryza sativa
gaacccgcatcggtgtgttaagttcctctcttattaacccatgcatcccgacaaatttcttggagatgaaagaatgcgttgcaccagaatcacatagttctgttgcagggattgagttatcagcaatcgtatccagtaggtcctgtggtggtgcttgtgcctcttccccatatgagtggttgacgtcagcctgtataaaccttggtccggcacgcctatgtttcgggcatttgtcatcgaagtggccaagctcaccacagttgaagcaggactttggttttgctcccgtctccttattggcttgtgcggtctggcctgtctgtgccggtgccatcggtgagcgtggagctgtacagcggttcgtctgacttccatggtcattctagctgccactggagccatggtgcaagttggtgtggttgaatgtgcggtgttgaccaacactcatggtggtaggtccagccttctgacggtgagtcaagtctggcttatggttacctccttgatgggcagtaagttgcgcagcttgcctcttcgtagccgtcgtgttgcgttgatcctcgtggcggattgccgtgtcaaacagcctctcatagtcggtgtagtcttcacatatcagttgattggtgagctcgtcatcagaaaaagacatgaacgtttcttgtttatcggcgtcggtccggacatcctctggtgcattcgggggtaccgagctcgaattc

SEQ ID NO: 87521 - DNA, 635 bp, Oryza sativa
  unsure (1)..(635): unsure at all n locations
acgaccggaccggcgacggcgcaaggctgaacgaactgcgcaacggcggcgataggctacacggcgctagagctctaccggcggcgaaaaacgaaggcaagggtgncggcgggtaaaggagacaccgggggtccttttataggggctagggggccgcggcgaaggcccacggcggccggcggcggtgatggaaaggttagggttcggagagagagaggaatccgattcgagatcgaatccaccgatttccaaacgatttagccgacgattccaaaagtgaaaagatagaggagatctcggggatcatttcccctctattaatttcaccggaaaaggaaagggatgaacgaatttggaacgagacggcggcgcggctcggttagggttcgggcgtggcagctgcgcgaggaagacgaagactgacaggtgggccccacctgtcagcgagcggtacgcgcgcgcgcgggcggcgctcggctgcgggctgacctgggccggggaggagagagagaggtttgggccgactttcggcccaaagccaaaagagagatttttaaaactttttcatttaaattattcatgaagtgcaattccatttattaaaaatacttccttagctcaaataaatcccagaa

SEQ ID NO: 87522 - DNA, 603 bp, Oryza sativa
ccaactaaaacctgataatggtgggttgtgagcatatggttttgatggttgtgctcatgacaattaaggaccggttcacgattttcggttgtgaaacatttaccgtgccatccacaaaccagcgtgggcaacggctttactttctgtatagtatggttcatagtagagcaccagactgtgaagtggcggagataagcccaccggggtcgctggggagtccataccttgtttataagggggtgattatgatccgggaacggtgcactgctttgaattgcgttatgcaggacgtattgtcacaatctctattcgggtacttgttaagtatcgcgacgcatggatgacatgatgttgaggttgtgtcttgtgggtacagtggtacacctctggctagagtttaaactattcgaataggcgtacccgcggttatgggcgggtctaacaatgtctttcgtgattagtttcacacctctcaccgtaataaataatgttgtaattggtaataacttggttagctcctggctaggaatggtatattcctggtttggagatagaactgtgcagccgggattggttgttcagaacggtttagcctatgcaaca

SEQ ID NO: 87523 - DNA, 1104 bp, Oryza sativa
cgggggtcccttttataggggctaggggcccgcggcgaaggcccacgtcggccggcgccggtgatggaaaggttagggttcgaagagagagaggaatccgattcgagatcgaatccaccgatttccaaacgatttagccgacgattccaaaagtgaaaagatagaggagatctcggggatcatttcccctctattaatttcaccggaaaaggaaagggatgaacgaatttggaacgagacggcggcgcggctcggttagggttcgggcgtggcagctgcgcgaggaagacgaagactgacaggtgggccccacctgtcagcgagcgggacgcgcgcgcgcgggcggcgctcggctgcgggctgacctgggccggggaggagagagagaggtttgggccgactttcggcccaaagccaaaagagagatttttaaaactttttcatttaaattattcatgaagtgcaattccatttattaaaaatacttccttagctcaaataaatcccagaaaaatctaggaactatagaatcaagcaaagtatttaataaaattttatgaagcccaattttatattggaatttattatttaaaattagatcttctcttctaggcttttaaaattcatttctaataattctaattaaacaacaatttatatatttaagatttttatggtgcgacatgagtaaagtccagtgagaatattgtgttttcgctggcgggtggctcgtcgccagccaaaatcgagtttcgcaagtggatatgctaagacaaccgctagcaaaaataccatttttgcaagcggctagataaaatggacccgcagtgaaaacaattttgggtataaaaaaatttcaaaatcggtgccgccggccgccacagccggaagcaccgccggctgccgtcgcgacacctcaccatggccgccgcctaccgaagcccgcaccacggtattccaaaccgtagaagggagggggttggaatagccttgccatcgttatcgtggttgccgtcctcggcgcggtagacatcgatgtcattgggggaaggcgcgacggatccaccttcttcacgggtgtgaaggacagcccgagcaacgccg

SEQ ID NO: 87524 - DNA, 698 bp, Oryza sativa
ctatagggcgaattcgagctcggtacccgttccggcgcgccgcaagcctaagcccgcggttaagccatccgatatcccgaccctgaaagactacaccgcccgcctggtggatcagaaatggctgcgactcgcggcgaggagaaaatctgcatgagcatgtatcaacgcattaatggcgctgactggcgcaatattttcgtcgtcggcgatctgcatgggtgctacacgctgctgatgaatgaactcgaaaaggtttcgttcgaccctgcgtgtgatttgctgatttcggttggagaccttgttgaccgcggcgcggaaaacgtcgagtgcctggagctgattactatgccttggttccgggctgtgcgaggtaaccatgagcagatgatgattgatgggctatcggagtatggaaacgttaaccactggctggaaaacggcggcgtgtggttcttcagtcttgattatgaaaaagaggtgctggctaaggctctggttcataaatcggccagcctgccattcgtcatcgagctggttaccgctgaacgtaaaatcgttatctgccacgctgactacccgcataacgaatatgcgttcgacaagccggtcccgaaagacatggtcatctggaatcgtgaacgggttagcgacgctcaggacggcattgctcgccgatagctggtgctgatctgtttatc

SEQ ID NO: 87525 - DNA, 591 bp, Oryza sativa
catctagtaagtctgtactttttcttatgatcatccccttgtcaaaagaagcgtaatttataataatctattttctgaagaacccctttgggaacctaaaaaaagaaatcataaacatagctaaacttgaaagtacataattaattaacactaatctacccctaacagacatatgcttacttttttaactactaagttttttctcaattctttcttcaataactttccagtctttgttactaagctttctaaaatgtataggaataccaagatattttacaggaaaagcacgccagcttacaaccaaagatactagagtattgatcataataattctttgcttgaccaaaacaaaataattcacttttgtgaaaatttattttcaagccagatagcttttcaaacacacataaaatcagtttcagattctttgcttgctgtaaatcatgctccagaaaaatgatagtatcatccctatattgcaaaatagataaaccatcatccactaaataaggaatcaccccatttataaaactagcatcctttagctctcttaattaacaatgcaagcatatcaacctactaaattaa

SEQ ID NO: 87526 - DNA, 732 bp, Oryza sativa
cagtcaaagcatcgtgtgcataggataaatttcttactagaattattttcttcagaagttttgtattagaagcataaaaagagaaacaaacttgcagtagcatatgagcattgacaaggttcatttacaattataatttcaaactgctattactatagacaaaatgattgcaacaacaaatgcactagaatgtaagcaactaaagaaaatatacgctccttcttacaaagttctacaagcataatatgcggaaaaattttatgacacaaccagaaaacatgcacatactaaaagctctcaaatcagattgtaatattaagcatgggagttcaagaatcataattctaagaagcaaagttgcagtaaaacgaaccacgtggccttagacatattcttctggtagtgctggtagagcgcggtggcggtgtcgacatgccaaacggtgacattcttctcctgcggcgaggacgacttctggaggtctgcaggaacgtccccgcgggcgacagcgcggcggcgaggaggcccgggagctcgaacgacctgacgacggagagcgtccggcagtcgtagaccgtggccgaggccgaggccaccgtggcgaggaggcgggacccgtcgctcgagaagtaggtggcgctgcacgccgtcttcgggagcctcaccggcggggcggagcccgtcgggtaaggcgggcccgaccacacgctgaatccatccggctcgcgcact

SEQ ID NO: 87527 - DNA, 1390 bp, Oryza sativa
gtactaatgatttgctttgtatctgcagcccatcctagtgttcatgtcaaaggttgatgggaagtttcagttcagtcccatcagcgttaactttttgacggaggttacaaaagttgtctttgctatcgtgatgctaataatccaggtgtgtacttttgctgatgtttcttggtgtgcttgcattctgatgatgagtaatttaacccctataaaatgatatgtagagtacacttatagtttgtcttgatggctttggattggtaaaatactctgttagttcattagatcacttgtactcttacatgagcagcctactgaattcttctggtacaattcttctgcgtccaatttcttatagtacattcgtgtatcagaagtgattgcacatttaaaaaaaatggaaggagcagcaaatttgtgctaatcttccaaattgataagctcaactaatgcagaactaaagatcacaacaacagcctttcaagatgtgaaagcagtttcggttgatattctatgtgctacctgcacttcattatctttatgcgcaatttagcttgtcagcatgttcactgttccttgaaaatttgaagtcctacagattcgcaattgctatgctgcaacagatgtacattttatgccttctatatactttccattatgatcctacctcttacttgtttaccttctcgatgctgctttctgtgtggcagtctagaaagcaaaaggttggcgaaaaaccacttctggcacgttcaaccttcatccaggtgatttgttttctgctttcatgacttatatgaaccaccagtagaacttttttacatactcatttttaaataccttttttctttaccaataatttgtttccgctacctatgttctaacataatactgcttgttgcatgtctttttgtgacattgtctgatcatctgactctccatcattttcatatgtaggcagcccgtaataatgcactactagcggttccggcccttctgtatgccatcaacaattacctaaaatttatcatgcaggtgaatctgaagccatagttgtcgcccttctatatacccctctattgtcatcatccatgaatatatatttttatgttgtctgacatttttgagctgattatgcagctgtacttcaatccgtcaactgtgaaaatgctaagcaacctaaaggtacatattttatgcactactcaagtgttgtgcttttcttattagtgtgtatacgcatatatcataccttttgtaatccaaatttctctaggtgctggtcattgctgttcttctgaaatttataatgaaaaggagattctccgtaattcaggtaagcttgaggttgtgttgcagttatttctgactttatatatataggttgcat

SEQ ID NO: 87528 - DNA, 2780 bp, Oryza sativa
aacaatgcatgtatattgccttgttgcagccctttatggaatctttgaagaaggccatggatgatgccaaaaagccacggcctattcaagacttgctgaaagaacagatagctaagctgagagaacaaggatctggtggaggtggaggaaaccgaaatcgtcgtggaggcagtggtgattctggtggcccagaagatgaatcattcaaggaatcattggatgaactagtccaagttatcttagcaaccgttgcattcattcttgtggtaactaacgttacattcttgtttgtactctctttccgaatgttatttcttctgacactttcacttttaccccaatttgtagcatagtcctgctttccaagtatcttattatgattagcttaactattaacgacatactgtaatgtcgaaacaccttacctgtagatagctccatggtcaacgcactaaaagacttgctacatgcattgaaactgcatagaaactggagactgagagcaccatttcactgtaaagagcaatattatctgcgtattccataaaagtctcgggtgtagtcacagaaaaagtcggtgtaatgtagcttcaaaataaacaacaggcactaaatatatattaagaaactaattcgtatttgtgtaatattgcagtacatccatataatcagaggtgaggagctgtatcgcctcgccagggactacaccagatatcttgttactggcaagcgtactgcgcggttgaaacgtgccatgcaaaaatggcgcaatttctcagagagctttatgcaaagtgaaggctcacaagaagaccagtatgaaagagcagccacctccaaaccaacttggtggcaacagcctcaaaagtttgttcatcttatggaggaactctgccgaggaaattggcgcccgcatgcgcaggagtcttagttcaggtgctcccttgttcctttttggccttctgaagcacatggatgtggcgatgagcagtactgttttcatggctggtgcaatgacctggaatctggatagcgttccttgcccggggcagtgatttgttcttctttgttcgttaatgcgtattttctacgttttgttaagcactaaccaagtgagtaacttcctggcaattttgtagttgatgagatcgcatatataagctagccggcgtctcatgtcatatgcggcaaattgtagattatgttgaagttgaaccggtgtagcttggtttcactgcattttggtttggtttccttagcgttggaatgtaatgggtcacccttgacaacgtggctccaaatgtataatcttcaatggaaaacgagtagtaagtaccgaagcgcttcttcgctgaacacaacatatgaattcttgtcgcgtgtcggactactaggcatcaaaatgagatatccccccattctaaaataagctcacttttatatatgaatctaaacatagacatgtatatccaaaataagttcacttttatactacgtgaagaagattcctttatgcaattttcacatgataccatgcgtatttctctgttctccaattttcacatcgtcagtgaagctactattaatcatcagttactaacgaaatgaaaggagtagctttgatagtatcttttggttttgtcatacaaccatcagttcaaacttcaaaaactatcaaaatttcgagccgttcttgtatcaagaaacaacagatctaagaagcagggtgcattaatcgcgcggaatcaaggacagtttcccaggcagtgttactttgacagcatattcgcgtgattacatttcaaatggcaaaatgccatttttctggattgagacaccatttcactgagtagaagtggatttaattgtcatcagcagaggctccggatccttcagcagccttcttctccttctgtttctctctgcgcttcttatttctcagtgcatttttgctcatctctcctctgtcccagttgcaatgttagtgatcatgcatagaggtaaaaataattacataaaacaagacaagaaaactaatttatcgatcaagaaactaaccccgtagaagcaagcccaccaaaaagctgcaattcaccaaacaaatgtgttaagccaatagcaatattcaaatatttgagttctttaacaacttgaaatagagccaataaaacatcggggaaaaaaaggagccaaatatatttggcggagtgcgaccaacaaacaatactacttgtttttgcacaaaaccacagcagtttgcttggatagggattttgcagccttggatgtgtataaactataagtcagcaattgagccagcataacaaggatttactcagcacaacgatgcaacaaatagtaaacaagatttatgcacacttctttttgttgcaactctaacacggcttactaattgatctctaatatataccttatcctgaacatctgcagaattctttgaatgaggtggtcgatatgctgtaggtttcgctgctatatttgcaggggccttgcttgatggttgtgctgatttagaaccctgtgctgaaactatacagaaaatgaagtatgtaaatcaattgaccagaacttactaacatggaatataagaaagtgtaaagaaccttgttttttcgtttcttcaatttttatgctacccaacgatatcgtgaggtcggcaatgtcactaaatttttcaggcgcttctggcttccagtcagcctgtgtaattcaaaaaaaaagaaaaatcaaggatggagtgtgtgtgattatggaaatat

SEQ ID NO: 87529 - DNA, 830 bp, Oryza sativa
tctgttgaacaaaaggccatttaaccttatcataagcttttttaaagttaatcttaaaaattactccacttttattcttgcgatgcagttcgtgcatagttaacatactatatattgagcttattaacatactagaatactctcaaaaattgcaaatatgggtgatggccatcgtaaatagttaaacatatatatgacacaaaagtatctcaagtatttattgtacacgacttaagcttcttactagtcatacttactttccatcgtatacttgctgcacactctcggtgactcggttcaaacagattaagacagcttccccaacgaaaagatcttgcatggcggagaaatatccaaaaacacaacaaacaaacaaacaagtcacgtgaaaatattcaggagccacaaaatttgactgagacgacaaagaaaatctgtccacggaaatatatatactcctatgccgcaaacaacgttgacgtaatgcaatacgattttatttgattacttatgacaattattattcgtacaaaatcacatacatagcatatgtcaatccctgtaattagcaggtgaggttgctgccggggtcgacgccgaactgctggcagaactgctggtagtaggcgacgcggttgctgacggcggtggggttcttgccgtcgcactcgagcgcgccgttgatggcgcggatggtggcgccgaacccctggccggagacgaaggcgtcgtgcacgttgttggtccagtaccagagcgccgtctggaacgccagcacggggctcctcgccaccgcgtccgggtcgcccagcccgtcgaacccgatgctc

SEQ ID NO: 87530 - DNA, 1624 bp, Oryza sativa
gcaatttttctctgtccaggctccagagcccctggcgttcttgatgttcatgtgatgttcttagtaacattttttgacttttgtgaaaacagacgattaccaagctgacagctcagtgcagtgagaaggcttttgaattagaagtgatattttaaaaataaatgtttcagtatgctgtctaaaataaaatttatcccataccaagtattaacttttctcacgattgtgcctttttttaatgctacagttaagatcagctgataatcgcgtccttcaggagcagctacaacagaaggtgctctccttttctttatttctttcttatcgttgttcagtttaaaatgtttgtgaatggtgaatgactgaatggtgcaatttcaatactggtttaacacaaaaatcacccctacttgcagaatgtggaaatcaatgagttacaagaaaaagttctacgccttgagcaacagctgacaacaaatactgaggcatcccctgaacaatgcacagaacatgagcttcatgatttgaaatctaaacttcagttgaaggttccttttctgatcctcatttccgcacagtttgttgaaatttttaatgctttccgtgcaattttttgaattgatatacacaatatttttaatatgctttgacaggaagcagaaagtgaaaagcttaaatacgagcacatgaaaatcactgaggaaaatcgtgaattggtcaaccagaacagcacattatgtgaggaagttgcctatgcaaaagaactggcatcttctgctgctgttgaacttaagaatttggctgaagaagttaccaagctatctgtacaaaatgctaagcaggcaaaagagttactaattgctcaggagttggcacactctagggttcctggtagaaaaggccgctcagctggcaggggcagggacgaggttggaacttggagtcttgatttagaggatatgaagatggagctacaggctagaaaacagagggaagctgccctagaagctgctttggctgagaaggagcatcttgaagaggagtacaagaaaaagtttgatgaggcaaagaaaaaggaactatctctggaaaacgatttagcaggaatgtgggtacttgttgctaagctgaagagaggggctttaggcatatctgacttgaatgttgatgatcgatctattaatctagctgacattactaacggtacaaaggaaaacaaagctgacaaaaatgtagctgtagttgagaaacaactttcagataataccgtgaagtcattgactgcagaggaatacagaaatccagaatttgaacctcttcttgttcgtctcaaggtatgtttaaatatgctgcatatgcatgttatgttatgactggatgtttattgtcttcaggagtaatcctgctatgtagagtagctaatatgtgccactgaataaaacaaattcttctaaatgcaggctaaaattcaagagatgaaggagaaggaaactgattccttgggtgacaaagatggaaattcccatgtctgcaaagtatgttttgaatctgccactgctgcagttttgcttccttgtcggcatttttgctgtaagtacagtcccatctatccatgaattttatt

SEQ ID NO: 87531 - DNA, 3551 bp, Oryza sativa
attagaaggctagtttattcaagctattcttaccagaaagtgacatgtctcttgccattccaaaattaattccacttaacatggcagagcatcggcatgttggttcaaacaacttcaacttatttagcagccgaagtcataccattttcacattggtgagttcataaattctttcagcattcaatcatttgttaaaaaaaaggaactagtgttttctaattattgtattaatctgcctgatgaatccaatattgggtatgctatattactttgtttggggcctataatatttgcgtgctcttctgcagatgattgaaagcagcgctcatggtgacgagtatgatggagtcatgtactcacaacttgtatgtttttctcataagcaactctctgtattttcaattgctccagctttctagtcttacatttctgtgctattgtattttgtagaatttgattgatctagctgggtcagagagttctaagacagagactacaggactgagaagaagggaaggatcatacattaacaagagtcttttaactctgggaactgtaagttcttggtgctagccaccaccattcataactcataattgtagttagaaatcaattattatttgttttcttgagatgtgttaggagttagaacatgattgcaactaccaagttcaggttggacttgggaagcatctggtttatgttgtttttatgttgctaataatttattgttggaactgttgaatatataaaaataactaatcccatgcaacccctaaaagaatgaaatgatgcgcctgaggaaaaacttccaattcacaacatttgttgtaatcttaatcttaatcactgttggtcctacttactctgaaaatttcaaacccacaggttattgggaaactcagtgaagggagagcaacacatataccataccgtgattctaagttgactcgcctgctgcagtcatcattgagtggccatggccatgtttcagtaagtaccaacctgtttgctttcttttgcagctactctgttcaaaattcactacatggtgctacactgttggccattctttcactatgaattgaaatttgatcatcaagtgatggattaacttatattttacagctgatttgcacaatcacccctgcatcgagtaacatggaggaaacccataatacattgaaatttgcaagcagagcaaaacgtgttgaaatttatgctgctcgtaaccgggtaagtattctaggtgtatgcagctgacttcttgtgtaactgttttggaggtaagaactaatggatgcttcatgattttctgctgcccagatgatcgatgagaagtctttgatcaagaaatatcagagagaaatatcctctctgaagcaagagcttgatcagctaaggagaggattgattggaggtgctagtcaggaagaaatcatgattttacgccaacaggtctgttccttttgctatttgcgagagaaattactggagttctgtggttgtgtctgctcgcaattgtggctattttcttttaggatacctatgatttatgctgttaagttaataaatgcctaataagttactctttttttttatcttgtttagttggaggagggccaggtaaaaatgcaatctcgcctggaggaggaagaggaagcaaaagctggtctgatgagcaaaatacaacgcttgaccaagttaatacttgtttctacaaagaacaatattcctgccctgacagatacgtctagtcatcagcgccataattcggtcaatgaggaagatgtaagtgctcgttattacactattgtgcattggcacatacaatttttcctttatgatatgcattcatcaggcaggccatttcacttcaacaatgtactggtcctttccatttcagaaagtaagcacatcacaagatagttctatgcttgtccaaaatgatagtgccacgaaagattcgctatcatctgcttcgccagatgctgtggatgagatcaatcaactaagatgtgctagtggagaccattcttcgattgctggttctggacccgatgaaatgcaggtagtttgactttacgctggttactgtctaatgacatgtgccttgtgaataaattgttcgcaattattgtgtggaagtgtccttataaaataagttccttggatttacatcaatatgacagacccatgtatactatttatttttttagaatcgaattagtctgtttttttggcagttaatgtatgagaatttccgccccttatcactgtcctctttcacttccaaaacacaatgggtctattctggatgggcgtattagccatatccagtggattccattgatagttggccctgccttcctactgaacagtttgaacaattatgaatgcaaagcgctcactagacagtacaatattaattcaattagttttcattttgtagtgaacatgctgaatttgtgaatttaattgcctatgatttcctgtattttgcatttcagggagggatcaccgcatcggatcaaatggatctactgattgagcaagtgaagatgcttgctggtgaaattgcttttggtaccagttcgctgaaaagactgattgagcaatctattgaagaccctgaagggacgaagaatcaagtaatatttttcctcctttttcttaatacttcactagaaaaaatgcccatgcgttgcaacggttgaaggctatcttaatcttattattgttatacgatttagctaagatgaaattcaatgtaggaatttgcttggatattgtttttacaaggtcataagctacaattaggagtctgattgtcttgagttagtatgcgagtttttttctaaagagatttcttatacgacgacttctatatttccaaaagtgaacgaacttaaaaacctactcaaatacaaatatataatttcaaaaacgaatgaactcaaaaaccgactcaaacacggatgacgtaccaaagttccggcaaaaacgtcttcaatttttataatagtagatatgtagttactacctttgggcagttttcgatcttttctatttgtagaagaagcaatcatgtaatttacttctagacacaaatcggtagcagaacaaatgacacatcttatgaacaaatcataccaatttctattcaacaaaatttcgaaaaagaatagttccctgacccctgttatgctgacttctatggcaggtaaaataatattatacatggctgggcactcatagtttttttttgttatttattgtatcttacggagtacttcttatgtaagaacagatctatgactgataagaattgttacctgaagtttaaaagttatcttctcaaggattaatgaacttatactagtttcttattttgtatttatgaaggatagacgtatggaattgttgactgcagtataaagtgctgaacttcttgattttgtttcattacgaatatatctccatgcttcatgtcacaccttagcactccattttgctatatttatgtctctaactctctatgtcatcactat

SEQ ID NO: 87532 - DNA, 5354 bp, Oryza sativa
attgtcttgtgagttcctcactgactgcagtatgaaggtcattgaaggcctgagaccaaccaaatttttcagggacatgcaactccaccagtggcttggggctgccagacagtacagctacaaaaatactgcatacgaacaccgtcacagactcgattccatataacgctctcatgagcactttccctttcgcggagttcttgaccttcatcagagaaaggttcccagcaagctcctgcaaggtcgccgagcagctaacaagccttgcacatcttacgcccaccagctccatccactccctaagtgatggctcagctctcttgagttgctcctgcgacggcacgccactctccgagcccaacacatgcagggcatactgcaacagcaattgcccttgatccagacgagagagctccgagctcagcgcgatgcaaatatccagcagcttcacgctgctgttgagataaatgtccacccatttgtcatcccagtccgagacaggcagctcgagatcggttatcaggttagctatgttggtgtgcagctctgacaagcaatccactgcaagcctcatccatgacaaggtgaggacatccgaggcggcctccggcttgagcttcctcaagctcaatgccagggcatcctcgtacgaagcgagcaactcttggagcttccgagataggtgagctccccctggaaacataactcgaaagggattccccacagggaagaacgatctgggactaccgtgtgcgcgactcatctccactgaactgcaaccaaaggggaatcgaatcatccaattagcacttcgcaacacaaacatggatgaataaagcaacaaaccaatcggccgtacatacaacaccttttgtggatcaaatcaagcaaaagggatacctaacctcatggtgataatagtccacgattcataaaattcacagaatctcccttttccccgattcgtctggcagataagctcccactaaacatacaaaccctagcgatgctccgcctcaattcactgcgccgaactaacattacactcttgcaacacaacatgaaattttttgcagtagcatatctgtatcatccatggcgaccaaaccctaaatcgagctagacaagtaaaaaatcaagcaggggaatcacagccacaaattcccaacaacaaaccaccatacctccaaatcatcaaatccacgaaccgataagaacacacaactaagctacgtccgcacaagttgacctcagatccaccaaaccacccagaaaaaaaaaaaacttgcgccaaaatactctcaacccaaataacaaccacacagggatgagaagaggaatccactcacctagatcggcggatccgcgcgcgggggtgctcaaatcgagctcgattactcgtcaatcgtcgcgtcttcttcctctcttcttcttcttcggtgcgagactgagtcgaaggggagaggagaaaaaaaggggaaagaagaaaattatttgggagaggtggaaagttcgagacgcggaatgatacgttattacgttggggttgggggttgggccgcgcggcccgttaggcccggatttctttttagttttattgtgattattatttctcggtttggatttttttgggggggagtgggagccaacgggcaaacagctggcaggctgatagccatttgtcggcgtggttaagttaatgcgatttttgtttgtttcgatcgatgtcgttatatattttttttccgggatttgttcgtgtgtgtccaactgtatggtgcgatgatgcgaatgcttatcttaattccggaattccctcaagcaagatactgtatcattaagaaaaagtggagtaccgaatagtttccgttaaattgttttgcaatgcatccagccatatggagtatataaaatacggtcctgctttgtatccctcaatcgtgatatctgatatcacgtcctttcaattattaaaaccaatataaattgactcttttagtgctattaacggtgcttttcactgacgtggcttattaacctaatacaaccagctaattgttagctactcctacaaagacacaagaacagttggacacgagtggatacgagaacacgatagataggtttcctctcgatccgacaggatcaagccgccgccgccttcgcctccgccgtgttctcagttcatacctttcgccatcgttctcctctgtttaatacaatctcccacaacccgtgacagctgtcacagcacacgcaactcacacacgccatcgcacaggatggattactcacttggcccacatcggcccattaacacgaacactgggtcgtttagcacgcaggccgcgccccaggtcctttcctgattcacctccctgctgtagctcgtcatcttctttgtcaactcccagtgcaactgcagacttgtcagaccttcccgatgtagttatgccgcttggttgggatggtctgacaatcccccagtcttgaaaactggcttgtccccaagccagtgcacgcggaaaccgcgcgaacagatcctccatgtcctcccaagtagactctgacggcgaggaatgataccaatgggttagtaactgaagaacggaacgattacctttctttaccaggcgtttgtccaggaactggaatggaacttggagagctcccaaagaagttggtagctcatcttgcacctttttagaaaaccccacagctgcttttaattgcgaaacatggaagactggatgaatggagctagtagcaggaagctggatatgataagcaacagtaccaactctgctcatcacctggaatgggccatagtagcggaaagccaacttgtgacaagcacgttgcgccacaaacgtttgaacataaggttgtaacttcaaatacacccagtctcctactgcaaactgtctgaaactgcgctttttatctgcctggtgcttcatttgctgctgagcacggttcaggtgttgttgcaagagctgctgcataaattttctctcagtgtgccactcatgtaagtcagcaatctgacagtcatccaaaccaatgccaaaatgggatggtgtatagccatagagtacttcaaaaggggttttgttcaaagtggaatggaaagatgtgttgtaccagaattatgcaagatacagccaggaagaccacttgtggggagcagcatgtacaaagcatctgagataaatctccaagcattggttcaccctttcagtttgcccgtcagattgggggtggtaagcagagctcatgtgcaaatcagtgccaaacttagagaagagttgatcccaaaattgactggtaaagattttgtcgcgatcagaaataatggcacgaggcaacccatgtaacttataaatatttttcatgaactcttgagccacccctccagcattaaaaggatgggataaaggaatgaaatggctgtatttggaaaacttatcgaccacaactaaaatgcaattgtaatgagaggagcgaggtaacccttcgatgaaatccagtgatattgtctgccacgctcctgcgggaactggcaagggctgaaggagacctggataccgagctcggtcaggcttggcttgcaagcagacttgacacgattgtaattgttctttgatcaacttcttcatgcctggccatgcaaacaaacttttcaccttgcggtatgtcactgggaaacctgagtggccaccaaggggtgtcgcatgcagctcattcactaatttgtgttgcagggctgtattgttgcccacccagatcttgcccttgtatttcagaattccctggcacagttgataatccttccggctgttgggactgatagctagttcagccagtagctgtttagattgaccatccagctgatacccttgcattagttcttgcatccacgatggaatacattcagatatagcagcaacttcactgattggtgattcccttctagatagagcatcagcagcagcattagaaactccctttctatagcagatcttgtattgcagccctagcagcttggtgaaagctttctgctgccaaggtgtatgtaatctttgctctgtaaggtgcattaagctgtggtgatcagtgaggataataaactctccttgttgcaagtatggtctccaatgttcaactgcaaggataatagccatgtactctttttcataagtagacagtcctcttgtttttgggcccaaagctctgctgagataagctataggatgtttttcttgagatagaacagcccctatgcccacatcacttgcatctgtttcaatagtgaagtgcttggagaaatctggcagtgctaaaacaggtgctgccactagagcctgttttagctgctgaaaagctgattcaatttcaggagtccacttgaagggtattcctttctttaacaactgtgtcagaggtttgctaatcagtccaaaatgtctgacaaacttcctgtaatatcctgccaaacccaagaatcctctcagcttcttgattgtggtaggttgtggccaactcaccacatcctgtatttttgctggatcagtagccactccagcggccccaattacatggcccaagtaagagatctcttgttgagcaaaggagcacttgctcaatttcaccttccactggtgggcagataagagctggagcactgttctgacatgttggaggtgcagttccagtgtgggactataaatcaaaatgtcatcaaagaatactaaggcaaattttctcaatactggagacagggtttcattcatagcactaaggaaagtggcaggggccccagttaatccaaaggacatgaccttgtactcatagtgtcctgagtgtgtttggaaggcagttttgtattcatcaccttctgccatacgaatttggtggtatccagccctgagatctaattttgagaaccatttggatcctgctagctcgtccaacaattcgtctatgactgggacaggatacttactcttgacagttacatcgttcagttgcctgtaatcaatacagagacgccatgttccatctttctttttgaccaatagtgcaggtgatgaaaatgggctactacttggttgtatcacccccgacctgagcatttctgctacttgccgctcaatctcatccttgagggctggtttgtatcgataaggtctcagattgacaggcttagccccttccaccagtggaatgtgatggtcacaattcctcttaggaggtaattcagttggctcagaaaaaatttcctgaaattcatttaatatgggctgaactatctcaggcactgtggttgcagtaagagtttcagcaacattgag

SEQ ID NO: 87533 - DNA, 659 bp, Oryza sativa
  unsure (1)..(659): unsure at all n locations
cagcttttgcacgaatatgtcaccatgttttaactgcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgtccacacggtactttactttttattactactgttaaatacttgtacgaaactgatggtccttgtccagcaggatttgcagccgggatcttcggtactggggcctcttcgtctcacgccggtagggagatttcctcaaccagatgtgcatgaacccaaaggnccccctgtcctcgcggagatgttcgatgctagcaattggcatgcagttgagggtcttggtgatgaactcgatctcgtccctctcgacatccttcacgaccaggagcttggcctttgcgagataatggancgacagatcggtgactgaatcacgcaggatgcttttctggatgagcaggacgttgcatccggatgccttgatcttcttcaccatgccaaggatgtaattccgctcctcgcggaggattcgatccatctgcgcgtaatccgacacgacgacgctgtgctcgatgtccgtcttgggaggcgagacctggaact

SEQ ID NO: 87534 - DNA, 591 bp, Oryza sativa
aacctgctcgacatcaacctcccggaggacggcaaccgcgcgctcaccgacgacgagctggttatgctctgctccgagttcctcgtagccggcacggacagcacgtccgccgcgctgcaatggatcatggccgagctggtcaggaacccatccatccaatcaaagctctacgaggagatcaagtccaagaccggcggcggcggccagcacgaggtctccgaggaggacgtccacgacatgccgtacctgaaggcggtggtgctcgaaggcctccggaagcacccaccggcgcacatgctgctacctcacaaggcggcggaggacatggacgtcggcgggtacctcatccccaagggcaccatagtgaacttcatggtggctgagatgggcagggacgagaaagaatgggagaagccaatggagttcatgccggagcggttcctccccggcggcgacggcaaaggggtggacgtgacgagcagcaaggggatccgcatgatgccgttcggcgtcgggcggcggatttgtccccggctcggcatcgccatgctttacctggagtacttcgtggccaacatggtgagggagttc

SEQ ID NO: 87535 - DNA, 3031 bp, Oryza sativa
gccttggatgtcttctggtttcatcgttcttcttggaataccagcttctttctacaaataaaaaaagagaataacaggaataaacctgttaaatgccatgttttgatcgataaggttaaccaagattgtgtacagcagggtcagaaacaacaatgcaaaatacattatatgtgacttacaccagttatagtccatttgtttctgtcctatctagtacaaacccaaaatgaacaagataaatgtgacgggcactggttgccagtaaaattttttaaaaaaattcctttatttccctagatgatgccattacctaacaagatgcacactggatggattcctcgttaatcataccaaggtgtgcctcaaattttactaacatgattagttattccatttttgagaaataaaatgtgcaagtgacacaccaaaactttttgcaatggattcattggcacaaaattgaattgaagtctaacatataatagagacaaggcatgtttgacaaggatatcaactaaaacaatccttttttacctaagactagcagttttttctccaacagcaggttcatctattgcacatatcaaactgataatatttgacagaaatagattccaaaataagaaggaacaactaaccttttggaagtcaattccagaataaacaatatggcagtttgaaagctctctgattttctcatcaattgcctgttcagtcaaaatacagtcagttgccaaaacaaaaagaaaacttcaattggcttataatgatatgaatatcccagttgactaatgatttgcacataaagttatcaagtgctcaggagtcaggacagctgaaaaggagtaatattgcttccagtttatgtttaagcagcaattagccttttatgtcacctgtctttgacgcctaatcatcgttgccagatcaacatatggcaactttgatcaattctgcactccatcaatattcctccatcatagtctttaatgtacctggaatcagcaactattgagttcaacagataaaaacctgctgtagcctagtacaataatactctcagacaacaagtagtgttatcattgttacacttttattaggagttactgactcactttatacttcaaggaaatgataaaacaatataattgacaataaattgcttacccttgccatctttctttgtccaatgtgatctcctttgtgaaaccctacaaattgccagcagcaaaggacaataaaataaaccaaattattgtttgcaagacatatgctaattgatctcttttgtttaaatcgtcaagaattcttatgatcaagaaactactaagtacagaaactgttgctgaacatatgcctaagggaactaatttatagctgaaacaaaactgtaggacttaggagataagttgaactattaaagattcaaagttagtcacctgatacaatcttacaaagactgctagacaatgttggacacaacatgtttagaaataactttataaaccatgcattgaaacattctttttgtcgctaattctatgaagtcactatttcgttaggttcaagtgtatttcgtagctgccacttgagaacaatcacaaaacaatgaaattttaagaaagaaagcatataaaagagttcagtcaaatagtcaaacctgctttacaaaatagccaacggcattgttatctgcataagttaagaaatgagtgagcccatcagcatctcgggcatgttgcttcaggtgattcattaaccgtgtcccatagcctttaacttgctcatcagctgtaattgcacaaaatgctatttctccaaacttctggctacaatttcaaaacctatattaggacagaaacttatgctgcagcagaaaaggaacatctctggcatggtgcatggcatgacgcaacagaaataatcaattgccagacaaacagaagtgtgcatgctgtcctacaacataacctttactgctttgagatcactgaacaataaatagtagaatcctataacacaatctcattatcaaaaatcaacgttagctacaaaaacttaaaagaacagctcatagcttccattagatttcattatcaataactatcagatatctaaacaaaaaagtaccacaacttgatcattcatgcaagtgcaaatacatataacagatgtcaatacatcatacaagttctagcaccaaggtggaaatattaccttgtataaggccggtaagtaatgcctcctacaacaatattattcctgataaccatcattgatttgtgagttctgcaagacacatcacaataatttcttttataagcactaacgaagagagatattcttgtcctctgcttccaaaatacgtagtaggcacattacactgagaattacctatccataacaagacggacaatgtactctttgggcatgttaggaagctgccgagcaaagatattcttcaagcctaccaacctggggaaaaacatcagtcactaacaaatctgaggttgtttggaacaataattttagcatacaaaccaaatcatatgttcatcaactccatcattagaatagcatagaaatttcagcctccctgcttcttcctgcagaacaatccaccaattttagcagaagtcacattctaaaattcaagaaacagtacgaaatgctactccaatttgactgctccgatgtctaaaccctacaaacggcctatcaaatcgaaacagtgcaaaccaaatacttcacctcacgcttgaggccctcctctcgagcgctatacgcgccactggtctgaatgttgtcagtgaacaaccccttcgggtcctccttgccgtcgccggcggcagcggaagcggaatcgggcttgggagcggccgctgcagccgcggccgcggcggcggcagacacggtcgaggactcgggcttcggcgggcggccggatgaggacgggggcgcgccgtcgaggcgggcggcggtgaaggtgtggagggagtcgtcgtcgtcatcgtctgtagtgggaggagga

SEQ ID NO: 87536 - DNA, 17110 bp, Oryza sativa
gaacaatactaaaagctgcaactcgtctgctattccgatcttcctctgattcaagtgctaccagttccttcttcaactccaggccaggcaagagccgagaagggcttcccaaatttttcccgcggaggagggagaatccgcgagtccacgacctcctactcccgagcggcctctgactgaaaaggatcgaatttatttgagtttggttttacatgcggatctggaaatgcaagaggacctagaagaacgttgctccttagatgtatgcagctgaggcatcctaacgaatgaacgatttgaaccagttccccaacctgctttctccccgagaaagccttcctgagattaaaagaaaaaggtttgaaggttctgggatcagtgatagttcggaaccagcaaagggaggctgaaaagccgtagtgctaacgcacgccctgtagttttgaagcaggcttcgacagcagcgagctccgcgtcgaaaagcgaagcgagccgcgctagcgcgctacgattattccaaaattgccccttcgctttatcaacttccagttataagttgtaacttacttcaaacgatttgagacctcttgatatccaacattgttcttaccagaaccaaaggccacaggttattgctaatgccttccactatactcaacctgcatggcaattacttaatcaaagtcaagatgcctatccacataggaaaaacccaaagtcaaaagagcaattggcctgcaaaaataaaggatttgttctcttttgtaattagaacaaacataaacaaattggatagaaaaggagcggaaaccgattgattgtacacttgctgttctcaactgggcctctgaatctcctctggtttcacctttgcgagtcgaagtaatttccggaaagacacagaggagctctcatgcgtggaccaacagtagccctgtcctctcctctttgttggaagatgagtacacatcgggtaatccgcccacgagagcccaatcacaagaggctcatatagaaagcaatcagcccatagcccaatatcgagaccacagcctattattcaaaccacaaaggatccgtctttcatcgtccaatcttctcgatcgaacatattgacatcaatactcctttccatggccattcacggcccgcgaagatcaaccactcgtgcccgagatcactatccaatcaaaaaccagacttccaagatccatctcactcagacccttttgaatgtagcggataacaacggagcggggctatcgaattgatatgtattcgaatcttaggagctggtaatcactgatatgctcatattggtgacgttattgttgctgtaatcaaagaagcagtgcccaaaatgcctctagaaagatcagacagaagtaagacgagctgtaattgtacgtacatgtaaagaactcaaacgaatgtcaaaacaaaggaaagatgattatcttataggaagactgccaacactgactggggttgttcaatcttaagtggagtgagttaaatgacttggcttgctcaattccttcccggtgtaatttcataaaaggaatagcactcaaagcttgaagataagttttgtactcaattaatttctcagtccctctaatcgggtgggcaccggccggccggatccccctgaaaaccgtacgtgcgggtctcctttttgggtataaagataaaggagtcgagtttacaattgaataaattttcataatacatttgtcttgggttaaaaatattactattttttctataaaattagtcaaacttagagtagtttgactttgaccaaagtctaaacgtcttataacctgaaacggagggagtaatatgaatcactagctagctggggatgtaatttactaatttacataacatgtgattgacccatctgctgacagatgaactatgtacttgtcccacttgcggactagtttctatagtcttgctagcaattaatggtaaaactcagttattattcagtggacagtgatctattagcctcagtgccgggttgctttattgggttcaaaagaattaattgaattgttgcaaagaggaatagttttgatagtgctaagacaatgacttgtattgtaaaaaaaaaaagtgccacatgatggggacagcgcgatgaaaagaaatcagttgtaatgacgcacaattgttttgttcttagaatatgtattgttttatttttatttttatgttgaggacctagtagcaagtcttatgctcgaaattcttggtctgctttatgtagtgatcacttgacccatcttttctggcaatgctgatttaacctcattgactccatctggcagcattagtagaatatcatcgcacccaacagctatggctaccacacaagcctcagaagcagccactgagaaaggattgcctttggggatggatgtctccatggtggatgaatatgcttcccagtccaagctgctgcaggaattcgttaaaattcccactattggcaacgcttggatcttcaattccaagactggtatgtgctgttattgctatctggttttactgaacttaggtttcttactcttcttctcgtgttgtgcagaaaacacatctagggcgatagtttctgttggccaaacagatctgttggcaaacaaaaagaggagcttcctattaaattcccacatctcaaaaaattcctcaaattctgtggatttccagtggtctcccttcccaatcgaaatgagtggagtttcagcagtaattccatcgccatctgggagaaaacttttactaatacggaattctgaggatgattcccctacaaaactagaagtttggggcccctgtcagttggagaacgagattcacattgcacaatctgttcatggatcactctatgtcgacgaatggtaaactatcctgcctcttttagaacaactttcttagttttttgtgtggtagtgggtttttttttggaagaaagacagaggtaattagggacgagagattgctccattcgccactttttgtacttcatgtttcttaaatgcaggtttgaagggatatcgtggaatcaagaagagactttagtagcttacgttgctgaggagcctcctcaaccgaagccagaattcaatgattcaggatacaagaaggctggctcgtctgaaaaagactgcaagagctggaagggaaaaggggattgggaagaaacttggggagaaacgtattccaagaaaaggatacctgcattgttcgtggtcaacatttcaaggtgtgtttctggttgttctgaaggttgaatccaaaatagctttaaaagtactgcaattttgtgaggaatagtttcattgcagcggtgaagtgcgagctgtgaagggcataccgagaacattaagtgttggccaagtgatttgggctccatcatcatcacatagcctggtttttgtggcgtggtcatctgataatggttaccaaaagacaccaaggaaacttggaattaaatactgctttaacagaccttgtgctctgtatgctgttcctgatcctttcatggaagaagctgataagccatcacttaagtgagaacacctgtccttgatgacaatatttattcagttctatttcaactatgcaccattgtaggcttcctgttctaacatattaaggtattaattgtcacattttagttattttctagtgatcgtgtgacactgtaaattcttctctcagaataattgtagcagcatatttttttcaaggaaaaaaaatcttccatatatattttcactcttttttcctcattaatcctagtcctgagcagacaaatgctaaatggattgtatgcatcatgtctcaaaaaatagaaagtttatttctgatgtcatttctgtttattgtacagtgtcagtaagggtgaaactgcacctacaaccaagttaacatcagagttgagcagtgcttttttcccacgattcaggtaggactgcattcagttttctttgctcagtactgttattcagtttaggccatatgtctcaactattatattggaagaagtacaagctacacatcctagccgtatttctttaattatgcattataattgttaggcgtaatttttcttctatggtttaaaatattttaatcaaattcccttaaagcatgtcaattgattgttcatgcttgttatcatgtattttaacctaaatatttgaacaatcataattcaaatgggagtgaatttggaaagtggagcattttgggctgatgagtaggtgtctttattatttccttgttcctgtaatcctgtggattgactcagtagatattaatttactgcaacaccaatacattttatttgcacatctacaattgaagttttcatgtctagattataacttagtactggtagctgatgcatgtagatgaatgttaacaatgcgtcgcaaaaatgatatggaatctttattgtacagtccagatggaaagtatcttgtgtttatctcagcaaagagtgctatagatagtggaacacacaatgcgacaaattcaatgcataagattgactggcctgcagatgggaaattggagggcctcagtgttgctgatgtggtacaacaatgcctttcctttacttgttaattttttaatcgatcattttgtttagatggcttccttttatatatagcttcaaagtcatggcttggaaaaatacataaatctaaccagtgtttatttgagcacattgtttgcctgttggctatacttgattaaagatatgtatttctggactttgtgaagtggaacttcaattatttttttaattattgaagtatctaaattcaatttcagttaaaagaacgaagttcagagggtaaaatttataatggtgtgtttctttttataggtgctctgcatatccgatatcaagttcttaatgtcttagctgttatgtaggtacctattgtgatgtgccctcaggatggttgttttcctggtctgtactgctctggcatacttaggaatccatggcttactgatggacaaactatgattttatcttctatttggggaagtaaggaagtaatactttctgtaaatgttgtgaggtgattacaagcatttttatccatcagttagaatgatatggctataaagtttatttatttatgaaattacctattttcttcacagccgtgaagtttcaagagttagtcctcaggattcggattattcatggaatgttcttgcactagacaaggataatattcttgcaggtaattccgtaccgaagttacagttgtatcccatagttcctttggataagatttcatattcatgtgcctttcccaccttttccagtttcaagcagccttattacagttcctcaaatatactatgggtctgaggtttgtcagactggaaaaccaaaccaatgggagtggcaagaaattgcaactccttttccgagtccttctgataaggtataactgaaaaaatgcgttgcttgttcaacttttccccaaaaacactgacaaaaattttggcagtgtaaagtactaacagtttctgtgatgtatgtttggcagatcagtgcaatattagcagaccataagttcagtatactcaaaatcccgattagcaactcttctaacaaactcgctgatggtatgtgtacaacccaaagctcctttctttaatgaaatgacagacagctctcctgcattcgaggaaaaaaaaagcctctgactgtttttttttcctggaattggtactctttggtgccttgtgttttgaatacttctgttactgcattcttcagttgacgctatgtttttcttgagatcagctgtactgtctagtacttgtaggctgatatattctgaactgcgacaaaatctaaccatgttgcatttactcaaggcaacactaaaatgcatttgtaagaaagttctcaaagctcatggtagaatactcttcttggttgtttgcatccttaaggatgcatgctaagcttcatttgcattttaatgtttgaaaatgtactttagtagaatactcacatcctctccccttcctaaatttttatattttataaaattgattcaggtgctaagctgccctttgaggctatttttgtgtcctggaaggattctgcaacaagaccaacaattgttgttcttcatggtggaccacacactgtttacccatcaagctattcaaaatcgttagcatttctttattcacagggatataaccttcttgttgtgaactataggtgagctttatttttttttcttccagtagttcttctgttgaactaggttaaaataccctgtcctttctgaattctgctttggaaatatatcatattaaacactaacattaatgtccacgtacacaccattctgttgcctagaggttcactaggctttggtgaagaagcactacaatctcttcctggaaatattggttctcaggtgcactgttgttgatttatttccatgttttaagattattttcttaagttgccagaaattttatatgaactgtcattacgtacaattgtttaatactcatgaacaggatgtgaatgatgtattgacggctttggactttgttataaagaaaggattaatagatgcatctaaagtagctgttgttggaggttcacacggtggtttcctgacaactcatttgattggccaggttcttagcatgcctttgttattctgaattctttatctatgcaattattcattacatttgcagtttatatttcctttagggattcaattatttgtgcctaatcgtttgcacaaataatctagcacaattcttgttgtaaactgtatatactcatttggacataattgggaacagtgtcttttgataatgtgtattggtctatatgaaactcttatatttgagaaatgtgctgtaaacttataattttgggagggaggttgtaatttgtaaaagagagtagtaagtttaatataagtacccaagcacactaagttatggtcagtgaacttaaaggctcaaagctaaacttggatatttcaggagctctgtagcagtgcacagctaaaaattcttttaaaaaaatgatgacaccaatttatattagctattaaattatatattacattgcaacgcttaagtccagaataatatcctagaaaaacattcttacaagagttaggatcagcatttgtttccttttcttggaagtaaagcttcactgcagtgtaagccgagctgtttttaccttttcatgattaagaagttcacatgtgatattctcaagaatatttcctgattttagaatataattatttccttgacaaaaatagtgagaaactactgctgcatgtgggaactaggtctatacagtttctttatgactatacatgcaagacaataagagttcatgataggtctatacagtttctttatgactatacatacaagacaataagagttcatgatgcacaggcaatagcacatggattcttctatttatcaggtcttcttggattctgttgaccttatgtttcatggactgcaggctccaggcacttttgttgcagcagctgctcgaaacccagtatgtaatttatcattgatggtaggaacaactgacatacctgagtggtgttttgtggagatttatgggaaagaagggaaaaactgcttctcagagtatccttcatttgatgatctttgtcaatttcaccagaaatcaccaatatcacatatatcaaaggtatgtagattctgcatacttaaccttttacaaaatctatgcttgaggaagaaagtgtagttccctcatgcaaatttgctccttgaggactttgagtaatcttttcttgacagtttaagaaaatctgcaggtgagcacgccaacactttttctccttggagcacaagatctcagagttcctgtttctaatggcttacaggtaatttcttatgcacttctgtttcatttttatatgatgaaagggttgtgaaatgattactagtagcaatgttgcattcatgttattgtttgcgtagacaagttcagtcaattttcctgaaaaccattagtgaaagcatatgattcatattgttccactatatactgcttgtatctatttatttattttcacttttacaaatgctggtttatgcctaatcataatcgcaacatatgcagtatgcaaggaccttgaaggagatgggagttgaaaccaaaattattgtctttccagaagatatgcatggccttgacaagttagttgtactttttaatcattttacctttgttaccccgatcagtgtcttctgtgttgcaacatttgactaagtcaaccttgcgtcccctgtgcaggccacagtctgattttgaaagcttcctcaatataggtgtttggttcaagaagcacatgagcaaataaacaacatgcctctgttaccacactctcaccttgcttaataaatgcttgtaatttgggtcaaagcagcccaaggaaacgtggttctgttggcattctaataaattaagcctgctgtaacatttctgtactgggataattcttgaaaatgtaaatgcatttggttataaaattttaccctcgtggtacggaactatggattacaaatatgtgatgttagattatgctttactttgaactttgaagtacttctagttcacggttgctgtcctgtagcctgttgggcttgggcattccttttatttttatctttttttaggaaacaatgggatcataatttcttttgaatttcagtgagaaaaaaatacatgaaagttcagttcaagttaggcacatggaaatgctgattgagaccactgtaacttctgcttctttgcatcaagatcccttgaagttgccttctggataatctcattttcatcagatggtacaaagagctttgttgtttcatacgattttaaaaaggacaacaatataagttattgcaaaggcttcttgtgctgttcgatgctttcttcgtggatgcggacctgacgcaaccttttgtccttattgctgggttcctcttgtctcattgtctatggtggtatgtacgatcattagtaactttttaagattccttttgttattttgggcccattctttgagacctgacacaaaaagaaaaccaaaatttgatgccatctgatcctcaccaattgtttgttgttaggtttgttgggatcgttgctaaggactgatgatgttttaaagctcaactgcagtcttggatcaaccactctgccactagactccatttgcacttcactgcaaaagcagaaaaatatatgtaagtattctcctttccttcgtctcctgaaaggctaatacgatttataatctgattttattgttttgaggcttctaacttgctgaattttgttggtcctaagttgtttcctcctgcactcagtctggtcctcttgattattgctgtagttccagaagaatctgattttgttagtagaactagtcccagacttaacatccaggatttaatattttttagtgttcatcgtattttttagttatgtttatacttttgtactacatgaaaatcaaagcatttagtgtcagagttctccagaaaaggattttggtgggaaggaagaatgaaagatacttcattttattaatcttaggtagccattatagaagtttccatgttttgtttgtctaagtgattcaatattttttcttgaattggtgcattgacaacgtcaaatctgtccatggattgcaagatgaacaattgggactgttgttcttgagttgttaatggaatttatgaagtataaattaaaaaatagtttgtgtctgaactacattaaagtgtatgaaatctgagtcttagtacggtagtacctgaaatttttcacgggtaactgcaatttgaattatgaaagagttaaggtgatataggttgagtggtgtgctctaacctctaggctcttttggcattgaaatgtatacccatacatcatgaagttgaagtcaggaattcaggtttctcagttttcatcttatcagtggaattgacaacaaaatatacttgagcttccctgcagcttgtttaacatactatattcttgagtttcccttcagcttcctcagcatattaacctttgtgacaatgcagatttagcttaacccagtagattgtgtctttccaaccgaccttacaagtgatttgaatcttctttgagaaagacaatccattgggaatggatgcactggcatctgaagaatacgcttcacagtcgaaactacttcaagagttcaccaatgctcccagcattgacggtgcttgggttttccagaccaacaatggtagggatgattttcgattatacctcattagtaatcatcattttactattttccagaagtggcgtaaagcaactcttgtgtcatgtttgcagaagacagatccacagcaatgtattcgattagccaaacaaacctactggcaaacaacaagagaaaatatattttgttttctcatattatgagaaatggtactaaccttctggactttcaatggtctcctttccctattcaaatggatggagtgtcggctgtcgtaccatctccatcgggatcaaagcttcttgtggtgcggaatggagagaaaggttcccctacaaagcttgaaattgttgatcaatcacatgtggagaaagagatacatgtagctcagtctgtccatggtccactttatactgatgagtggtaaaagtacagcataatacctgcacttttcagtccattcaacctatctgtacaatattctggatcatgatactatttttgttggcacaggtttcatgggatttcctggaaccaagaagagaccttaatagcatatattgctgaagattcacctgaaccaaaaccagtttttgatgatactggatatagaaaagaaggttcttctgagaaagactgcaataactggaaagggcaaggggattgggaagaggattggggtgaaacttactccaaaaaagggagaccttcattgtttgtccttgacattaataggtctctcagcaccttctaattaatacataatgttgacctgaccatagatctgacaatacgacttactgaaaccgtttatttgttgtattcagtggagaagtacgagctgcaaaaggcatttcaagatcattgagcgttggccaagttgtgtgggctccaccatcttcatgtggaaggcagaagtatctgatttttgttggatggttagagcacaatgggtttcagaatactcctagaaaactaggcatcaagtactgttctaataggccatgttctctatactcaactctttgccctttcgaagaatcagatgttgataatgcaccagctaggtaagtaactgagcacccatcttcagatcatgctgtaactttgtaaagtttacaaatttactttatttatcactagtttgttgaaataagaaaatgtaaagctctgaataactatgcttatggggcagttgtaagttgatatttccatgacatttttccagtgattctaaattagagcctgcttcagtagcaatcaacttaactccaagcataagcagtgctttctttccgcggttcaggtatgcccgcattagtatttgcgtattttcttgaaggaccttaaaccatgctagaaaaattcttcacggaaaatctctaattattttcaacagcaaggatggaaaacttctggtgtttctatctgcaaatcgtgctgtagacagtggagcgcacaatgcaacagattcactgcataagatcaactggccttctgactggaaaatggatcaatacctcgaaatcactgatgtggtatgtcctcagatttgtcttgaccggtacttatctgctgtctgcagtcaatttatttaacttctgaactgtgccagattccaattgtaatgtgtcctcaagatggttgttttcctggtttgtattgttcttccatgctatcgaatccttggctttctgatcgatgtacaatgattctgacatctgcttggagaagcactgaagtgatattatcaatcgatgtgttgaggtaaacaaggttgctcacatatgcctttctactgcttcaaaaatcattgcaatatcccatgctatttccttaattcctcctgcagtggaaaagcaacaagaataagcccagaaaattcagagtactcatggagtgctcttgcagtagatggccacaatgttcttgctggtaattctaggtgcacataatcagttaacttatgcatcaaattttattattttgggtgtaataattttattttatttttgtttgttttctagtgtcaagcagtcccatcgacccacctcaaattaagtatggccatcaagtgtcattgaaggatcagacatgtacatgggtctgggacgaagttaataataatccattgatggcagctaacaataaggttagatggtgtacaatttgaagtatacttaggtgttctttgatgctttgaacaatgtaatttactaaatcaggcttttttttttcattctcacattaccatctgctgcaggtaaaggctttgttgtcacatcaccaattcagcatactaaaaattccagtcactaacccctctgatgacctctctgatggtatagtcatggacacaaatattttagactatcatatgtggcttatcatcattcaccaagcaaatgttttttatatcctgcaggcagtaagcttccatttgaagctatctttgtgtcctgcaaggacagttcgcacaaaccaactattctagtccttcatggtggcccacactcagtatctgtatcaagctattcgaaaacatcggcgttcctcgcatcacttggatttaacctacttattgtaaattatcggtaagtttgctgaaacatttctacagttctgatcaattaagcttatggcatcatctcactatcatctgaaaaaaaaagagggacaccgggttttggagaggaggctttgcagtcacttcctggaaaggttggatctcaggtatgtaatccagctaaactctgagtctttgtttctcatgaaccaacctaatttctgatgtgtgtcaaactgtcaagcaggatgtccaagactgccttacagctctagactatgtcattgagggaggacttatagacgcatctaaagtagctgtcatcggaatttcgcacggtggattcttgactacacatctgattggtcaggttagcatcctaacagattttagcctctcaaaggaaaagaagaagaagaacaaaatcctaatagaagttagtatatgtttcttgttcagcttgtaatttgttgttattttgtttcaggctccagatagatttatggtggcagctgctcgtaatccagtctgcaacctatcactgatgattggcaccactgacattccagattggtgttatgcagtggcctgtgggagtgaagggaggcaacatgcctctgaatctccttcacctgatcatcttcgcctcttctatcagaaatcaccaattgcccatatttcgaaggtgcatttctgttctcgccttcattcaaagagcaaaaaagaaatgttcttactgatcaagtcattgttcttaaaaacaaatgaaccagagaaatcaagtgattagctactcaaaaaggctcactgaactttgctgattttttttttctaaaaaaaaaaactttgctgatttcaacaggtgaaagcgcccctgcttatgcttcttggaggagcagatcttcgagtccccatttctaatggcctacaggtacatcaatagccgtttaaatttgcctcagtagtttccactttcaattcgttgtagaaatagtccataacaaaaaggctagatcctgaaacaacctaacaatcccgtgaaaagaaaatcaatcgacgggctacatcaaacagacattctttaaattcatctacactcgattaataacctaacaatcctgcatttgcttcactcatttgtcggatttggttaaactattcctgctcggatgatttcagtacgcaagagctctgagagaaagaggcggcgagatcaggatcatgatgttcccagacgacatacatgaaatcaacatgtaagcaagtaactgaaccgaatttcagctcatctgctttatataaaatgtcggcaacagccgttcggaaaaaaaaaagacattcagatgccattgtactattgcttttgtgcctaattttctccctcatactggaatccatgcttttgttcagaccacaatcggattttgagagcttcctcaacattggtgtctggttcaagaagcatcttagcatatcagcatcagatgcatctgcatgaagtcaacttgaagaaggggaggaagaaattacgtggtttaatctagtccaacaggtagatgccattgtaagccttgttcatggagctcgtccgtagacgagtgctccaaaatattagagacttccctattgaaaaaagtaaatggagactttaattggtttgagttctttccttttcccttcaattcacatgcttgatgattggatgcaaattcagtcggatttactaattactactagctactgctctgaccgtgattgatgatcagtccaacaacaatacttgcaaaatagtgcaatccaggagggtgttgttctttatgcacgttggcccatgatttttttttttcaaacaaagtcaacagccgcgcgagcaagtacaaacctgattcattaagtaaagtgtggttttgtgaattttactcttgcccggcgaaaaatttactgccccctgtgaattttcctcttcattctgaaatactttgcacaagccaactcacccatcaacatgccaacttaatgtaagcaattaaattggtgaaaaattaaacacgccatcagattgctacgttaaaactacaaagctggaaagcacaacaaggggggcgagagctataacaattttacaacaacaattgactatatcagatgtaccaaagaccatgtcagttcttcgttgaggcttgggcaagctgagatgctactttgtttgagaagaagctctcgagcctgcacaaaaagaaggaataaaaccaaatcaattagacaaccaggtgactgagatgctactttctttgaactctcgagtatgcaaaaaaggaacaaaaccaatcacttagttagacaaccaagtgactatggccttgtttagtacgcgaaaaaaaaatttttgggtgtcacatcggacgtttgaccggatgtcggaaggggtttccggacacgaatgaaaaaagctaatttcataactcgataggaaacagcgagacgaatttattaagcctaattaatccatcattagcacatgtgggttactgtagcacttatggctaatcatggactaattaggctcaaaagattcgtctcgcaatttccatgcaaactgtgcaattagtttttttgtttatctatatttaatgctccatgcatgtatccaaagatttgatgtgatgtttttgggaaaaaaaattgggaactaaataaggcctacgtttcaaacacggacgataaataattaatgccagatttcccccaaggtgaatcttctactggttatgatagaaagacattattgagtgcacataaatccaacatgagatgtaaccacccacgtttctattaatggttaggctaaatattttcaaagaaacattgacagatgcctgacttacaggtagatgaatatgcaaacacaagattgaagttcattgctcaccgtgaggcacacttgtaatagattgtatcgggagagttataagtttttgcattgctgaacattctcttcatgtcagctacaaacatctctagcgtcacataatactgctcagactcaactctttttgacattgtcttcaaatctgcagacaagcttagtgttcagaaactgaatagcttagatggcacaaaacatagcttcgccaagctgggaaaagaagggaaaataatcccctaaatcattccagcataccaataggatctttgataatgtcataatagtcaggaacatcacgtgaatccactggctctttgaatggccaagcatcaggatgctcattcatattctacaagacaaagctcttatatcagaattgataaaagtatgaagtatctttcgtaagacaacagtagatccaacacatcaggtcattgcagatctacaacatctttggaacataatcctttgaaaaaattgtctatagagcactgtacttggttgtcatgttaactcccaatcacaaaacaaaattagctatatctgctggcagatactcttttgttgccgatacacactaaaagatcaggtctgtttgcccatagttttgtttgctggtggccattgcaatccattagcatagtagcatatgcacatgactttaaggtgtgttttgagtaatgacatggatccttagtgttacattggtgtagccagttttgcctaatttctaaaccacactggactgatggttgagaatcactagtggctcacctgacaatcagcttaacgtttcaaaggataaatatgactaatgtctgaccatatgaagtagagttcacagtgaagtataccagaaatatttgaatattaaacttataaaatgtggccatttcaatcattgaaccattgaacagaccatccagctggtctggctttagaaaatatgcttgaaacagaaagggtgcaaaaaattcaaaagggagcaagcaaagtacaggtttatccagtgaggtcaaaccaaatggttgcatgtcatataaaaagatttgcgaagataaaagacttgccttcaacaatgaacgcattagattagtaagttgttgcctgtaagtactgtaatcaggagaaaaggctgatcttgatttggaatgcccccactgatctggcgtccacccagcttcccctgcatcacattgattgttctgatcaggcttgcatcatagctaaaccagtaaacctaacaaggcggcaaaacaa

SEQ ID NO: 87537 - DNA, 925 bp, Oryza sativa
tttcagaatcacattctgaagacaaatgggtctatattgctttattgtattagcatccttaatttttggaagcagagaaatcaccccgtaatttatcctatcactgtctaaaattcctttttgaagatcatcaagcatctctttgatcaaccccgtaaattcaggccagagtttcttatagaaacccactgggaaaccatccggtcccggggccgtatttgttttcatgctcttcatgacctgatcaatttctgacaactcaaaaggtttcatcaagctttcattatccccctcattcaaacttaatttgtcagcccaaaccccctgttccaaatgaatgtttctcaattcttccctcccaaacgactgcttgtaatagtcataaatatgagtctgaatctgttggaaatctgaaagaacctcctcccctttttgtatagagaaaatgtgactttcctattcctaccattagcaatcctatggaaaaaagaagtattgctatccccccttaacaaccattgttcaccccctcttctttgccaccatatttcttcttgtagatagatctgttctacttccttttctagctcatatctgacctcccattcttgagaaaacaaatccctctcctcagcaatgctgtcaatttcaatcagcttttgttctatctctttccttctctttttttgtttgcttaccatattagcactccacccccttaaccatctcctcagataaggcataagaagatgccaataattcatcactttgctctgtattctggcaggccacttctcaagcaaatctttcttaaaaccctccaactcaaactagcccatctcgaacctaaaattgtttcccctaactctctccccctcctagtatttaacagcaaaggaccatggtctgaaccaaccctcaaaaa

SEQ ID NO: 87538 - DNA, 1393 bp, Oryza sativa
cttaaagtttatgttgactttctttttcggagctgtgagctttaaatatttcttatgacctttttacctccagaaagaaatcagagttccctcagtaaatctactaatagaaaaggcaccataaaagtaatcttaaattaaaaaccagattaaggatgcagtaaccatagactaatgtactacaagacactgataagtggtaagcatagttcgtgttctgtattaccctacttatagagacaaaaataacaatacttgctgtcctgttactgtaatgttgggttctaagatgcaattttctatataggagttattttaaagaatcaataaatccatttttcaaatttataatagttaatacttaattaatcatgcgctactgatacgccccattctctgagacaacaatagctacaggcaaacatccctgccaaactcaccctaagatcccattacaccctagcacctacccaaaagaaatgcattcaaattttgctctagcatacatttaatgctttccttacctgttcatacttgcttggccacctgtgaaatcagatgtagcttgccacagtgtgtgtttccttggttgaggatccgtctctttgaagaagagaggaggtcgggccaacttcattaataatagaaacctctcagaaaaaaagcaagataggaaagtaacatgaaccaataatctttaaaataacttaccaccacatccaaggttccctgtccattttcagggcaagatgccttcaatgcagtaatatccgaccactgaatttctatcttactcttcaaaccaccttccagaacttcccatacaagcttatgttttgcgaagtaacattttgccaccaaatcaccttcataccgtgatatatactgctcagagatagaatacagttaagattatggccaacaattgttcaggagaactgctctaaatgtgactaaacactaggtcgtagattcaacaacatgcaggaataaggcttttgggcaaatgactacctactgtagcaaataattggccattaggacaggatataggatgttttaatgttgcattaacatctcacagtggtgtacaatataaactatagtaagtactatgcttacataagatcggaagtattacatgcaaacagcatcaccacaatgagactcagaaactaagaatgtacctcaacaaaagaatgtttctgtgtagatagtaaataattttgattgaaagaaataaaaaagcaacagaaaaggaggacgccaaaattaaataaatgtcaaggttgtggcagaactactaaaagctatatctagattcttacctccatgtgccaattctcaaaatatttgcaggaaagtttgaagctttcaagcgctccccagctgt

SEQ ID NO: 87539 - DNA, 4795 bp, Oryza sativa
  unsure (1)..(4795): unsure at all n locations
agagattggggatgagggaaggtagctggcgggagagccggacagaacgtgcaagatgatagagaggagaggagtatgcgagagagatcacgggtaaggtgataggacatggagagcagagacgggggtgagggtggaatgaaaacgatgacgcatgacgttgtgtagacataagggatggtacgactttcacggattgacgcataagcagtaagagatgatagtgtgaagaaatgaggggtaggagagagagacagtgacgaatgtaaggactaggacattaaggggataggaagtagaagcgtttaccgttaaaggtctgagggtgaaaaataggtcgaactggacgagatacgcgtataaatgaaatgcgtatgcccaccttaacccacacacgtggcgccaaaaccacagggggtcggggcgccctagccctcggggccgaaacgggagcggcccgacccctcggggagacagagggaggggtggccacgtcaccctcgggcccgaccccccaagggggtcaggccacgtgggtgaccgcggctacccaagcctctagtcacgatacccccggccccatgtcaccgacaacaatagtaggctataagtcaactataagcacatgtgaaggagataagagaggagaaaaaatagaagttaattatagatttgtagtcagatgtaacatggaatcaaagacactttgtgtgtatgagatgtgagatcagatattaccgatgtggtatatatttataagtaactactgtataaataagttattaaattggttatatatatgatttggagctagtaatttggttatattgctctaagtacgagtgtgaggaaactcctttgcaattgttccacagcaatttttgtcccgttgtgttcaaatatgagactgaacagtaaatactcgtttgcgtgtccatcgcagaacctagcaaatccgtaaagacgatttgcaaatctccagtatcttcaaattttgggagactttcgtccattttgttcttcccgagtgttgtcacgatccatttctgccgccttcgcttcttcctctgcctcggccttcgccttcgcctctgcctcagccttcgccttcgcattcgcctctgccgtctgcttcagctcgtcgatcacgatctcgaggcgggaggactcgtcatcggagccggcgcgcttggccgtcatgaggcactcggcgacgtcggccggcgtgatgctctccctgccgaggatctcgccgacggggccgaacagccggtggtcgtcgacgtccaggtagttcttggcgagggtcttgaacgcctcgattccgcagtacgacatctcgatgcgcatgtccatcctgccccgccggatcagcgccgcgtcgagcttgtcgacgtggttcgtcgtgaacacgacgatccgctcgccgccgcacgccgaccagagcccgtcgatgaagttgagcaggccggacagggtcaccatgctgccgtcacggtcatggcgcctgctgccgtcgtccctgtcgttctggcgcccccgccgctgcgtggcggcgcggtcgccggtgaggtcgagggagcagtcgatgtcctcgatgacgatgatggacttgctggtcgtctcgatcagcagcctgcggaggtcgttgttgtccttcaccacggtgagctcgacgtcgtagatgtcgtagtcgaggtagttggccatggcggcgatcatggtggacttgccggtgcccggcgggccgtgcagcaggtagccccgcttccacggcttgccggcgcgccggtagaagtccctgtcgctccggaacgcgtcgaggtcgtcgatgatctccctcttcctggccgtgtccatggccaacgtgtcgaacgtcgtcgggtggtcgaagtcgatgtagctccatgctttgtaatcgtaccggctgcacagtcacatcaacgcaatgatcagcaagatcgaaatgaaaaaaaaaaagaagaaaatgtgaaaatgtacaaggagtcgccggatttgttgttggtgtagaggcgtcggcggcggttgctgaagaggatctcgcggcccttccggcggacgtgcggcaggtactcgtcgacgacgagccgccggtcacggtggtgtaacgtaaggcgctggcaccgccgggtgtgcgccctctgctgcccctgcgaggtcctcccgcaccactgacgtccaccacagcgcggcgccccggaactcgtcggcgacgtcctgcccgtcgcgcatgctgatcacgacgccgtcgccctcggacgcgccctcggcgcggagctcgcgcgcctcccccgcgcacccgtcgctcaggtacgccttcacctcctcgtaggtgctgtcgccgctgtcggtgacgcggccgtaccgggagtagtgcgcgctggcgccgcccggctcggagacgtcgacggtgacgtaggggtcgacgacggcgaggaggcgccgggcgtgccggcggaggaagaggttgaagtaggtcttgaacagccgccgcggcgcgtaggcggcgagcagcggcgccaggaggagccacagcgagccgaagttggacagcaccgagcccaggttggcgaacgcccagcgccgccactggacaactttgcccgtctcggccgagagagccatggacggcggcgacgacgtacggcaccaagcggtgagttcgcagcacacgggtctctggctctctgtccgcgcgtgcagagatttatgtagcgcgcttctgccacatttatatctttttaaagaaaaaaaaatcccacgatctcatttgaccatttattacctgctagttaagcttaaaagtaaccactcgatgccttctctccgtgataaaatatagcaactactccctccgtattttattttaatgtatgacgccgttgattttttgataaacgtttgaccactcgtcttattcaaaatttttatgtaaatataaaaataattatattttcattaaaattttgaataagatgagtggtgggacgttgattaaaaaatcaacggcgtcatacattaaaatacggaggaagtggtatttaattaaatgccatctaatactacgaatttaaaaaatatatatatctaccactattaatttttataattcgtgtagttaaatatgctaattatatattatataattattttctatggtgaatttaaaacaaatataaatatgatgatgttaaactatataattaagtttgtaaaaattaatgagcaaagattaaaatgtttgatttaaaataaaattaaacggcaaataattcaaaatgaagaggatagctcattgagttactccatctgtctcaaaataaattaaccttgtacgtgatatgacacatcggttggtttattttattaagggagtacgatttatgacaatgaatacctacccacaaataattgggagagactacagaatgggatcctgttagaacgtgatattttaagtgactcctccccacttccacgtgtgctctctcctgatacgtgatacctggtaccttaggtactagttgatacctggtacctttggtatcggctgggtaccggctgatacctagtatctagatactttagtatcggctgggtaccagctgatacctgatacctagatctttaagtagtgactccttcatggtacttggtaccacctggtacccggtacttgcgtactgaatggtacttggtacctggtaccctggtatcgagctggtaccaaggtctgatacctaggtactaggcgtgatacccaaagagatagtgaacgaagccatcccagcttcgcttgaggcggagagacgctgcgcgtcgccggccaccgcggctgctactcgcacggggcaagaccacggcgacgcaacacgtggcggcgcggcacctggaccacaccttcgagaagctcgcgtcggcgcacctccagcttgtgatggcggtgccgttggtggacgcgttgcgcggttcgccctccgagctgctcgcgctccccgaccacgcccaccacttcccgctccagctccaccggcgaggcgcgctccctctctccctctcactcaccgcgcccgctgccgagctcctcgctgtcactacctcccccgcagcggcggccgccggctccggcaacggtggggtgacggtgacagggagagctacacctcgagtgccatctgatttggaggaggggagtgaggtaggaggaggggatccgaataatttgagagaggagggtgaggtaggaggaggggatcgatcgatttgggggaggggagtgaggtaggaggagaggatccggatgatttggggaagaagggtgaggtaggagcaatttggattagtattccgtcttcactaaataccggtgcgtagattttctctaaacaattgtaacatgtttgtagaaaaaccggtctttaccgtctaacccacgcggacaagtcttctcttcattgagcgtcaccactcacctcgaaggtaccaaacaaatacctaaccacaatttgttttttacaccttgtcttcactcatgacaatgacgtaaagttgtagtacaacaatttccccggttgctagagttgacttgggtgctcatagttaatcaagaaaattggagattcatatggcgtgttctctcatgattttgtatcgactatttcaaactactccctctttaaaaaaatcaatctaagaagatgtgatctctcctgaaataatgtatctgaacatattagtgatgngttccagtcgatctgcaaatcaatggcgcgcg

SEQ ID NO: 87540 - DNA, 806 bp, Oryza sativa
  unsure (1)..(806): unsure at all n locations
tgggccattgatggctgctgtacnctatcagaacagcaaattacaagtacaaggaaaattactttttctcatctggagttgacaaaaatttaaataaatgtaattcagtgctggagaaaaaaaaaatcatatgatcatctaaacagatgcagaaaaagcatttgacacaagtcaacattcttataaaaactttcaacaaattaggtatagcaggaatacttctcaatataataaaggttatatatgacaagaccacagcttacatcatacccaatgatgaaaagctgaaggctctttcctctaagaccagaaacaagacagggatgctcactctcaccactgctattcatcttagtgctggaggtcccagccggagcaattagacaagaaaaagaaaatgcattcaaattggaaaggaagttatgaaactgtctctgttttcacatgacatatatcttatatacagaaaattctaaagactctaaaaagactgttaaaactaacaaatgaattccgtaaagttgcaggatacaaaatcaacatgcaaaaatcagttgtttttctacacactaacaaggaactatccaaaaaagaaatttagaaaaccatactatttacaatagcatcaaaaataataaaatacttcggaatagatttaacaaaagaagtgaaacatttgtacactgagaactgtgtaagtcattgatgaaaggaattaaaacacaaacaaatggaagagttaatgttttaatggattggaagagtcaatacttgtaaaatgtccataccatccaaagtgatgtgcc

SEQ ID NO: 87541 - DNA, 708 bp, Oryza sativa
atgataagctgtgctaaatgcgagataacttcctagggcttcatggactttctcccagaaatggtaggtaaattgtgtgccccgatcagatataattttctttggtacacaatgaagacatactatcctggtcatgtataactcggctagcttagcactgctataatttgtcttaacgggaatgaatctcgccgtcttggtgagtcaatccacgctcacccaaatggaatcatgtcctgttgcggttttgggcaatccaacaataaaatccatacctatctcatcccatttccattcgggaatcctgagaggttgcaacaaacctgccggcctctggtgttcagccttcaccttctggcatacgtcgcagagtgctacgtattcggccacatctctcttcatgttgggccaccagtatccttccttcagatcttggtacatcttcgtacttccggggtgcaatgaatatgccgattcgtgagcttcctttaaaattaatcccctcagtccaccctgttcgggtacgtaaattctctttttataccatagaacatctttttcgttggttgaaaattcctttgcacgtcctgcagctaagcgttccttcacctctcggacttcctcgttgtccttctgggcttcttctatttgggttctcaaaagaggttgaatgtccagggtgtttatctatccacggggtactatatg

SEQ ID NO: 87542 - DNA, 2179 bp, Oryza sativa
cagcgaaactaaagacaagtagcaacctgctgatggacgccatgtaccctcatcgatcgagtggggccttggcttgcgacgtcgcagtccctgcactacaaaatgcactgttgtcggctggcaagcgatccatcgatcgatgaacattgcggatctaaacaaaactggtatctttcactggtggagaaaccctttgtagtctcggttcataacccccttttagtcctggtttccaaaccgggactaccaatccgggactaaagatcgctatctttagtcccgggtgaaataaccgggactaaagatcgatctacaccaaccgggactaaagatcgagctgaccttttttttttttcatggcccggttgctgcatggcatatatatgtttcagtacatatatgcatatatatatatatatattatattatatttatatatgtttcaatacatatgtacatgcataatatatatgtatttatacatatatatgttatgcaaatgcatatgtgtgtgtatgaccaaaatatatttacattatagaaaatgtgtacacatgcatatagaaacatatatagtcatgtattaattacaatccattgtatgtcctagctagctacgatttcgacgtagtagtagtcgctagctcagaagctaaggacctatgaattgtgtttccgtcgtagaattcacccttgggatcaaggatttgttcgttgatgaatcccatgagttgttgttgaaccgccgcgataaattcctttgtgcatggtcaggttatccctcatgcgaataaactatatgaatgtatgaaattgattagtaattaaacaagaaatcgatacgtaatgaatttttgaatttatttgtacgtacattgagctctcttgtggtgatgatttggtctgcaagacagtggcaatattcgcacacgtaatagccgcacaagttagttcccttcttttgctttgcgcactacaaataaatgacaaacaacgagagatctaattaatatacacttgtatgtatttgaatcggaaaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacagaggaacttatgacggtacctgtctataagttcgaaaaccttgtcaaacgtagactcttttttatccattgagtcatatatgttgacagtgcaggccgacaggtcgaagagtaaaagcacccagtggaatctgcaatgtgcgtgggatgcattacatatgaaacacttagcaagttcgtacgggaatgaaatttggtataggaagacagtaaaattaaactaactctgtgttgtacggcaacagtatgaacgtcttgtaatgctgcgccttcaagagatggacgagattgtcctctgtggcttgcggatattggtcgagcattgcgacgtttactttccgagggtcgatgaatccagtatcgaaaaccccccgccgtcgggccctttgaatctccattctacaacgataaaagggagtatattattttctatagtctacttatatacaaggacctaattaattaaaggagacgcagtaagaaatctaactgaacgatatacttacaaaatccagcaactcataatagagacgtcgagggcgtccagctggtatagttcgtagattcccttgaaattgatccaaagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattcttctatcgtcatttctttaccggtcaccaatggctcgatctcctggtttggttgctctccaagctgagggactggtttagactttccagaagatgctttcttcagcgttcgctcatagtccgatagcttaatggcctccttggcaggtg

SEQ ID NO: 87543 - DNA, 1846 bp, Oryza sativa
gacggcgagattcattcccgttaagacaaattatagcagtgctaagctagccgagttatacatgaccaggatagtatgtcttcattgtgtaccaaagaaaattatatctgatcggggcacacaatttacctaccatttctgggagaaagtccatgaagccctaggaagttatctcgcatttagcacagcttatcatccacagacagatggccagacggagagaaccaaccaggtcctggaagacatgctgagggcttgtgctctggattttaacaaggattgggagagatgtttgccctacgccgaattctcctacaacaacagctttcaagcaagcctaaagatgtcacccaacgaggcattgtttggtcgacgatgtcgtaccccgctaatgtggtccgagactggagaacgggcggtatttggacctgacattattcaagaggccgaagaaaaggttcgcttgatccgcgaccgtctaaaaatagcacaatcacgacaaaagagttacgccgacacccgaagaagaaacctggaatttaaggagggagattacgtttatctaaaggtttctccgatgaggggaacaaaaaggtttaaggtcaaaggaaaactggcaccaagatatgtgggaccattccagatcattgccaggcgaggagaagttgcatatcagatacagttaccagagaatatcgcggatgtacacccagtcttccatgtatctcagctaaagaaatgtttacgagtgccagaagagcaagctccgctggaagaaattcacattagcaatgatctcacatatccagaacacccgatccggatattggatgaagccgaaaagaggactaggagcaaagtgtggcatatgtacaaggtacaatggagcaatcacactgaggatgaagccacctgggaaagtgaagaatttttgaggacggaatacccgcacctattcgaagactggtaagaaatctcgggacgagatttatttaaggggggtaggtttgtaacactctgaaaattcgaccgacaaaatcaaaactctaaaaatacagatcttcaaaaaaactttttaaataaattgcatcatgccaattttattcgacgattttattggattttgatttcggaattcatcgatcacaaataggggaaaattaattaggaattaaccctgcaattagatttggttaaagaaataaataaattataatttaaaataaagattaggtgggatagaaataaataaaatattatcgcgaccatatttggatcaattaaatttaaatacgatggaataagaattaaccctaaataaaactcaaataaattacataaaaataaaataagagtaatattaatctagggcaaattcattagttgagataatacacatattgagtaaacttcatttatgcaagatttagaaattataaaatcaaattcatataggaaataaactaaaattgggaaaaataggaaaaagacactattcattagcctctaggtgttcgacgaggctccctagccccttcccctcccctgccatgcgcgcctcgcgccccgagccgtcgccgtcgccgcctgccgccgtgccgctgtcgcctgccgcgccgcgcgccgctcggccgtcgccgtcgcgcctcgcgcctcgtcccgccgcgcgccatcgcgttgccgcccgcgtgtcgccgtcgcctgacgcgttgccgatgccgcgctgctgcgcctcgtgccgcgcgcgccctcctcgcgccccgcgccgccgcgccgcgcgcccgtactgtcccgctgccgcgccgccgctgtctgccgcaccgcgcgccgcgcgccgtcgcccgtc

SEQ ID NO: 87544 - DNA, 1134 bp, Oryza sativa
aaatacaggtatcccatatccttgggcaagtcgacagaggcagcaaccttactatcattgaatattacccacctcccgtctttgaggacatgggcaacgtagtgcccacaatgggtagaggtgcccatatggctcacaaacgccatcaatttgtatcctgcagagcatagagcaatgttaataaaccaagaactgcaaaacacacacacatactgaagatagataatcaaccatctagaagtattgaacccaatggtttggaaacacctacagtctgagacaagtttggagcttacttttatatggtttggctaatcattcactaccatggatttctttacatatatcttaaaagaaaaaaaaattaaaaaagtaagttttcttggaaacttagatgggacatgggtcatataattgtaaatccacatccatttcttgacgataatgtgccatcgttattcagaaatgctcagggcatgtacaaagtcatctttcaaatgttgcaaactacaaattcaacattaacagttcagaatgttaatgaaattagctcatgagattggaagcttggcactagaaacagtaaaacagaaggggtagaaaaacttactgccacttccatctggtatgtgtgcatcatcatcttccatattgcttgttgaagaatcagtaggtactgagctaaaagcctcagggtggctaaaaatccagtctgttgctctctcgatatttccaccctatcacattagaagtacaaaacataagcctccgatcaaaaaggttggttgcagacaacgggaaaggaacaccctaagacagttttgaaaggtcattatatgaaaataagcaaatatcaactttctgagaggtattcaacattgcgaactgtacaagaaaatgtaaaagatcaactatcatggatgaaattaaaaacagaagattattacagaagctgccaaggcctttcgagcaacatcttcttgaaatccgaaggaaacaagagtttgaacgctagtttcatcaacagtttgttcagcagcctgtgaatctttagatattggatcgttgatatctgtatagcagaaaggtgattaaagtttgtagcggtcaagttacaaattagggctgcaggaa

SEQ ID NO: 87545 - DNA, 669 bp, Oryza sativa
ttagtttagcgcaagttcatgtacaaacacaacaaatccttcaaattatcgaaaaataggtatttcgcataccaatgagaggataattaggcctgagcggccggtttgcatcaagagatttgagcaccgagctatcggatcccctggagaaacaatggcagcaggggcaaggccaactttcttggtcaaatcggagaaatggtgcggaaacgcgtgcgcctccacagcctgcatcgaggtgagctcctcgctggccccgtcgacgaacaagaacgtgaatgctctgttcctgcaagtctcagaaggattcgatccatgatgcatcggtaaaaaaaaacccgcagagacacattaagctgttcgatgcggatgggcgaacctgaagtcggcgttcttggaggcgaagatggagaggaactggttgacggagatgccgagctgcagatcccaccacgggacgaggaactccagcttgttgtgcttcttcctgcacacctgcgcctgcacgatcctcaggttgctcggcaccgtcctcccacctcctgcgagcaaatacaaaaaaaacaatctcgttagagatcgaaggaatgatgtggaagcggatgttgggatgagttcgttcgatctgcgtttcttacgggcgcaggggaaccagtggtcgatgtccca

SEQ ID NO: 87546 - DNA, 553 bp, Oryza sativa
tttcaaaaagcagaatatatttttttcctgatagagcattatgtataattcactttctccggtatgacatgattttcacagaaagtgcaacatgagttgctaactcaatacgcaagtcagctcctggagaaggagcattctggatgccatgcattgcttcgtgatgacaaggtttcttggagaagctccacgtctctcaacagtttatcaggaacaaatgaagtctgctaacatagcatcttctgttttactccaggttgatgatctctctagaatgtacaggctcttttccagaataactcgtggtttagaacctgtttctcaaatatttaagcaggtattttgtttttcagaagagagtggtttatttcttaaatctattttgatgatgtaatggaatgttgcttctgtgtagcatgttactaatgagggcactgccttagtgaagcaagccgaagatgctgctagtaataagaaggtgcacagtctatatattaacttttgtttgtattaatgttgtcttagtacattcatcttattgtgtacttggggt

SEQ ID NO: 87547 - DNA, 648 bp, Oryza sativa
ccagtgattagcagtagattagaggtattttccacttacttggaatggactctttgaataccaagtggatgtcgcagtggggtgatttggacaggaaggccgcctgccccatgtactgcagcaccaagcacgggtagatgagccccacgaacgcaacctgtcaacaagtgtacgtacgtacgtgtcaaacaaatgtcaagatatttaacctgctcttaaaatcaatctgcattatattaaacgagacgcagtactgcactatcagtgctctgacagcaagcataaacagacacatatacccttatggatgcagctgtgaagtggccaagatccccatacatgggtttggtccctgcacatacatacatatatatattattataaaatatgtagttgatgagtcgcagtgcaacgagcaaaataaggtttgtttgcctgtcatggagaggagaatttccccgagggagatccagccgtccttgccggtgtgctggaagaacctgacgaggtattaaggggagagggcgcgcagcacccttgggttccacaccacgatgttgtagacgccgagcgcccccaggaggaggagccagacgatgaccaccggcgcgaacaggaaacccccccctgtgcgtgccccagtgctgg

SEQ ID NO: 87548 - DNA, 707 bp, Oryza sativa
ccgttgagactgatgacacgtctactatagggcgaattccagctcggtaccctatccgattacgaagtcttgagttttcccgactgaacttttccggtctgcctgccattcaactgcgtaatctggctcgttatgctggcatggcgtcggtaaaatatatcgctcgaatgccacagcagagaaagcttgctgtacttactgcattcgttaaagcacaggaaataacggcattagacgatgccgttgatgtgcttgatatgctaattctggacattatccgcgaagcaaagaaaaccgggcaaaaaaaaagactcaggacactgaaagatcttgatcaggccgcattgttactggcgcgggcatgtgcattgttgctggatgataatacagatgtcccagatctcaggcaggttatcttcaagtgcgtacccaaaaacagactggcagaatctgtaagcaaggttaatgaacttgctcgtccacagaacaataatttccatgacgaaatggttgagcagtacggtcgggttaaacgttttcttccggcggtgttgcgggacctgcatttccgtgcggacccgcaagtggacatgtcctggctggattcatattctgcaaaactgattggtcgaaaaacgccatcttgatatgcgcctgacatataaaaccgtcctgtgaacccttgtatacaagccgagtacggatcc

SEQ ID NO: 87549 - DNA, 701 bp, Oryza sativa
agcagtgtcattctgcagcaagaaccaagtgtcaaattttacaaggtcgtacaatttgatccagcaggaaacaaaaaatgttctgcacgtggtgtaccttgatggacgaatgatcccactaacattatccaatatcggcaacttcactcttccccctcgatagatcctcaaatgcctcagaaatgcctttcagaaaaataaaaacagcaaataagcacatctagagctcatttgtgaacccactatttacagctttttacacagcaattttacccagagtaaaaaaaaaaactaatgtggttaaaaatcatgctactgttcaaaacagctagtagatcattgctgcagagctgagacaaaggaggggaaattccagtggtggattggtccaacctctgtcatgttgcaaatgaagtttgggatggttggcagcgccctgctcccgacatgcacgtatgcgtccactgtcagatcctcgtacctcacttcgatcttggggaactctatctgcactctgcaaccaacaaaaataaaaaaaaatggagagcagcacagatgcttcagatcagcccatgacaagtttaccaacactacaagcatacaaacaaaattctacaccaaaatccaaaccaaccagaggagacgagcgatttacagatcctacaagccgtagctgaaattgtttcgtaaaattacagcaa

SEQ ID NO: 87550 - DNA, 1389 bp, Oryza sativa
tgatgaatcccctaatgattttgatcaaaatcattaagttaaggtagatacacatcttgtcatatgatcaaatggtttcgccaaaaatcaataatcagacaacaaaatgtgcgaactcgatattttacacgactctctttaccaattctgccccgaattacacttaaaacgactcaacagcttaacgttggcttgccacgccttacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatatccgtgagcaaaaacggcttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagggtcgtgctcgtgcttgcccgtagacaaccgtgccatgccagcacaacccacaggccagtg

SEQ ID NO: 87551 - DNA, 574 bp, Oryza sativa
agaggccagatccttactatctccagaacagtcagcatcaacatttgccaatcagcggccgctcggaacaggaaagtatcaggaacagaagctggatccagctcataaaagccacagagtttgccaccgttttcttttgtcagccggaaagaaggtatcaggtgagaaaaccttatgttttcatttgtaggtatctccagagtgccccttacactgtcaggcttgaacacagctctgtagccatctactcgggtcaaaagtaagacttttgtgctagcttcagtgcagtcagtaatttcaccaattgtgtactcgaaagtatccttgctggaaggaacccaaccaggtgcccaattattgtagatggcccaaatttcccctacttgtggatgaatttcaaagtatcgtttccaaccaacttggctagtttctactaaatgagagaaagcatcattcgtgtctaactttatcctccagttgcggattttaaaagtcccacagctcacaggaatattctgctctaaccacatattctcctgctccagctgagggcagacttcgagccaagtcaaat

SEQ ID NO: 87552 - DNA, 691 bp, Oryza sativa
ctgcaaattacaagtacaaggaaaattactttttctcatctggagttgacaaaaatttaaataaatgtaattcagtgctggagaaaaaaaaaatcatatgatcatctaaacagatgcagaaaaagcatttgacacaagtcaacattcttataaaaactttcaacaaattaggtatagcaggaatacttctcaatataataaaggttatatatgacaagaccacagcttacatcatacccaatgatgaaaagctgaaggctctttcctctaagaccagaaacaagacagggatgctcactctcaccactgctattcatcttagtgctggaggtcccagccggagcaattagacaagaaaaagaaaatgcattcaaattggaaaggaagttatgaaactgtctctgttttcacatgacatatatcttatatacagaaaattctaaagactctaaaaagactgttaaaactaacaaatgaattccgtaaagttgcaggatacaaaatcaacatgcaaaaatcagttgtttttctacacactaacaaggaactatccaaaaaagaaatttagaaaaccatactatttacaatagcatcaaaaataataaaatacttcggaatagatttaacaaaagaagtgaaacatttgtacactgagaactgtgtaagtcattgatgaaaggaattaaaacac

SEQ ID NO: 87553 - DNA, 704 bp, Oryza sativa
ttgaaagattacagaccaataagcctttgtaatgtgatttacaaggtgattgctaagtgtttggtgaataggatgcggccgttacttcaggatgttatcgtgccagcgcaaagcgccttcattcccggccagatgttcactgacaatgctctcatagcttttgagtgcttccatgccatcaatcggtgtaaatcggttgagtctcaattctgtgcttacaagttggaccttacaaaggcgtatgatagggtggattggagatacctagagggagctcttcttaaggttggtttttgttctcaatgggttcagctattgatgacatgtgttacctctgttagctatgctgttcgcttcaacggatctatgcttgaatccttcaaaccgaccagaggcctccgacagggtgatcccctgtcgccctatttgttcctctttgtggcagacggtttatcaacggcgctgagtgaagctgaaagatcaggacggttacaacctctaaaagtctgcaggagagcccctggaatttcccatctcttgtttgcagatgatagcctgttgttctttaaatcaaatatggaacagactaatgtggttaagagtgctcttactttgtatgagcaaagcacaggccaactcctgagcccggccaaatgttctttgatgtttggaaagcattgtggggatgctctgcagtctgacat

SEQ ID NO: 87554 - DNA, 597 bp, Oryza sativa
ttccttaactggcattctaagctataaattaggagcaagtttgaatacagcaccttctttttttttttgtttttatgatgttttaccatttgattataacttttcagggcttagaccagcttagatctgggtttctccaacagaaatcttttatgcagtctccccaaccattgcaccatctacaatttctcactccacaacaacagcagcttctgcttcaagcacaacaaaatatgacatcttcacctggagagatggacagcagaaggcttcggatgcttttgagtagccgaaacattgttcctgggagggatggtcaatcaaatgcctacacggaagttattcctagtgttggcccttcattgcaaaatatgtgctcacctgtgcagcgcatggagacagatatgctgatgaaggtaagtttcacttgtatgttttactatattcatgcatttatttatttgcgaggatacattggatgtaagtaatagtaccttgtaaaccaccgggttatgcataattttgttctcaattgatatcttatatgtacatagattatattgtttaattcttgtcagtgatcagtaatagaatttc

SEQ ID NO: 87555 - DNA, 1332 bp, Oryza sativa
cgcagaagccggcgaccatgccggcgacgacgccgaggaagtcgtggcggaagccgaagtggtcccggaggaagtcgacggcggtggtggtggtgatgccgtcggcgagcagcagcggctgatccaggtcgccgaactgggaggttagcaggccgtacagggtccatgacaccgggttggcccagtaataccacctccaccacgcaggaatcctctgcattatgtttaagcccattaatcattagccactttaatcacgtcctaatttaaacaaaccattattgcttcccaattgctaaagtggttctagtacatgacaagtggtcactgtaggacaaaaaaagttactggtgggtttggtgaaattattaggggcactggtatatcagggcactcatgctccattatagtacaatgttaatagaaactaaaaactactatgcaacatagcagcattttagatgatgtgctaaggaattataaagaaaaaagagtgtctcggatgagacattgcatatatattcaaaccaggaaaatagatatctcctctaagaatttctgatgaaatttgcgaagggagataattcatttttggccccagtaataaataatatgcattggaaacactatttccatagctatatatgttaatgtgacaaaaaaaaataaagatatggataatgtgcactggaagtggccttatggattggaaacactatttccatagctatatatgctaatgtgacaaaaaaaataaagatatggataatgtgcactggaatatggattatggggaaaacagatcatgggtccagtacaattagaggacgttaggtgcaaattatgcatggggttcctgttccttccgtacctttcttgggatcatgaacccacagaagagattccacagcgtgtagaatggagcagcaataataggcgcaacagtgtggttgggagtgatcgccgttgtcatcatgccatagaaagtgaagtacagcaaggtgaagtacatgaagaacaggtaccacaagaacttcactgctgtccactcgaacgagcccaagctgtagaaaatcgtgccgtagataagtgactgcacaagaatgtaagggaactccactgtaacctgcatgccgaagaacagttcgattgttagccttattatggtactactacgagcatcaaaacatgatgagatgacaggagtttttgacagggaaaattaccagggagaatgcaaaaggcagtgccgagtacatcccagctgccctctctctgtacgagacaaatctttcgatggaaatcacaggttgaacagaggtggcgttagtg

SEQ ID NO: 87556 - DNA, 845 bp, Oryza sativa
gggaattgtatctgattgttttgatgtttttgcagtggaatgcgatgaattctatgcgaattcgctcttcgtcgtcggcgagtttggtggcaacgactacaatgcgccgctgttgcgggaagggcctttaggaggcctacaagttcatgccggatgtcatccaggctatctccgatggcatcgaggtagaaattcaatagcttcgttgtgtcgcctatttgttagtggtcatgtggagaatgtgatttcaattatacaactgttcgtgtttggtgcagcaattgattgctgagggcgcaagggagctgattgtacccggtgtgatgcccactggatgcttccctgtctacttgaacatgctcgatgagccggccgatgggtatggcccccagagcggctgcgtccgtcggtacaacacattctcatgggtgcacaatgcacatctcaagcgcatgcttgagaagctccggcccaagcaccccaatgtgaggatcatatatggcgattactacacgcctgttatccagttcatgcttcagcccgagaagtttggtaagttcttgagctctttgatagttagctagctcaggaagcatcagttcgttcttatcctttatttcacatcggtactaaattggcttttctagcaaaataactgttttttagctcttgctgctctaatttacttgaacagatcaagtcaactgatacctagagtcaacttttcctcctgtcacccttgaaagacacaatatattatttttagatagttcagatctgggtagaggtgcataatctctctagtagcacaatgcaatccttcttattgcagtaatgatgggtca

SEQ ID NO: 87557 - DNA, 802 bp, Oryza sativa
aataggtaggcaaatatatcatccaaaccagagcaatccaagaggtcgaatgtcctgatgcagccttgaacgacgccaacgtagacgatacaattgcctggaccggcggaacattggacttatcccttcgccggagatcgaagacgatgcagccctgcgtcgggtgccaagttttgccggaacataaaaacaaaagtagaagtaaaagggtggcgatgcgccgaattgtattgatcgtagcaatagattacatagacccgggtgtacatatttatacccatgggttgatacaagtccttgtcggacaagaaagaaactttcctaaagataaaaggaaaagataaagtccttataggacactaaacacactttcctaaagataaaaggaaactaacaaactattcctaattaatagataacttgccatgccgcattctctttgaactcagtctctggataagcttcttttagtagatcaatttccttaaccgaatatagcaagaatccggcaactgacgacttgacaattctcatcggctaatctcaggacttcgaagccgatgctgactctcagccgatgactactccgggcttaccaaatttcactgttaacacaaggctagggttggcacgtgacatttgaggtgaattgcggccaccctctggagctgggaaacagatggtgtggtgccaagctaccccttgtccacaatacggggaacccttgtaccatatcaccgacatattggatttcattttgggattctctgggcatgctctataagtttctatgctgcactga

SEQ ID NO: 87558 - DNA, 5005 bp, Oryza sativa
tcactcccgaacacagccttagtttatagagaaagagatgcaaaaactaaagtggagttcaaatgcacagtgaaccattcattacttagtctaaatggcccaagttgataatcaatgcaaaacaaatgtaaaaggatcataacatgatttatataattatgtgtaagcccaacaaaccttctagcttcctcatctctcatcttagcatccatctccttacttggtggatatgtcggcaagcttgatggatcacatgcataaggctcagttgcaaagaactgcaatactcacagcataaaaccttactacatagtgatagcctaatagctcgtcaaaataaaaaaattaggactgtataccaagggtggagctatattattaaataaataaataagagatttcctacgtactgaacattagggagagtcgtaccaagcgcagcactaaatattgaagcagaaaacataatgtaacccattaaatcatgtggtctagaaaattgcaatggtgctaataagtgggcatagatctccagatatcacatgtgcatgaaatgcagatattaaatcgacaattctaaaacagaaaaccttttggaacctatactggaagtcaaagtagccatttagaccttcataaagatgaggtccttggtacaaaccaaatctaaagatttaaaaacataacagatcttttccatttatagttacagtacattacacatctgaataccagccatttcttggtatttgagtgtgcaaaacgtcattttattggtgttgctccttgcattttatgtcatagcactactcatgtaggatatctacgctcagattattaggagaaaaggaactagattaatcaaaagatgccacattgtcaaaccagcagtttagtatctataaaagcttccgaaagactgaaacaataacaaagatggattgttgtttaaaaagattcttgaacacttttgctcatactgcaggatttttttttcttctgttctcaagagtatagaagtgattccacatagaggtgatatgtatcaaaggaccacataaatcacaggtcaattatgttacttcacactaacattctctgttacaatgctaaggaggaaaagatatggacatacttcactttgcaaggcagatgtagcagtttggcgctcagctggatcaattgcaagcagagtttcaaccaacggcaaggaagatggaggaaaatctttaaatgcttctctgatacaacgcttatagggctgctgaggtttgaatattgtagcatgtggcagcttggactttttccaatactcctctgagggggagccacatagcttgaaaatcttgtgcaactgttctacctgatcagttcatattgcacatattaaaattagaaaatggcaatcaattttatgtaagcaactaaagcatatatagcaacacaagataaaaacaataaattaataaacatcacgagttcaccctagatgcatggattcaaccagatagattagaagaactgaatatttatggtggtttgatcacctgatgaaacaaaatcctactcgttgtgtcacgatcaaaaagatatataagtaagttaacaattgtacgaattccaaataatcctcatcaagcaggtccatattcatgttatcttaaagaaacttcaaatgattaaattcaggtttgactatcccattaatagcatatattgctggcaaacagcacagagttttgctcagattgagtggtttgtggtactataggagttttaatcatagaccatgcctaaatatttagcttagcgatcatttcattttctggacatatttaataagcctatgtgtaccttccagtgaaaatatcatggcaggacaagttatatatagcctatatgtttgaaagttttgaaaggccttataaattggcttttgcattttatgagctataagcagaaccaatcagcttatgaatcactgctaaataaggttcagctaatcactctatattgccagtggcatcgtcgatctgaaatacaggacttctcttttcacagaaccagaacaagatgattatgttttacatttgcagaattccaaatttactaatatatggcgatgcctgaaatgctctcgagaaaaggaaaaccatccaccaattatatataaattggtacattgaccacttattacttacatagcagtatgattttataagatgtaaactgttatacataatgtaaccaccaataaaacagagatactagtcaaagtggcagcttatctgatttccaacaggagtttgccctgcaaatgcacagagcaaaggaaactgacaaacctctatggcaatcatggattgacaactttctttaattttctcctgtatttatttgtaactattgtaaactatatatttatacattaatatatcgcagtaggagcctctcctgctgttttccgtcaaaaaagaagtggcagcttatatttgtcttgtgtttactcccgacaagtatggactttaaccttcatgaaattgggtttggtttcagctgcacctcagtcctctacaacacgtttttcaggttggtggagcaaagttgttaagggtgttcccaaagagccacggaagggattgaattctttgattatttagtaacttgggagattcggaaacactgaaacaattgtgtttccaatggaactaatcctaatgtggtggtggtgttgcaagctgtggctaattagggttggtgtttagtgggagcccatgagctccatcagtttctttgtaagttgcttaccccggcagtgagttagtctcagtgggtttgttggttgggcctcacttatgtgcgaggcttgttgggacgtgttcttggtgggaggtgttccttgacccttcctttgtactcctaaatatttctctcttcttaacgaaatgaagttctcttgtgttttcaagaaaaaaattggaaatggagaaagtgatacttatgtgactaacttagaacatctactacctcagttcacaaacatatgctgttttggatatccatgcagccaaacttccaacatatgtgtacattgaatacatgaaaaatcatacgtgcagatttgcctagaaaactacttccataataaaggatttttttcgtgtttaataaattaattgcaacaaaaattaagtggcagataagtgtttggaggtctgcattgaggtccaaaagaccaaaacaacatgtattaacgacagttgagagtactatactgacgaattttaaataacaggaataatggcacaacatattttaattccaaaagacgtatgcttttcaaggaagcttcaactgaagccatgtggataaccagttaaacactgatggcagtaccctatacaaaaataatagtcatgacatatacaacgaagtcagcatatcattcaaccccttcaataaatgacaacggcgtggccatcaatcactatcaccaaaacattaaaaaaagaacaaacgtagaagattaatcaacctagagatactacaatccattggagcaaacctagtataaaaagtcaacattttcaatacacaacagccaccatggagttttttttatataaatagtacaagttgacttttggtaccaaatgagatttcgatattggattgatagaacaagtatggtccccaggattaccaaaggaatagcatataatgaagagtagaaattgtcctatgactcacctcagtacgcccaggcatgatgggcttcccatgcaagagctctgccagaatgcacccggcactccacaaatccacaccaacaccatagtctgtcgcccccaacaacaattcaggtggccggtaccacaacgtgaccacgcggctcgtcattggtcgtttatgtcgtgggtcaaagaatgttgccaggccaaagtcggcgatcttaagaatcccattgttatccaacaataagtttgatcccttgatatcccgatgcaatacattattattgtggcaatgctcaagccctgacaatagctgctgcacatagcattttatctgcgagaagtacatcatcatcaaatttaacatattcccagcaagtattcgcctataaaacgagatagcacgggatccttaaacacctgcggcagagtaaacttgacgtccgggctcgctgccaggccagcaagggcatgctccatatactcgaacaccaagtacaggctgcatgacatccttgacgtgaccaacccctccagcttgataacattgggatggtcgagtttcctcaggatcaagatctccctggccatgaatttgacgctctcgggctcgagattgtcgaaccggaccttcttcagcgccacgatgcggccggagacggtgtccctcgcgcggtacacgttgctataggtgcccgaccctatctaagagtcaattgccggacagggaaggccaccaccacgaaacggcaaaatcagtactcgtatggtaggtaacaagtggcggatcgaaatttgcggatttccggggggtgctttccgcataataccttgttgagcttctcgaaggtgtcggcgcggcggggcgtccacccgcggagggcctccccggcgacggcgacgagccacggcggccaccccgcggcgagctgctctgcggccgctggcgcggggacgcacccctgcctgggccccggcttgcgtcccagcctccggcgcggccttcccctccccggggactggtccgccgcgggagagtccgtggagggtgccggcatcggggacgacctcttcttcctcctccccttcctcgccgccgccgccggtggcgacgacgacgggcgcccgaagacgcaccccatatcctcccctctactctaccaacccacctactactgcaaccctacaagcagcatctggcggcggcggcggcggcggcgggcagcgggcggcggcggcgaggggggagtgaggcgaggcgaggcgaggga

SEQ ID NO: 87559 - DNA, 1009 bp, Oryza sativa
gggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagactcaccctagactagtctaatggaattgaatagtataggtggatggttgggcctgttgcaacgtggtatagcgttggacagtggatgattaatattgattaattattacaactgttttactgctttcaacttctgtttataaatgcccgctttatgcaaatgaaccattatagctatcccttgataattccctgcatcatacccctattccggtatgacttgctgagtacagtgggtagtactcaatcttgctctattttccccaaaccccagaatttgagtatgcgtcagatggtggtttctccgaggagtaggcttcgtccgtgccgtcgaggatgcttgtggagtggtgttcccgctgcagtccaagtcaaggcttagctccagctatcctttaagttttccgctgcatttatgtaagacttttataatgtttgtaagacgtggatctgtatgtcaactttgtcgtttgtgtaccccggccggtcctggacggggattttaatgcacattctgcttggaattctattcgggaatttctgggcgtgacaactaatcacctgaataactcaataaactcattagtcccttaaccttattcatcattaatcaccaaaacccactaggggataaatgcaacttcacaactaaccttctcgatcgcttcagtcattgatcacccaagacacaccagatgatgacacatgaacacacaatattttttaacgaggttcagccgaagcctacatccccagggctctgattatgggcgcccatcccagtcaatac

SEQ ID NO: 87560 - DNA, 923 bp, Oryza sativa
ctagtggatcccccaggtattaaaggattttcctgggattaaatattgcttttgctcaattttaattggttaaaattatttctagagctctgaaaattccactaaaaatcttgttagcgtatttcgacatgtagaactcaagaaaaattccacatgccaaatccgattattatttgcattaattcattagggttttctcttgcttttacaccgatattttctctggtggattataaattcaatttaggcttgggaaagaacttcagggtgtgacaaacctacccctcttaaacggaatcttgaccccgagattcggaggagctggtgaagaggtgcggatgggcggcctttagctcatcttccctttcccaagttgcttcttcgtctgagtgatggctccactgaaccctgcagaagctggtgaccttattcctagtcctcctttcactggtctcaaggatacgaactggcttctccacgtaggtcagatcctcttggatgtcaatgtgctccgagtcggctcgttcttcgggtaccctcaagcacttctttaactgggacacatggaacacgtcatggataccgatcgtattggatggaagttctagctgataagccacttctcctcttcgttccaagattttgtatggtcccatgaagcgtggtgccaacttgcctttcgtctggaaacggtgtactctccggagcggagtaacacggagatacacgtaatcccctgcttcaaaagtgagttccctttgacggttgtccgcgtagctcttctgtcgagactgggcaattctcaacctctctctgatggttctgactttctcttctgcttccgttaacacctctgttccgaacagttgacgttcgcctgtttgatcccagaagagaggtgtgcgacacttccgtccatacaa

SEQ ID NO: 87561 - DNA, 1148 bp, Oryza sativa
cgctaccaaaccacgacagatgctagcattacaagttttacaacaagcccaaaagggtttttacttaaactggtccggtctgaccaacaagaagctagagaggatgtagcacagcgtgcgcagtgttcttctgttagtcactgcgggcaggagacccgtcggcaacctggagcgggatcctggaggcgatcctgaggattgcctgggggacctccggtgcggaggggatccatcgctgtcagctggcggcgacctcctgtgaatataaatgctttcagtgtatgaccagaaacccaagaaggcatttcatgaggtaggtactacctccatcccagaattaagttaatctaatactggatgcgacatatcctagtactatgaatctggacaggtactagattaagttattctgggacggagggggtatatttttatatatatcccataagtaacgcacatacgaccaaaatgactacatgagtatgcggaaaatattcgaatgctttcccctaatccaacagcaaggcacaacagccattcaatctttactggaatatcatacactaaaagtctatcgtatgctactttcaaccatttttgaggcgagaaaagcaaaccaatgcagaacttttgcattgcaaagagcaatggaagtaagaagcactcgaacttacttttcataaccattatcagcatcacgccggtccccatctttattggcaggagaataggatctccgcttcttgtctacttcatgttcttttggctgacgcctaggagattttgcacgatgtgtgtcttttctctgtggggatgcggaatagtcatctcgtcgtcttggagcaggagagtatgacctttaaagaaaacatgtaagtgagagaatcatgaatgaagataatggcttaggaatcacatatagcaacaaaaagtaaacaggaactataattggtctaccttgaccgtggacgaccacgataacggggagagcgggaacgcgaacgtgaacgagacctccctgtaagaacagatggatgcctcagtaattcggtgtggcaacaaaataaattagaaaattacatgcatttaagaaaagaaaattaacaaaaacttgagattgaccaatagtactaatctgaaatctgaaa

SEQ ID NO: 87562 - DNA, 658 bp, Oryza sativa
tcccaaaattaaagttcctagttgcatgatgtattttccacaacccttgtatatgatatattgtcgctaactttatgttattatgtttgtctattgatgcagcgcttgaagacccttcgagtcagaggtcacacggcgcacatactgttcgacgaccggtacgtcccgtacctacggcgggcgcagctcttggcgttcgtgaccatggcgcagcgaccggtgcctctgtacaacgccgctgctctgacggccctagtggaccggtggcgtccagagacacacaccttccacctaccgtgcggggagctgacggtcactctggaggacgtcgccatgatcctgggtcttcctatccggggtcaggcggtcacaggtgacacagcgtcagggaattactaacgagtcttcgtattcatttgctaatttttttgcaattactaatgattccatttaatttccggttacaggtgacacagcgtcgggaactggagggagagggtcgaggagtaccttggtctggagcctccagtggcacctgatggtcagaggcagacgaagacatcaggggttcctttgagttggttgcgagccaacttcggtcagtgtcccgctgaggcagacgaggctacagtacagcgatacagcagggcgtacgtgc

SEQ ID NO: 87563 - DNA, 1528 bp, Oryza sativa
atattgctgcctgtaaatttctgtgatttgatgtttgcctgtgttgtgtgcaaagttttactaaagtttagcagggctgggacgtcagcgccatgctaaatggcgctgacatgtccaaactcaacgccagtgcagaggtcccagcccagccatccagaaggcttgctgggctgggccacggccgaaacggccaagtccaacctcagcgccaggtgggctggcgctgagtgtcgcacggtcagcgccattatggctggcgctgaggtccaagcccgcaagccatccagaagccttgcttgtctgggccttgggggttgcggccaagtcccacctcagcgccagtccggttggcgctgaggtagctgccacgtcagctggggatcggcccggccgccacggtggcacaatgtcagcgccagtcccgttggcgctgacacggccaacgtcagcgccaatgtgtttggcgctgaggcgacggcctatttttggatgaagtttttggcaggggttagtttcgaaataagttttccaaaagggtcaatttgtcaaaaaacctgctagttatgtggaaattcagttccaggtattgcatacatttttgttaatcgattggtgctaatgaactgccgtgtcctaattcctaaaagcctaaaattaatatatgatggaaattcagttccagatgatgcatacatttgttaatcaattgagctaatcaactgctgtgtgacgagattacttgtgaggatatgaacatgcatgaggggatagatggcagatcgcatatgcatggcaaaaacatgcatatgattgttcatctgtatccacccatggggacttaactagattggaaggtaattaaccctgtcacatgaactactttgaatccttctttgaattgaaattcaggaaactattaccccttcgcaggtacgtatatagagctgatgctgatgctgcaacagctaattatactccgtttgttaatgaccgcgatccatacctgaatctgaatttctgtggaatttgcaggattcaaaatgtctttttatatatataaaaaaaaggactatgtttccgaatgctcagacattatcttctgcaacttagctattcattattcatgcagcgatcatgttgtgcaacgtagttacatgtggtgctcgtattttgggagtttgcgaccaatgtatatgcaatcaagttaattatagtttctgtagcactgcaattatcatttgttttgcgcgcgcatgtgaaatttgggcgaaaatggatccttgttttggggagaacattttggatcctcatttctcatctagctgtataaaatggatacgatattgcagcagcttgcaagccataatctgtctcatgtgtatatatgctcccaataccagaactggattgagtcatatctaactgattagatcgatagattgttacatacgtatgtcaaaaaaaaactcatgatcaataagcagagatgattaagtaggtagaagaacaaggagactgacttacatgg

SEQ ID NO: 87564 - DNA, 566 bp, Oryza sativa
ccatttgataacttttaaattaaaaattaaaaactttaatttttttttttgtaaagagatatgccaaagattaaaaaatcggaaaagaaacaccgaaaaagataaagaaaaaggcacccgtaagcaccaaaatcggaaaaaaaaaagtgcaaaaaaaaaagacaagggagctatagggtggggcagctggcgtgcgcgccagcaatttagctggcgcgtatgcgcgcagtagccaccccccacgtggcggatcatgtccgtcaggtcggcgtgcgacgacccgccttcctccaccgccgccctcgccgtcgcggcaagctccctggcgcgcgccctcctcgccacgccgtccgcgccgccgtccatcagctcggccaccgccttctccacgccggcgccggtgacctgcacgccctcggcctcggcggggaggtacatgggcggcgccgtgacgcccgaccggacgccgacgccgagcacgtcgacgagcagccgctcgctgctgaactggtcgaggatggtcggccatgtcagcgccggcacgccgcgggcgatggcctccagcg

SEQ ID NO: 87565 - DNA, 1333 bp, Oryza sativa
ccggcttggcgcaagaggcgcggccgatgaagggaggccggattggcgcgaaagacgcgtccggtggaagaggccggcttggcgcgagaggcgcggccggcggtggaagaagcgacctaggtgtgaggaagaactgccggtgggtgtggcgcgattttcggcgctcgaaggctagccggcgggggacaccggtgcaggggtcccacaggtcggtagagcttgtgtggtggtggggcatcggtgcggcagtcgtggatttgcaggatctcgtctgggtccctttgttggtctagtggcggtcggtcacgcttagcggcggccggtccggtcctagccttctcctgggcttgtgtgttggcgacgtcggtgtgggtggtggtttatttttcctttttcctggttacgaccctccagattgtaatcttgtaatttttttctactctatcaatagaacttcgcaccgtctcgtgcgagtcgttaaaaaaaaatgatggtactgggaacagatcacaggttgcaacgacaaatttatcttatacatagcaaaataatcccaagagattgacatgtgcgcatagtaaagatgatgtcgttttaaacaaccataatttggatggatgtacattcataaccaagtggcagtggcagtggcagaatttgttggtaggaatacctgaagaagagattagtttcccgtttttttgacaaattgacccttttcaaaaacttaattcgaaactaaccactgccaaaaacttcaaccaaaactaggccgtcggctcagcgccaagcgcattggcgctgaggttggccgtgtcagcgccaacgggactggcgctgacattgtgcaccgtggcggccgggccgatcccctagctgacgtggcagctacctcagcgccaaccgcttcggcgctgaggtgcccaacctcagcgccaagtaagttggcgctgaccttggctacttagagcccggccgaggccgccccagccagttcttcctccgttttttccccagccgcccgcctagggttcggtcgccaccgcgttctcctcgcccaatctcccccaaaaacctctctaatcgaaggtgatttgtgcggcattgagtttgggatcggaagagaaggtatacccctctataaaccctaagttccccaaagttttattggatattttgcattgttttggttgtagacgtggtttgataatagttggctaaggatggattattagatggataatatgggtggggatgaagtgtggaggtggcatatctttatccatttggttgttattgatacatttagcgaaatatatttgggatggatgtt

SEQ ID NO: 87566 - DNA, 1454 bp, Oryza sativa
cggcggcagcttgcgtcggagctcgaccaggtgcgtgggctttccaagcggctgaaggcggccgctgaggccatcgcggctgagtctgcagcggcccttgctttgcctgtggtggtgccgccgcctcagcttcctgttgggtatgcgcactcgcagttcgcactcgctgatcctgtgacgcccatacctggtcaagttgctggtgctattgttccggtccgctcagtgatgcagcgcgggccactaaccgtgtcagtgactcacacagagtccttcgagaaggagaagcggacaccaaaggcgaatcagttgtatcaaaattcagagttcttgcttgccaaggataagtttccgccttcagattcacatggtcgtaagaaacccaagcaccacaagaagaagcatcgttccttagcatctcatggtgctggttatgatgctgagcagaggctatactctcatgcttttaagaaatctatgtcgctgctttctaggctaatgaagcacaaatttggttgggtgtttaacaagcctgtagatgctgttgcgcttggtttgcatgattattttgctattatcaagcacccaatggatcttggcacgataaagacccgactcacgcatggccagtacaggaacccgagggagtttgctgatgatgtacggctgacgttccataatgccatgacctataatcccaaggggcaggatgtgcatttcatggctgagcagttgttgggaatctttgaggcgcagtggcccgaaattgaggctgaggttcagtaccttgcctcatgtccgccattgccaaataagtttccacctccaccaattgacgtgcgcttccttgatcggtcagattctgtaaaacaccatatggtgttggactccaagtcaaggccattaagtcatactcccacttatagtgccaggactccatcgatgaagaaaccaaaggccaaggatccggataagagagatatgacaatagatgagaagcggaagcttagtaacaaccttcagaatttgccaccggagaagcttgatgttgttgtgcagatcattaagaacaagaatctgtctgttagacagcatgatgatgagattgaggttgaaatagatagcatggatactgagacactttgggaacttgatagatttgtggccaactacaagaagaacctgagcaagcaaaagaggaaggctgagcgagccatgcttgcaaggcaggatgcagagttgcatgcacaacatgttgccccacaacaaccagtatgggcattcaatcattcctattcctattctataagtagcactatatagttaattgaattttatgattggtgctgaaagttacagtttcttggattgcagagtcaagagcctaatattggtgtaaaatctccaaagcaaagtaagttagatctgctctattttgtacttcatctaattgt

SEQ ID NO: 87567 - DNA, 708 bp, Oryza sativa
gccgcgctcgggttctccgcgcagggcacttcgcgcggttcacggcggtgagcaagctcgcgctccgctgcgcccggggctccgggacggacagcctctccgacgacggggcgcgccaggtggccgccgcgctgccgtccgcgcggctcgccaggctcaagctccgcggcctccggcagctctccgacgacgggctcgcgtcgctcgctggcgccacgccggtgatccgcaagctctccgtcgcgtcctgcagttttgggcccaaggccttcgtcgccgtcctccggtcgtgccccctcctcgaggacctctccgtcaagcgccttcgcggcctccctgacaccgccggcgccaccaccgccatcaccgaggagatcctcttcccgcccgcctcgtcgctgcggtcagtctgcctgaaagacctgtacagcgccctctgcttcgtgccgttggttgcctcgtcgccgaacctccggtcgctcaagatcttgaggtgctctggctcctgggacctcccattggaggtcatcgccgcgcgtgtacctggccttgttgagctccaccttgagaagctgcaggtgggtgaccgcggcctctccgctgtatcggcatgtgcaaaccttgaagtcctgtttcttgtcaagaccccagagtgtactgatgcaggcataatcagcgttgccgagaaatgtcacaaactgcgcaagc

SEQ ID NO: 87568 - DNA, 1104 bp, Oryza sativa
cttgtttatgtgctgttttggtgattttgcttctttctgtttagattccgacgtttccggagagtccgtttttgcaggagaagaatttgaagagttccaaggccagcaaggcaagtcacacagatcccaaacaaccctttgagcatgttgatcccgtttaaagctactgtttctattcaactattgcatttattttcgaatgtcattgggtgaaattaacctattgtttgttatagcccttttgttcttgattactttattccgtgataccttgggttattataacttgactagttgggctatatatattggttcagctagatattagatatgattgcttagccatgcttagaaacattagcacactattgggataacttttgactcactattgtttaatgatggcttaatgatagttcacgatggtcaatcgtgattggttaattaattacatgccaactaaaacctgataatggtgggttgtgagcacatggttttaagagtcgtgctcatgacaattaaggaccggttcacgagtttcggttgtgaaacttcacgagtttcggttgtgaaacattaaccgtgccaaccacaagccagcgtgggcaacggctttaccttttgtatagcatggttcattgcggagcaccagactgagaagtggcggagataagcccacaggggtcgctccagtcatcgtcgtcgctcaggaaggtcgccatcatggtcgccgtcatgtcgccgtcctcgtccgctcctccgccgttgctgtagaccgccggagcaccgtcgccgccgtcgacccgatcttctccgccgcttcgatctcgccgccggtgccgtccgttgatcttccgccgcttctttggtcaccggtgagttcgccgcgtcacgctctacgtcctggtgccctccgttctcgtcgtcgcgccgtcgttcgccggcgagcttgcgccgcccgagccgccgccggtggtgacgtcaccgctgacgtcatcgtggccgtttgccgtgagccggtcgtggaccgttcgatctcggccgtccgttttggatggatcgatctcggctgtacagttccatgaaccagcggcgtgcacccgg

SEQ ID NO: 87569 - DNA, 1022 bp, Oryza sativa
agttttgatgaaaccatattggttttggtggaccaactgaaccattttcccttgtagtctatttgtcatggcctttgagatgatttttactgaactattcatcaaggaaattggtctatagtcacttgcaaactagggagaagatttctttggcactagagttatgaacgagtagttcagaggctttagatcacaaaatcctccatggaagtcagcaaacaacctgtagaaatcctgagagataactggccaacatttttttaaaaaacacccattgaaaccatccggtccaggagctttatcagctggcaaaagagatataatgctatcaatctcttgagaggaaaaaggcagaactaagtcatccaaatcacccctcttatcaaacaactcagataagttaaaaagcatagagggatcttctgaaactcccagccttgatctgtaggcctcaagcaaaagggcagctttgccatcatgatctgagacttcaattccttctgaagaagtaagctgagtaattgaattttttctgaacctttctgtggccatagcatggaaaaaattagtattttcacccccaaactaagcccagttctgtctgcatctttttttccaataaacttgcttgtaatggagaagggtgataacttgctttttgacaatatttctaaaaataagttcaggcactgagagcaagcgacattcttccaggatgtccaagaagtgaatgactttatgacaattatcaataagcaaagagagtttcgacagcttcttactcaacattttaagtttcttctgagctgtttgaacttggctgaaatagcaagggcatttgaactcgcattttggattcaaagccaagcattttcaacctgttgtaggaaaccatcatgctgaacccagaaattcacaaatctgaacacattagctttagggatggacatcttcacctggatcataaggggcacatgatctaaaatgtgcttagaaagagctagaaccatagtgatcggata

SEQ ID NO: 87570 - DNA, 582 bp, Oryza sativa
agtggatcccccgtttttatttttggatcaatctttcccttttgtttagttttgttttagtgatatgatctgtagtattctgaaggtatctccaaaagcatgcggacatacacagggaaggaaagttgtctcaagggaggaagcaattatgcatataaaagctgctgtagatgccaggaaggagagtggctctgacattgttattgtggcaaggacagactctcgtcaagctttgtctcttgatgaagcattatggagagtacgcgcttttgcagatgctggagcagatgttctatttattgatgcccttgcttcaagagaagagatgaaggcattttgtgcagtatcacctggagttccaaaaatggttagatctgttacatgctatcttgcttatccaagttgtctgtgatggccatgaaacaattgtctcatcatattctgtgctatcttctgcaggctaacatgttagaaggtggtggtaaaactcctattttgagccctgctgaacttgaagaaactggttataaactcatagcatacccattatctctgattggggtatcaatgcgtgcaatggag

SEQ ID NO: 87571 - DNA, 843 bp, Oryza sativa
caaaatgctgagacaggctgctaacatgtacacaccagtggtctttgaaatttttcgcagggagtttgagatgtttgtcgattccgtgatttatagctgtggagaggatggaaatgcattcgaatatagagtagcagtaacagataggcctggggaacactatgttaggtttgactctggcgacttatctgttgtatgcagttgtaaaaaatttgaagcaatgggtatccagtgttgccatgtgttgaaagttctagatttcagaaatataaaggagttaccacaaaaatatttcatgaaaagatggaagaaggatgtcaagtctgcaagtacaggcaatcaagaacttctgaatggaggagtttcacaaattcccagctcttatttgaatgttcccgtgccatttatagatccacaacatgtgcaatcaaataacgagcttaaccatgtaagttgatcaaatataactattcattaagtttattttttatccttagtaaaggttgaggttcaatatgcgtgatcaactacaggacacttctgtttctaactcccaccagcaggcccttcatggaggtgcacagggaagtcaggtaagaccccttggtagaactgaactcacttgtgcaatacttaatttctaaaagcaatattggtgcttttgctcttctcatagtattttgtatgcaccgccttctgaggcaagcaatccattaagtttgtatgcactcaaattttgttagaaaaatattctcaagatcgccacattccatggttgtatacgatttgagaccactggtgacaaaagaatacgctcacatctttttgtgcatttctggcttt

SEQ ID NO: 87572 - DNA, 1817 bp, Oryza sativa
atacttttaattcaaacgacatgaaggtcaaagcccaaatgtaacaaatcaaacatacgggaaacatggattaccaggagaatgaagcagcacaaactggtaatccacaaccgaacatatcaaccacctaaaagcaaaatcgtcaagttacacgcaacagataaaaaatgcctattttttcaacagagcggatgcttatgagttataccttcataggtaggtctagccctgaagaggaagtatgcaatgatacacctagatcagccgatcctgtaattattcaaagaatcagcatttatgctacaacatggaattcttttggcaatcaactagtttaccaagcaaaagagggtagtcctctgatgcaagccacatagtccggaaggcaacacgcctcagtttcaacctctttatttgctcctcatacttcatcctatcaggtcctttgccttcaaaattgatattcatggatatcataacaatactcaaaaactggttactggagctaattagcagaatgcacaaaccagtgataatgaatagcatcttgggtagacaaattgcttcccgttcttgatatcaatccaaagctttccctcgtccattgaatcatcttctcctaaagttgcagcaacacgtctatcgtacataagtgctgcttccagaagtatgctgaaatcttcatctggtgtcctgaaatatgtggcaaaggaaaagattcttaattttactttcattttaaccacatgtgctgagtataaataatgatacaactaggatcacccagatcaagagaacagaccagcttgtgctgctgacaacaagagctggtctattaggcttcaagaaaatttcaccatcgacccagcttgtaaatacagtagtgttcctgtcttccacttctttctctgtgttgtaagagcaaacagtagaaactatatcaaagtgaaattttcttacagcaatcaaatatttagagtggctggagaacataccaacagaaatgcaatcgtcattgcccatagcactacaaatggaattccccaacctgctaaacaactatttcatctaatggtcagataggcagtacagcaaagatgaggaaataaatgaaaacagatgctcacctcatgtttctctgtcaatgaagcaggatggaaaaattcaggagattgatcgtaaagaactgttgcgctgaaatccaaccagttaagttaatataaactgtagctagcgacttcaaaaataaaagtagttgtgtgctaacacaacagccttaaacatgaaaagtgcctgaaagtttgatcttacttgattccccatttttgatcaagctcgtgtttcattgcttttgtaacacagaaggcaccatcagccatccgtccaaaatgcttctcgaacctagaatgcaaagaacacaccactatattaacacacacaatcagtatgctacatctagcagataaacaaacaggacaggaattaccagaagtagattttaacaatgatatggcttctgccatgagacaacccaagcagtgtatatccaaagttatgccagtccacaataaacttagcacctcttagccagctagccagttttacagcagccaatgttggaacagagggtggattctgttggacagaagatgatcgaataaaagaatcagttccatgctagtgtgtgagattttcgaattaacaaataaattgtaagtatcaaatagaaggatttctaggtaataaaagtccatgtcagttagtaaggccaaaagatacttacaaaatgacaaaacttcgcctaagtaaaggctgca

SEQ ID NO: 87573 - DNA, 1469 bp, Oryza sativa
gcaaatatcatcttctgtgaataaaaaaggaagaaccaactgatctacataaacataaagtacgcatggtttatatttttagcaataagcaagaagtacatatccaatcagcaagagtttctatttaagccccgggttaatataaagaatccaaatatgccatgagcgagggagtaagagaatataaccattgccctaggatcacaagaatttacttttggagcttgattgttagggaacaaatatcaaaaactgctctttaaattaatggatgtcacttattcactctatgcaacaatcacttagatcccctacatccatctcagtatcatctgcaagagcgccatcatccatgatatcatctgaatcttcacttttgacatccaatatagaatcagtagcactgctactatcatcattaccaaacaaatagtcctctgaatcaaacaactcggcaaatttaccaagattcttgatcctccctctatagctggtaagttgaagaactttttccttccacctcaccagtgggcacttttctatcaattttgtcccatcataagacttcgtcaagagcacgctaaaccgcttccccctctctatcacataaaagatgccataatgcttcagaagcagcctcatcaacttctgcggcataacaaactcacgacagaaatatgtgaggtgatcaatcaccagcctcttttccaacgtgaagttcagtacctcgtgcatcacagcaactgccctcttatcaaattcaggcgagccaggagtcaatcctcttgcctctgaataaggatataggtatgttgtcttctgaaactgctcggtattcccttttttcacataatgatgaacttttccgtagaatttgtagtaacttgtaaaatttggtgggaacttcatggggaatgatagtgagagctctcctggtggactgccaatgccgttagcatttgcatcaccagtcaatgctgctgtctttttctcgagctcggtgactgcccagtttgggttccaagagacaagctccaggtaatcgccatcctccaacctgaccaccctgaactgctcggggaacatgtgaacccatcgtgtcttgaaatcatgaggaagccccatgtcgcgcctgaaatgtgcaatcttgtcgatagccagacgacggtccaccgacatcatcagcagcctggtgacgtactcagcggccgtgcgcgagtgatcctccagcaggcgcgcctcctcctcgatgagcgcctcggcctgcggcgagaggcccgcccacatgacgccgcggctgtcgcggcagacctcgaagagctgcggcgagcggctcacgaagtgggcgaccttgttgggcttggtgagcccaagctgcgggcgcaggatctcgaggcgcttgagcggggtgacgtgctcctcctccttcttgagcgcgtcgaagacggcgagcaccttggtgagcacct

SEQ ID NO: 87574 - DNA, 691 bp, Oryza sativa
accagatttcaaatgccagaatttcaaggcctggttcaggagcaaaataccccaattgacctgtgtggtcttcacgtaagcgaggcgatacacgccctgaactatgagctcaacaaccggcggaagattgctcgatccacaggccgtcgtctccaggtgatcataatatcaagcacacgtactccggcgaggctgaccgccgccgtcgagcagtacctcctggagcacggcattcagtatacgcaggcacagccgggccttttccgtgtcctgttacagtgaagtaacaggatggtaggctcatcatgtttgtgtacacctttgaaagaagaagaaaaaaaagaggaggaacaaaaaagaattgacccctgtactactgtatatggcagagatgagtagtactagcagaatagaaatttgaaatagctgttgtaatattcgtatagcaaggcttttttttttgtcagcaaaaaacgttgtaaaatttgcggaattaggcgatatgttctttcaatgtggcgtccctagctgctcgttccaatctaacacgcatgcgatgcaggatgctatttggactggaatcagctgatttgcgtgcagatttgcgaaagtaatacatgacgcgacacaccatgattgatcttcgtttaaaatcaaaatggttgacaactttctttgcaagatttttctt

SEQ ID NO: 87575 - DNA, 1096 bp, Oryza sativa
cattcatacctagcagcagaagaattatagtgctctataaatcatagaacaaatcaccaagcgtaacgcagatctatttcacacgagtgctctataaatcgtggatcaaattaccatgtgtaaagcagaatttctcaggagtgctatgtaaaggttgtgtttagttcctgaaaaaagttgaaagtttggggaaagttggaagtttgaaaaaaaaagttagaagattatgtgtgtaggaaagttttggatgtgatgtgatgcgatggaaagttggaagtttgggatagttggaggtgaactaaacacggctaaaatcacagaacaaaatcaccatgtgtaaatgcaagaatttcagaacagtcgaaggaattttatatcattaatcaattcagtccccataggaatcgaaaaaaaattcaaacgggatacaatatactacagtacttgtcagatccatacacccctctctagtcctgatctaccgactcaaggccattgcgcttcagtgaccgtgcttaattatacgccgcgataactagggtaactgctaatcacgaaatcttcatacttccatggtaatcaactcaaggtcaggctcggcgaaatcaactcaaggccgttaatgcgacgagaaccatcttccaactcgaccggccttgcagcatcggctaccgggtgaccacatggcgatcaatcgatcgagctctcaattctcaaatcgcagacgtgacgtcgtggcgatgatcatcagcgcgagtgcatgtgtccaaggcttcccagcgcgagccaatcctcgcgcctctccacggccgccttcgctttcttcgccggcggctgctcctcctccgccgccgcagcacggacgacgtacgacgaccgcgcggaggcgggggtggccttgcgcttcgccaggaaccgcttcagcgacgccttcctcgcgatcggcatgtccaccagcgcgggcggcgcctctggcgcgccgccgccgccctgcgccgccgacgcgaaccgcatcagctcggccgccatggccggcgtgcagcggtcgatcaccaccaccttcccggcgtagaagatcgtgaactgctgccccccg

SEQ ID NO: 87576 - DNA, 1750 bp, Oryza sativa
tcctcgcctccggtcaccaccgcctgagctcgaaccagcagcctgagctcctcctgcagcctgtcgagctcgtcggcgcccgccgccgccgtcgtccacggcgtgccagaaccatgacggcccttcggtccccctaacgtgcctatggacagcatcgccgccgcccagccgtcgtcgagctcgtcgccgttccggtggagatcaccggaggtatgagcgcctgcaagagatcaaagattcagcaacaattacgtgactgaaactctgaaacgctgggaattctgaaaggagaaaaaaaaaaccatcgtcacttacgtcgagatgacactgcagtgtgatcttgtttcctcgtcccgtggagccttgtctgcacccagttcagagcctgaaaccgaagtagaaccagcagcagcaacgattgctgaattagcatttgtcattcgatgtaaaaaagttcagaagaaccagagaatcgagtgtgtaccctcatgagcagttctcgtgacctcttgtgtgcgagttcagaagaaaaatgtggatgaatggactcaatgggaagaagaagatggatgatgatccaagactccaagttcactatatataggggtaaactctgatcttgttgcaactttacagaagcatgcgtatgcaggattggagaatgaagaatttctctctgactactacagtgtcaaggtgattactgtcacatctcacaggaattatggcagaaatgcagagctcaaagatgaatggcagcttggtactccttaacattccaaatagggatctggcctagttgaggagagatgaacagatattccatgtgaccaaattactcaggagatttggttgatatcttatcttaggataggctcatggccactgccatgtccagcaaactaggatgcaattttatatatcttgagctgtacacattcccagttgagcttgattggaagcaggacccagtaccgatgaacaaaattcttgattgcagctgagatgaaaagggaaagtcagtactagagggggaaattgcaccgagagccgagaaaagaaacattaagatagatcgcagtatggtgcttccaagaagcattgccgtgtgacaaacttagccacataaattttcaagtgtttgttgccatatcatgtgtttgctgtgttctgaaattgacggtttcatactcaaatcaggaagcaagtaagcaggatagtgggagttcttgtgtacttttttcggcgatcagtgtggaaaatctaatatgttgtattctgatgttttctgatatattggatcgaccctctcatggggtatatataggagtacataggggatagagacttggagtataggattctatctctaggactctatcttatctctaggatatatctaatctctatatttgtatttgactcttatctctaactaacatattatacttctaacattccccctcagtcgtaacgggagcaaagctaacgattgcgactggatttgaaatcttctatttcttcatctctcggagtcatcatcatcgattgcatctctgatggtcgttcctccacctggtgcctgcgtccccttctgtgtcgtcccttgactctcctctattccctcccgcagtcatagcgggagtgtcatggatgatagcgatgacacggacgcttttgactggagtttccatcaatgatttttgttgtagatgttcgtcgatgtagccgatcatgaagtagccgtggt

SEQ ID NO: 87577 - DNA, 1126 bp, Oryza sativa
gtcattgcattgatctcatgcatgtagaaaagaatgtgtgtgagagtttggttggcctgatgttgaatattcccggaaagacaaaggacgggttgaacgcgcgccttgatctacaggacatgaatattcgcagtgaactccagcacatacgagatgcagagacaggttgagtgtacctccctccagcctgccacacattgtcgaaggatgagaagatcgcaatgttatcatgcttgaaggatattaaagttccatcgggctattcagtgaggataagtaagtatgttaaattggacgactaaaacttgttggaatgaagtctcacgattgccacgtgctaatcacacaaatcttgccagttgctatcagaggcattctaccatcgaaagtgcgtcacacgatccaacgtctgtgcaccttcttcaatgcaattggacagaaggttatagatccagaagatctagatgggttgcagaccgatattgtgaataccctctgtcacctgaagatgtttttcccactgtctttctttgatataatggttcatctccctgttcatctggtgaagcaaacaaaactatgtggcccggcttttctaagggaaatgtggccgtttgaaaggtgcatgggagttttgaattcatacgttcgtaacaaagctaaacccgaggggagcatcattgaaggttacacgaccgaggaggctattgagttctgcgtcaattacgtccgatgccgatcctatcggagtttctgcgtctcgtcacgagggaaggttgttaggtgttggcccaatcggaaggaatagaattaggcccgatcaagcgtcgtacgtgcaggctcattacactgtgctccaacatatggcagaagttggcccatactttgaggagcacttagcgaaaatccgagatgagaacttggggcgatctgatgcatggattaccagagaacataactctcggttcaacgaatggttcaagaatcatgcgacaatgtccacggatgtcccaaatgagacagtacagttgttggggatggaaccgtcttggaccctgggagctaaactacgtcaagttcaaggttcctttgttctgctgccgttgggtgaatctacgcactggtg

SEQ ID NO: 87578 - DNA, 872 bp, Oryza sativa
ggtccaatctgtttttttagggttctgacttcctacaggctagtaataaattattgattgaagaatctaataaaggtttcagtggtttgcctaaaaatagccacatggacaagtgcatagtgttctttttatcctcttaatcaatataatgcttaaagttatctagttctttgcgaggtcttggaatgtccggtggaatcttgctaagcatatatagatgcgcatctccttgctattttttactattttgagaatgttttactgtgttatattcattaattggatgatatatacttttcatctttgacttcacattttgtaataccccagtatttcctatattaatttgtgaactaggcaggccggtctcaatttaataatacgttcacatactgtatatttgtatgcacattaaatagttcatcataattttgacacttaattaattatgtcacatcagctagatttttagatatttttttcatatatagtagtattatcttgccagcaagttgccagtagataaatgtataaccaagtcagcgcgcggtgtaagtcccaactgaaatgaggcgtatatacctgcagcaatacacgtataatacaagatatatatgtataggtaatactgcaaggaaagtggtgtgtacgtgtacgtgtacgtatagtatacgtacccgaatccgtgcttggcgtagtaggggaggttggagagggaggtctcgtcgatgtcgaacacccagatctccttgccgttgccggagagctggaggctctcggcgtaggcgatggcctcgtcgatgacgacggcggagtcacggcggtagtggccacccgagcatgtagtggccgacgtagcccttcgcacctgg

SEQ ID NO: 87579 - DNA, 675 bp, Oryza sativa
caacagacagaagtggggcgcataatcagaagatgaagatgagcatgacatgtttataccttctccattgggcggtgaaatggttgatgtggatcacgatctgctgcaagacatgttacgtgacggtgaagacccagcccagaatgagagagattccatgaagttcagcaggttggtcagtgattcccagacgtctctgtacgctggatgcaaagcaaaacacactaagttgtcagttaccttggacctaatgaagctgaaggcaagtagtggatggacagacaagagtttcacagatcttttaggaattttgaaggctatgcttcctgctgagaacacattgcccgagacgacatacgaagcaaagcaggttctgtgtccactggggttagaggtccgtagaattcacgcttgtccaaacgactgcatattgtaccacaagcaatatgcggacttggatgcttgtcctgtctgcaaggcttctcaatacaagcgaaagaaaagtgctgacgaaggaaagaagtcaaagaggggtggttcggcaaaggttgtgtggtatctacctatcattgatcgtttcaagagaatctttgccaacccgaacgaagcgaagttagtacattggcacgccacggagagaaggaatgacggtatgcttagacacccagcggattc

SEQ ID NO: 87580 - DNA, 5922 bp, Oryza sativa
gcggggaggggtgggatggtggagtgggaggtggggcggcggcgggattcggaggacgtgatcgtgctgcgccggggccgccggcgaggaggcggccaccgccggtgaaggcggtggagccggagtccggcgggttcgcgtacgagccgccggagaagctgttctacaagacgagggtgtgcgagacgttcgtgaccagcggccggtgcatgttcgaggacggctgcacgttcgcccacggcgacgaggagctccgcccctcgctcaccgcgtgcgccggcggctggaggaagccttcgccgtcgttgtcggcggcggcgcctcccgtggcggtggcgccgacgcctccgccggcgcaggtcgtgcacgagctcctcgccaggggatccggctccggcggcggcggccaccgcgccatcaccaaggtgtgcttcgagttcagggacaagggcatctgctatttcggggagacctgcgccttcccccacgtctccgctgcaggtaacgctcgctcgcgatcgccatagcttagcttagctaggtcgatcgatcacacgtacgtgcgcgtgcatggccgatctcacgtcgatcgggatctcgcggatcacggctacacctgacccgtcctcacgtgttcgacgcagagatccgccagggctcaaggctgtcgtcgatgtcgtcgtcgtcgtgggagatgccggcacggaggagcgtggcggtgaccgtgcccaggacgttcgtctccgtgccgccggtggcgccgccgccgccgccgccccactaccgtgtcaacaacagcagcagctacaacgcggcatccatggccgccgcggcgcccgccgccagcgacgccaaccttgtcgcccagcagccgccgccggagcagggaggccggaagatgacccgcctggagatgctcagcctcaagaagatgaccggcatctacggcgactggctcgaggggtatgagcatccataaaccaatcgtcgatctctcgctcgccatgattgatcgagctccacctgccaattgccatgccatgcatcgatcgatcgtttcgcgttgctaccttagctcatcgatcgtcgtcaagaaccagaacaattttatatttaatttattttccaaatctgctcccaaaccgaacattgatcttgtcattttaccatccgtgtctgtcggactcatgtctgtatgtgtcttaaactgttgttgaattctgtgcgtgtaagcagacctgcattgccgtcgtgtcgtaagaactggaacaattttatctttgtgagattgtgtttgtgtccttccgtcttcctctgtggtggcttgggccgtttcctgttcggtggcaacgcggcccaatgggcttgcagaccatcgctttgccgaaggaaatggttttggtttggttgttggagaattgtatatgcagggcgagagagatgcggatctggtgttctttagtgcaggtgaagaggaggagaccggaggaggggaagagggggaggaggatgggatctgggattggagccgtgctggtgcttgttgcagcatggctaacatttgcgccgcctggtgctctggcttcttcgcgcaggtattgctgttcttgctcttgctaatttttgatgcaaggttctctgattggatttggcgcccaagaaatctgcttgtgtttagggaggaatatgtgtatggatagcatgattcagtttctaaggttggattttcatgagtgtcgatgtcttttgcaacagttgctgttgtgggtaattttgacccaccccacactcaaaaggaagaacattgtaggctagtggtagtgaacaaaaacatgtctttgaagtctaaagtataatgttgcctgtcttatattgttccctgatgatcttgtgttgattatgatcatggtattgatgcattaggattgatttagaaggtcttatgtaatgtaaagagcaatagagcattatctgaatgctggtgttgttagtataaaactttggatgaatcgcttcgattatcgtgggttgatgcaaccatttggtggcatatgtgagattcctattataaaactgagtccataccaattaaatgattacaatcaagaggcagtggagaaggggcaacatagatgggggaaatggtaatgagggctaagcctgtcatctaaaagaatggtaatgagggccatgagagaagggggagacttctattttgtctatggatgttccttctaatttttttatgggggtctggaaggcgctagaaaattataaaaaagcatacgaaggaggggagaatggaggagaaaatgttctaacattgataagaacaggaaactgagatgtaaaaaggaaaacacggttttgagttatttttctttgcagaaacttatattatggaattcatgtattactcctttcaggtttgatctgagtattgcacaagaaaagttagtgaactccacaggtggttcaactgcttcaagctcacaccttgtttttgatccttcaaaatcaaagagactctcatggcatccaaggtcggttttgtcaacttgatatgactagtaatatgcctgtgctaaacactacggtactactttagttgtctttaataatttttaaaattttcatgttagcaaaaaaaattattatatgaattgtgcatttgagttttaattcaatttatgtcatagatcaaatatatttcatgtaaagtataataatatgatataccaattcatgcagatatataatgcatatatctgtgccttaagtcatatgatattaaagatatatgataatacgtatatttatgccttaagtcataataatgcataataatatgatatattatgcatatatccgtgacacgcaaaataattcacaatggcgttgatatcaatatttattcatctcacaagcgccattttatttattcatattgatatggaaggatcaatatttatttatcccacttccactgatgtgtttacatatcttattatgagaacttgggttcttatagtcatgtacttcaaactgtctcttaaacatcttaatttttcagatatgtcttgttttattcttctttacgtggtgggcaaatcccatttcttaccttaatataggatcttcttgtatgaaggttttctttctgacatggagtgtgaccatttagtatctatggtaatttttgtaacactgttatcacagcttattatttgcatttgtgttatcgaagcttatctgcttatgttttcattatcacagggacgtggtaatatggagtcatctttagcatttactgatggtgatagaaatagttcgtataacaacattgaggtaggcctcaaagtgtacctagctaatagcgaagtgagcatacatccctctttcataatttgtggtattttggaatcatgcagaaaatatactctcattgaaataaatacaagagaaacctccaatccctatatttgacaatctagtatgatttagcctgtaatttgatggttagctgtggctgcagttaaatgaaattgaagttatatacctttcctgatatttatttcttcatcattcttttggatatgtagcttactgtaggtgttaaacttgtggaattttttaaaaggatgaacttatgatctactgtatgaagtaccattagccgtggactgtgctacttctaaacacctatattgttgtactcttgaaggatatagttgtttccaagattgaggacaggatatcgctatggagctttcttccaaaaggtaatcactcactcgacaacacagaaacattgcatgccgtgtactggctgctgacattcctgctggtcttcagaaaatggagagagcattcaggtcttgaagtatggagtgaacagaagtggcagtatcaaggaggaacctaaatcaagcagtggtgcccataggcttgcgaccattttgatgtatctttctgatgtcaagcaaggtggtgaaactgttttccccagatctgaggtaattatatcctcaccaggcctactttttcagaacaccttatcagaataactatgcactgcttatagtctaggcacatgtaatttcttcagtgatttgattcagttgagcagaagatcttatactaaactatgattttagatgaaggatgctcaagctaaggagggggcaccatctcaatgttctggttatgcagtgcgaccagccaagggcaatgcaatactgctgttcaatttaaggcctgatggagaaacagataaggatagccaatatgaagaatgtcctgtcctcgaaggagagaaatggctagccataaaacatataaatttgagaaaatttgattatccaaaatcatcacttgcatccgaggatgagtgcacagatgaagatgataggtgtgtgagttgggctgctagtggtgagtgtgacaggaatccggtgtttatgataggaagctcagactactatggctcttgccgaaagagctgtcgagtgtgctgattattttgcaattttttgctagtagaaatattgatgtcataggcagagaatggtgtaacaaactgtatatgttgcccgtttttcttttatgatttactttgcgtttgttaggaaatttaatttggagttaatggattgaccactgttcccaaattatggaaaataattttgttccatcagatgataatgatatatgcacatcataattaatcatgatatgattgtagcttatattgttggttaaatgaccttattctttcagcatataatcacgagaaaattataatatgagaaatggtaagcaagcaaggcgtcagatgtaacttaccaaattgccgttccatgtgaagacaccatcatacttggcagttggcacctcatttataactctcggctgtactcctgaaataaataaaatacagtgagaaaattataggagatattcttacagcccactgccttagtttttatttatgaccatttccacttacagctatgtgcaatacatacagagttacacactaatacttgtctattatacaaacaaaaaggttataccaaacgctagcaagccttgcatattaaaacaggagatatttgccatatctatctatttctttgaaagctagagaattaacagatgaccatatatacaaaagtggttgttaaatgagtgtttctattacaccctagtgaaagatgattcttatcacttctaccatatatttttgcctatttctaagcttgcttagaattttagttgaagtttactgtttcaattcattaactaacttgctacttgaagaaagtttcaaagggtattacctaatactctgtgaatgcatactcaaaattgtacgtactacatatataagatatatatgagtgttttgcctgaaacaatcttaaataatcacaatgataagtacctaaatttagagggctatcatgcctacttcaccatcggccatcccctctgggatctttagggttcaaaagtagcagccagtggtggagccacctctcgggtaggtcaggtgaccgcctaggctccgtcatcgcttctcaactgctaactggcttcggtgtctacaaaaagtggttgcacattaaaaaatgctattagtcgcgaggttcaagcgctttgcccactggtagcaacactagatctaacggttaacatggcaatcacaagatgcagatctaataatatgaaggaaagtggattacctctcacggcggtggattgacatagatccacccatgatagcatcaaagacaaggaaggtggcgacgaccggtagagatagatggcggcggataatcaactaaaggattaggttagatctgtgttcctctccgtttcaattggtagcatggcacgaggcgtacgaccatggcggcg

SEQ ID NO: 87581 - DNA, 714 bp, Oryza sativa
tcaatgcaggaaactaattgaagattgttgagctatatcaaattataactactcatttcaatatagttgtccacatagtctatgctcacagaacaagggagacaaaagatcaaagtaatgtttagggatcttttttgttttgggagttggtgtgcgcttgtgtggtggggaaaatgggggctagaattgagagctggtcaactacaattttcatccaggacagtttagagcccccaagccagcacatattattttttactcccttcatcccagaaaaaaagcaacgttcataatctggacagaggctatgtccagattcgtgtatagaagttcccccggtttctagagtctgattaaccccttgttaaatagggtacttggtatggatagcagggttagagaatacaactacactataaattccctcaatggagaattattttgaaaaggcaagtcccaataaactggagaacaattttgcacggaggggttgagaaaacaaaattttcaccaatactaacctttccgatgcatccactttggcccttaagtcttccagttctgcttcagcaattgaaagcctttgttggcatgcagtttccgcttcatttgctgcttttactcgaagttcaagattatgctcttctaaacattttctcaaatattcagcttgcttgcgagctcgggttttctgattcttcaatctctgaaatt

SEQ ID NO: 87582 - DNA, 730 bp, Oryza sativa
tactcactgacaccaaaagagaaaaaagctttctgtacatgcttgcgtagtttgaaagtctcgactggtttctcatcgaacattataaaacttgtatctatgaaagatttgaccatctctgggtacaatgctcacgactgtcacaagatgttaactgtcttcctacctattgctataagagcggtcaagccagttcacactaagttggtgataacaaagttgtgctattttttcaatcgagtatcacataaggtttttgatcctgaagagttaggcccccttcataaattcgcaatcgagacagcttgccagcttgagatgtttttccctccatcttacttcaatatgatagagcatctgattgtccacatcgtccctcagattatcgaaattggtcccctatatctacatcatatgtgggcgtatgagaggtacatgtcagttctgaaatggtatgtctgtaaccaagctcatctggggggatcaatgatagacgggtacataactgaggaggtggttgaatgctgtatagattatatgaaggacgccacactcattggtatgccccctcctgtacacgagggccggttagctgggaaggggaccgtaagcaagaaatggttctatgatgaggcctataaagttgtagcggaagcacatagcagcatgctgcaacagcgcgccatcctcgagccgtacattgaggaacacatgaacgagatcagagctt

SEQ ID NO: 87583 - DNA, 658 bp, Oryza sativa
tatagggcgaattcgagctcggtacccatgcatgtggttgatggagattccatatgtcatacgatggaggtattgtgtgcgtatgggatgcggagtcgaatttggaaggagtccaaatttggtaccattggttatgtaaagtttctttcttgtattagagggtttcctaaggtgtttaggactcttagtatgagtttggtttgtggctttaggatgcctacctcgggtataaatagagggggagcgtgaggcttctcggtatcgcttttcacagcaattgagttgagttttgagttagggtttcgagtttagtcgaaatttttgtaaggattgctgttggtgcactttgttaacacagagagaatcaataaagtcgtcatccactttaagagttcttcgatttgtgtttcaccgggtttcggcggtgtaatcggcggcacaccagcggtcaaaccggcggcattcgggcgggcagaccggtgggtgacctaccgtctgaaccggagcgacattaagcgcgacagggatttcagggctgtccaacccgtagaaacggttatctactttggtagaccgatctcatacaatttgaggtaacttttatttgcgctaaacgtatttggcctttgggtatactaaccatttacccccctttgat

SEQ ID NO: 87584 - DNA, 532 bp, Oryza sativa
cttcaccgtcggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcgtgcctccgtcgccgccgagtggtgcctccgcctacacggctggcctattatgccgccgctgttgggcgtctacgacttcaccgccggcctgcctccgtcgccgccgagtggtgcctccgcctacacggctgacctattatgccgccgctgttgggcgtctacgacttcaccgccggcctgcctacgtcgccgccgagcggtgccttcgcctacacggctggcctattatgccgccgctgttgggcgtctac

SEQ ID NO: 87585 - DNA, 643 bp, Oryza sativa
agttggcgttataacaggccagccgtgcaagcggtgacaccagtcagcggcggatgcggcggccggtcggtgaagacgtagacgcctaacaacggcagcataataggccagccgtgcaggcggaaacaccagtcggcggcggtcgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataataagtcagccgtgcaggcggaaacaccagtcggcggcggcgaaagcaagccggtcggtgaagacgtagacgcccaacaacggcggcataataagccagccgtgcaggcggaagcaccagtcggcggcggcgaaggcaagccggtcggtgaagacgtagacgcccaacaacggcggcattaaaggccagccgtgcaggcggaaacaccagtcggcggcggcgaaggcaagccggtcggtgaagtcgtagacgcccaacaacggcggcataataagtcagccgtgcaggcggaagcaccagtcggcggcggcgaaggcagccggtcggtgaagtcgttaacgcccaacaacggcggcataataa

SEQ ID NO: 87586 - DNA, 612 bp, Oryza sativa
ggcgtgcccaaaagaccatttccccctaccgcggatcgactagctcgtggatcgacaactagctgcgaactcatgagctttttggatgcgtactccggctaccaccagatccacatgaatccagccgacatctctaagacagccttcatcacaccattcgacaccttttgctacctcaggatgcctttcggcctgaggaacgccgaggcaaccttcgctaggctagtgtacaaggtcatttacaagcagctggggtgaaatgtggaggcttatgttgatgacatcgttgcgaaaagccacaaggctttcgaccatgcgtccgacttacaggggaccttcgacaacttacgcgcggcgggtatgaaaccaaaccctgagaagtgtgtttttggtgttcgcatgggcaatttgttgggttttctcgtttctgaaagggatatcgaggcgaaccccgagaaaattgatgccattcagcaaatgaagcccccgtcgagcgtacgcgaaatacaaaagctcgcgggccgaattgcggcactcagtcgattcctctcaaaagcggccgaaagaggcttgcgtttcttcaagactctccggggcgcggaaaagtttacc

SEQ ID NO: 87587 - DNA, 675 bp, Oryza sativa
  unsure (1)..(675): unsure at all n locations
cttgtatctatttttcagttgagtgataccaaagctgacagagacttcacttttgtccgcttactcgttgcagtaagatgtgataacaaacgccctttaatatgtagttctctactatgccaaaatgattaaatacttcaatgtagatttcttgtcaggtagtatgaaatatctactccagtaatggacgaatttttgggaagggaatgtgaaattaccggctattgatgacatcaatttcatgtaaggtgacacaatgcacgacctccttgcgcttctggagctcgccctcggggcacttgacgaacttggtgtgaggaccaacagcatcgtaatcccgcgacctcccgattgagcggccaagcttggtcaccttcccggaggccttgtcgagcgcaaccacatccccgctctgcaccttctccttccccagggcctcaatcatcttgccgccgagctcgtacacggtctccatgtccgtggtcttgagcgtgaggcgcccggtcttgccagccgcggcgacaccggaaggcgcggagctgccggcggcggctgcggcggagacggggcggtcgatcgagatctcaacgacctcgccctcgatgatctccgcctcctccttgatgcggacgccgatggagcggcggaaggcctgngtgagcgcctcggtcttgg

SEQ ID NO: 87588 - DNA, 524 bp, Oryza sativa
cttccttagggcaccccgaagctcgtccgcccgccgacgtcgtcctcccgtggcttgccgtcgctgttcgccatcgtcttcctccgcgccggccaccctcggtgaggcacccccctcccctcttttcccctccctctccctcctagccgccgctttagcgccgccgccggttagtcgtcgctttagcatcaccgcccttcggcgccgcctttgcgtcgccgtctccgccgccggatgccgtcgccggcaacgcgacgcgcgcgtgccaccgccgtcagccccgggtcggccggtcggctttgatgccgagccgagcccggcggctgcctccaccgccgcccgtccgatcggcccgagggcgatctgggccgtcggtcccgtggaccggcggtggaccacccgcgtggtcctggtccacggtgaaccgctcctcctgagccgctgaccggtggggcccgcttgccggcgccgcacccccctctgtgctgacgtcagccctgggatttattgcgcaataaatgatt

SEQ ID NO: 87589 - DNA, 515 bp, Oryza sativa
acttgtcttctgtgccgatgacctcggggtcggaggatgaaaggggcggccttccctcagtggcctcggggccgtcctgggggtcgggggctcctggcatcgtcggacaagcgggcaaagggccaactccggtcgtcaggggcctctggcctccgttcgactcgggggcctcttctccctgctctttctcgggtcgagtcagcacagggttagcctcggggtcagagggcgttaagtgcggccttcccgcagtggccttggggccctcctgagggtcgggggcacctagcaccgtctgacaagcgggcagagggccgactccggtcgtcaggggccgtaggccaccgtccgactcgggggcttctcctccccgctcgctcccgggccaagttagcacaggatgggggtgcacgaaatgaggattgttttcatcgcgctccacaaccaacgctgcactaactacttggggggtcgccgctaagtaaagtagcaggggctcatttggctccggggcg

SEQ ID NO: 87590 - DNA, 514 bp, Oryza sativa
gaagtggtggtggtggtgcttctctcttttatccactgctgctttttcagtttttcttgtgacggtgtctcatcatagattaatcttgtgtttctcaagggtgcccttggcatgttggcaataccttctgccctggtaatcctagctggaatgatgataaaggacgtccatatgcccaactttccatatgagctggtaaacaattttgctttttcatgtcagatataagtactattttgttttcctggattgacattttcctgtctactgttaaaaaattaggcccatatgaagtttgtagaagcaagtagaacaatgatggcaaccttaaaatgtcctgaagtatggcgaccatgtgtttacatgtacatgtctcttgctttgagcgtggacattcaagaaggaatgttctattggtacacagatagaaatgcagggctatctttttcagaggtatattataatttacaaatcttatgctatgctctgtggttttcgtggcctacatgggaat

SEQ ID NO: 87591 - DNA, 2914 bp, Oryza sativa
atatacagaagggtaacaagaggcctctgtctcctggaacccaggcactgatgtgtgatgagcaagatgcagttttccaggattcaaaagctccagatgcaaccccctcaaccacagaagagaatctggtagacattttcaaagagcaagagaagcgtgtattgacaaatttccgtgactacctttgtaagcttgcgacctgcggaaaattgcaaggtgagtctttgtatgcactcatttggtaacgtaaatgcaaaactagttttaaatgagatactgaaaccatctaacataactttgcaactttccgactcttcattcctatcagtgtttatgcacacataaacaccaagataactgtgcttccttgtcacagaactgaagctctctttggcatcaacaaattgcagcgaacaagcctttgccgaccacggtaacaattcctccataacaagggttgcgaaggtaaccaggatcagacaaacaatccctcagttctccagcaaggcggcaagcactaccgctctggacgtctgatccttgctcggaccaaaatcggcaatgctggcatttggaaacttatggggcagaagagccctttgcacaatggcgtcgacaagtgctgagtgcatgggcaaacctgacgatacctccagtggcgctatcacaacttgattggcaactctggtataaattgatttgggccctttcttgggtactacattttcccactgccttgccatgtaaactctcggtgacgacatgagcggttctgttcatcttccaacgtaatcagtcgaattgccctttttccctactatcagagttcatgaatccatggaacggctgaattgacaggattgaacagaacgtgctagtggtgatggcatttgacaaggaagtagtattgcatatctttttctgagcaagatttttattagctagttacccatctgcttctcatgatctttagcacccaaagggcactcatgattacaatttcagttgacaaagaacatggcgtgccaacgtatttgattagcatattattacaatttcataccaggtataaagtaactacactttcctgcatatgccatgttctttgtcaaatacctggtgcttgcctgttatacgttttagcactatgtatactagtaatatgcccgtgctaaacgctacggtgcaattccattgtctttaataacttttaaaatttcatgttgggaaaaaaatttatatgatatgttcaccgtatcggctcacctttctacatttttcccctccctgttaatatttacctctgtatctgtccggcttcaattttttccccggtacaatcaggctgtggagctgtgttctctagaaagaaatccctccttccacatgtaaaatggaacgatgaattaacacaattagctaaaaaaactttaaaaatggataagatcatattactatatgccccgtctaatagtttaggaagcgtgcacgcaggacctttcaacgacaaagagacaacgtgagtgcaatttggagagacggcggcagtgacgctttaagcagccgcacgttgctggagatcggcatgagggatggtggcggcaactacagattgtcttctgaccatcaaattaaatatgaataactcgtcatctctttgaaacaaagggcgcttccggttctgtgcgtgcttcaaaccactttgtattctccatattaccatatctatagagtctaattttcaatgaggaactactgagttcaaatgcgaagacggtataataatacgctatgacaacagtgctgcggttatcattgataaaaagggaatccaaatggaacttgcgtttttggcgcaatggccgaggaattgagagaattgaattttactaaaatagtttcataagctcatgaagtattaacaataacaaaagggaaatttgagccttctttgttgtacttgctaattcaatgcaaacacatataagctgtaacagatggtttcatatttgagccttttttgctgtacaagctcattgcctgtaacaaatgctcattgttggaaaataagagagcagatcaatctagaagtcagctcctcctctagttgccaagctgcaaacgcatgtgaatggaaaaaaacaacacagtgggtaagttaggagaaggtgactttttctctttttctgaaggttggagctctgccattatattaagaagttggtttcagactacaattcaaggatattacatggaacaaaaagcaactgagctttcaccataaactccattgcatagcgaatatagttggccagtttattttttgttaaatttcctgcagatagaaccttgtggtgtacaaaaaccgatccaaagaacatctgcctgggttcatctggtgcccaacatagttctttcgaaattgttacaggtcattgaatgatgacatgagcactgattgcagctatcgatgcctcaaaaaatcctaagctattattagaggggcatcaagcatacagagttatcttgaaaggagaggctaagtggctatggagaagagaaattccactgaccgcttcttcatcgtcaatttccagccgccgctggccttcgtgagccattttgccgcttcgcccacagttgtccagcaagaactcaactgctgggcgctaccagtcgtcgcacaaccatctcagtcggaagcgctgggttgcttctaactaaaattactaaagaaaatccggtcatgaatttcacaacttgaagtccatgtgaaagaggccaaatcagtatggtctttatatttattctttgccttcataatacactggagagttgagcatgacgatattaactaaatgagccttgatcatctgggcatggtatgcttattatataagataaaaaaaatgtt

SEQ ID NO: 87592 - DNA, 1150 bp, Oryza sativa
attcctgcagccccagagaaaccatgtgtgcacttgtcatgatgaagaagagccagagaaacatatatggtggaagaggaaaaggattttatttgaccaaactaggagaagttctgacatctttctcaactaactactttggtatccagcagaagatttgaccaaacatgtttccatggtgagagtattcaaatcaagaatcaaataggtcaaatttaaactaaccacgaatgcggagcgtataagttcttcctcataatccacagtggcacctttcacaaagtcatatgagacatcgtccacaaccaatttaacaccttctttctcaaagatcctacatgtgtaacaacaattgttgagataagtaaaactattgatgaagtatgtgacacactcactacataaatcatctataaggtatacactctgttcataagtttccacaataatgcttagaagaaatacagaatttacacttgtctaaaatggacaaaccagtcaggaaaattggcataccgatcatctgagtttttcttgtcatcaagagagaaagaatattggaatccagaacatccaccagcttcaacacttaatcgcagcatcttaccttcagaaggtggttctttagcatgtaattcttttaatctctgtgaagcattaagtttccaaagaacacaaaaatgcgaagctgttaggaaaactaaaattataagaaagtatgtaaaaggaggggggatacattctgaacaccaaaagcatatttgaagtcaacttggcacaaattgaattctcaaatgttcctactgcgttgaacaaaatgtgatagaagtagcatattcaaatgtaacagttgaaaatgaatcaaagacaaaaacaaaaaaaaagcaggaaatatttgttgtttccaaaaaaaaatatatcacctctgatgaaatttcaggaaatccctttagcaatgtccatatttcaaaattttcataatattttaaaggttttgcaaacatatggggtataagtgtaagcatatgaaaccacttttactgtctagtattaacaacagaaaatgcattcatctagagaccctgaacacatgtaacaagaattgaaatcctgtcacagaaaccctgatatagcccaaaaagaatactcc

SEQ ID NO: 87593 - DNA, 680 bp, Oryza sativa
ggtattcattttttctcacatagatattttttattctcttgcacaatgagcaataacaaagctatttgaggaataacaattgaataaatcatatatataaagcatttataaatcaaaccatatgctagtatcaatattgtatatttttttaattaaagtatagaaataaaatgtcatgcatcatctcccttaaaagcaatatctaagcctcataaaaagactagaatacatacaagctataccagagacaaattaaccttcatagtattgatagcatgcacaagaatataccatatatataaaataaagctccttttttttaatttatcttattatcaaattttgcttgataaaaccatgaggtacaaaaactccccctcaaaccatgccaaaaggatgaataattcccaattctccacgaagaaaagcaaagcgattagaatctaatggtttagtgaaaatatcagcaagttacaactttgtatccaaaaacgtcaattcaacatcacccttctcaacatgatccctcaaaaagtgaaagcgaatatcaatatgctttgtacaggattcttagcaatgtttatagcagtagtattatcacaaaagagaggcactttctcaaaagtaagaccataatctttcaaagttaatataagccaaagaatctgtgaacaacaatt

SEQ ID NO: 87594 - DNA, 782 bp, Oryza sativa
ctattcgctattgccgttcgccgtcgtgcgtgccggaggagccggcacgagcgaggacacggaaggggactctgggcgctcgccttcttcctcttccccggcccgaggctggagagatcactcccgtgccgtcggcctctcgtcacagcgccccgcctcatctcggtagtgcattcccccgttctccctcctcgatccatctcttccccttagttttcggtagtagcatgtgtagccttcctgtagctagctggcgccgccccgaccgttgccgccgctagctgtgtgctcgccgccgtcgccgcccgtgctccatagcgcccgctcgtcgctggcctcgctcggcgtagctccgcccaatccgacgctagcaacggattcccatagccgcgtagatgctctcaccgccgggaatcggccccacgtgacctcgtcgccgtttccccttccctcgccgccggttgccgccgccgcaatccgccgccgttgagttccctccggcgaatccgagccgttggctcgtctcccctcgtcccatgcaaccccccggtgtgctcgctttcacctgtatcgccgtggttcgctcagccaatcgccaccgccgtccgccatccgttccggccggcataatcgtctaccttccgccggcccgcgtggctgccacgtaggcaccacgttggcgccacctccggcgcgaccggatcggctgaccccgcagccgttcctttctgttccccccccccgtgcgcatggtccgcggtgagccgtgaagctactcgtgg

SEQ ID NO: 87595 - DNA, 1366 bp, Oryza sativa
  unsure (1)..(1366): unsure at all n locations
tttcccctcataagtgaaggtgaatggagggaacatgctctcgttcgatatcgtcatcggcatgaccatttctgtgcaggcctgcaagagaagttgcttcagaaaacacaactagtatctatctcagtattgtcagtggcattgtatcaatcacctgccatccccaaccactgaggccatgggggtcttctccatcctctaactggaagcatgtttgatctcctgtgtaattgtagtacagactcgccgctgcgaaagctttgtcaacgatgtctgctcctgcagggaagccgtggatgatcttgcacatctgtagaaatttcatgagaaatttactgagaactgaaattccctgggaattatatgttcagtgagacagaagaacaggcatggtttctgctcagctcagtttggtgtttctgacacaatcttggttatgcatttggttgaaatgtagagaggagatttggacattgtttgcagaacataggtagagatggcaacctccttgataggataggcaggcagattcatcaggaaattggccggggttggatagtccaccatggctgtgtacacaaatgctgtccatagccagtttctgaacgagtaaaccgatttcacagtcctaaaatttgagggaggaaaaaggcaatattgtgaactcaggttagtgtaaatccaatcaatgtcattcttcatctattcagaagttgggaagatgacctttaatcaaagaatgatcatggctgtcatatatataactgataaggtctatgtcatttttttacataaacctgttctgtctggtatcttatctatcaatatattaggcaatccttattgccttcttaaaaatggataagttttatgccacctgtaaatttatatagtttcttacacatcacgacaatgaagcataattacttgaatttgtgtgtgtatattatccttttctgaatctgcatgctatttttcttttcttggtattgtttggttgatcacttgcactgcacacatctggaatataataattacaatgatctcaattttctgttttcctttatatctaataagactataagacgtggataaaattttggatattcgtggcacgtttttcaaactactaaatggtgcgtttcgtgcgaaaactttctatatgaaagttgctctaaaatatcatattaatctattttttaagtttgtagtaattaaaactcaattaatcatatgttaataccacctcgttttacgtaaaacacttaatcttatttttcatctttatctttaggagaaaagaacaccacctaggtagtgtattaaaccagcaataaacttacttgcangctctgaagttttgctg

SEQ ID NO: 87596 - DNA, 1738 bp, Oryza sativa
gacagtgatgagtcaacttcagatgttgccttaagactgaaagactcgtgcctttccgaacaaccgatgaaagataaagatattcctactgctgtacaatctccagttttccctgatttttatccactcgagcatgaaaattgggaaaatgatattgtttggggcaattcaccaacaaccgcaattcagccttgcttaacaagctgtgcaatatccaaagaaagcttggatgaccacaatgaagaccaggccgagggttatgtctctgggtgttgggatgtacagaataaatttcatagttcttcagtaatggcagatccttttgggcatacagaaatacctgattcaactagttaccgttcccctgagaacagctattctccattaagaaaggagactgctcaggagaataacagcttagatgaaccaaataacataactcaaccggttaaaatcgacaccacacggcatttaaacaagctctctttactgaacaaggagttgttagaaggatcttggttggataacatagtttgggatcccagtgaggatgtaccaaagcccaagctaatctttgaccttaaagatgatcacatgctttttgaaatattagatgaaaagaatggggatcacctccgctctcatgctcgtgccatgattgttactcggccaatgaaaacttcagcagtggaaaatgttgaccataacaatcaagcaattgcattgagtgggagattcaacatttccaacgacaaattttattctaacaggaaaatgtcgcagcaagctagatctcatgctaaaaagcgtgctacaatgggcttaaagttggtacattctgttcctgctcagaagctccagaccatgaagccaaagttgagcatgtaagtttttcttcctctgcatgactctatgaatcttgcattcattttcagttattttattgaagtgataatattgtaaatctgagctttattcaggtgcctgcatagccaaaatatttttttcacgtattattcttcaataacagaactgggtaatctgtctttgattaaacatacttgcttgagagaacaactgccagtcctgttgtcttgaggaaatgttttcgtagacatggaactggcatctggctatgttcgtgaagataaccttttttgccttggattttcggttattgtaattggcgcagctgtacactgtcatgatcgatcatcagagagcataagatacattttcttgattatagttgaatatatgttccttttaggaccaattgttggatactattggggaaaaaagattgctttagaacttcaaagttcagccaggttatagttctgggaacatgcattttttaccaaagaaaatgcacaagttttccagtggaaagctttgtgttcaatattgattgactttgtctacatttactgcactgcagatttctatgctctggtagcatcagctattcaaagctttttggtcttaatcgtattcaactagttgtatttggggtttttagttgtcgtgtacttcaactactgaactttgttgttttctgttctttgttgactttaagtcgctaaattttgtcttttgatcaacttttgtgcagcaaagaaatcgcaaacttccatagaccaaaagctaagtggtatccacatgaaaataaacttactgctagatttcaaggagatgagtgcagtcatgggccaatgactgctattgtgatgacttt

SEQ ID NO: 87597 - DNA, 1402 bp, Oryza sativa
attcacttcagggtactgcactggaaactgatttgttggcgccaaaaactcaccatttgactgcactggaaactggtttgcaggcaccgaaaacccaccatttgactgcacttgatactgatttgcaggcgccgaaaacccacaatttgactgcactggaaactgatttgcaagagctgaaaacccaaactttgactgtacttgaaactgatttgcaggcgccgaaaccccattatttgacttgtttgcagacgagttgccagaatggcaagatggagagccattgcttgtctcccacatactcttacagaacatgccagcatatgagctaccagaatcgtctgtatccaacaccaagccatttgatatgtttgcaaatgagctcccagatgggccagatgggaagcactttcttgcatttgatgagttctgcagtggctgaaacacaggattgttgcccgggcttccaccatggccaactgtccccatggccatgtttctctggctgttcttgagctgaactgagtgagtgggcagaaagccatttgttgccaatgcagatgcagaattcatccttgcaaatggattgctcgagcttgaggaggcaatggctggggttagacggtatctcccattttcacagtaatttttcagagcatccagttcattcatatacttccatttttcaggaaattgatcaggatccatgcctgtttgagtgctgatccttttcaggtataaccgatacttctgaaaccaagaaaggcaaacacatggttgagatgtgtccatactcattggaaaacaataaaaaaatcacaaaaaaattgattactagttgtgtgcacacattaaaagaagatatgaaaggtttatgtatggaacactttcgatcagaaaagagtaatccaaatatctttaattatagaaacatagaaattaaacataagtgtagatataaacctgaagatgacttgcaatattctctctggtcatgtagtccactttcatcatccgcaatatcttccttggaacagcacctacattcacataatcaaaatatttattgcttaagacaaattgaaaaaaagaaaaagattgtttgataactgagacatgatgcatgagctcttacgatcaactccaagctcatggacggcaatgacaaagtcccggtgcagctcaggtgtccagacaaccctttgtctcttcagagttgaatccatgttctctttgttctcaccataattatctccatcatttctcatcttccttgtgtacttcctcttggtccgcgtcgcgccaaccagctcaccgccgtcgttgtaaccgccattgtggttccttatgtcaagctttctcttcctccacacatgttgccatatgttctggatgtctttga

SEQ ID NO: 87598 - DNA, 681 bp, Oryza sativa
  unsure (1)..(681): unsure at all n locations
attcctgcagcctccttccaagaggagaatctgctggatgtctaaccaaaccatcttgtgtgcgctcttcatcatgccatcttgttagagctgctgttctagagcatgcaaacaacctctgaaaccttctctttattggaaaatagcgaagaactttattaggaaccttgtgtatgcgtttgccatttagactcttgttttctgacttccatcttgaggtttcacattttggacaagagttggcattagcatcatccttccaataaaggatgcaatcatttttacatgcatgaatactaacatatccaagccgtaagcatttcactgttttcttagcttcattgtagttctttggtagtgctgaccctttagggaaagcttcaataagtagatttagtaatagatcaaaactcttatcagaccatcccccaagcaatttgatgtgtagtagtttaactatgaaatgcagctttgagaatttatcacaccctgngtacagttcttgcccataatcatctgacagcattttaagagcattcagatcttcatttgttacatctgaattaccctcatcctcaaattcccccctatcatctaagccacatgccaagtctcgaagcaaatcagagatgtcatcatgttcacttgactccacatccccaacctcatcatactcagcag

SEQ ID NO: 87599 - DNA, 686 bp, Oryza sativa
tcttattggctctttgggtgttgaggagaatgcgagggcaaaggacaacttgggcaaaaaggtcgagagaggttctagtgccaatatggtacaaaagaagaaccctcaagcatcccacaacaacaagaaagttaagcctgatgtcaaacccaaggctacaaccaattttaagaagaaaggcaagggaaaggcaaagggagactgctttgtgtctcgcaagtctgggcattgggccaaggactgtcctgaacgcaaagacaggaagtctgctaacatggtcattagcaagggcggaggaacatcggggtacggtaaaattttacctacagttctctctttttttcattcacctaattggtgggttgatattggtgctaatattcatgtatgtgctgatatttccctgttttcttcttatcaggtcgggagaggtttctccttgttgatgagaaaagggtcacttgcggctgttcatggtgttggtacggtcgatatgaagtttactttgggaaagaccgtgcagctgaagaacgtgcaacatgtcccttcaataaagaagattctagttagcggctctctactgtgtagagaaggttttagacttgtgtttgaatccaataaatgtgtcgtatctaaatatggaacttttattggaaaatgttatgacaacagaggcttgttccgct

SEQ ID NO: 87600 - DNA, 681 bp, Oryza sativa
gggataacttgtgccgatctcgtgtagtttgaatttttctcaataccaggtcgccgactaagaaggctagtgatcgaacgttatgattatgataacggcgcaacccttgcaagtatcgagccgactgaattaaggctgcttcgagggcctcttccagtcagttcaaatcatctactcggtcttctccgtagcgctcctcgttaaagttgcgaaaacgtaaagattcaaattccacctcactgggccacattgcttccgctccataaactaagaaaaacggcgactggcccatggcccgactgggagtggtgcgcaaggaccaaagtacagacggcagctgttctacccacttgctggcatagggattcagtcggtcgaaaactcgtgcctttattccttggagcaccatgccattagcgcgttcgacttgtccattgctcatagggtgcgctacggaggcataacaaattttaatgccgaagtcttcacaaaagtctttaaatactccgccagcgaattgagtgccattatccgtgatgatccgattaggtaccccaaaccggtgcacaatgttgatgaaaaaatctctagccttgtctgtcatgtttgtgatgaccggtttagcttcaatccacttggagaatttgtcaatagccacaaagaggtgagtataaccgccga

SEQ ID NO: 87601 - DNA, 669 bp, Oryza sativa
cgggcgtccctcacccagcattactatctcacggccggtggcggattctggcatgaagcggcgcggcagcccagcctgcctctcgctcacaatgcgggaaggcggtagtacgctaccgtcgagcagagcggagccccgtgccatgtcgtcggagaaagagagggttgagaacgagtgtgtgtggcgaaggtgaggcgcagcaaagagagagttaggggcgcaaacggcgaaggaaaggggaatagtggcgaaaaggaagggagcaagtcctttcctcgatagctttatacccttgccatcgctgagcccggctcctcgtttctcgtgcccactatctcgctccctcgttactcgctatctcgctccctcgtttctcgcgcccacgcttccactaaattccattcgcccgcttgcggcgcataaggtagatatgcggttgtggcagtcgagatagatcgtatcgtgtgtgcgttaattacgctcgctgaccgaagcgacgttaccatatctccagacgaaacgaatctacacgcccagattcgagcgctgctcaagtgatgtggcagtcttgaagagaccgcccatgactgacggccaagacaccgttaccgatatgcgtggtttgagaccgttgggtttctgcccaatcacggagaccggtcccacctg

SEQ ID NO: 87602 - DNA, 675 bp, Oryza sativa
cacacgaacggacggccgagatcgaaccaatccaaaacggacggccgagatcgattgggtccacggcggctcacggcggacgaccccgataacgtcagcggtgacgtcaccgacagcggcggcggctcggcggaggagacggctcgaacggcgcacgctcgccggcgaacggcggcgcgaggacgcaaacggagggcaccaagacgaagcgggcggcacggcgaactgaccggcgaccaaaacgacggcggaaggtcaacggacggcgacggcgacgaggaggaagcggcgaagctcttcggcttgacgacggcgacgaagctccgacgatctccggcgacggcgaaggggcggacgaggacggcgacgacttggcgagcacgacggtggtcttcccgagcgacggcgacggctgaaacgacggcggcgcacggctggagcggcggcggcgacggcaaagctagggcacacggcgctagggcttttccgacgacgagaggcgaaggcgaaggtggcgacgggtagaggagacaccgggggtccttttaaaggggctcagaggcggcggcgaaggcccaaggcggcggcaacggcgaaggaaagctcggcttggagagagggaaaccgatccgtaacgaactcgattccacgaacttccaaaacgatttagccaaa

SEQ ID NO: 87603 - DNA, 1097 bp, Oryza sativa
ggacgatgtggttggcggcatcccggacccgcgcgcgcgcatcgtcctcggtcccgggagggaactcctccagcgccatccatggggagaagccggggtccctggcctggtaactcgctaacacgagttccaccgctccttgggcgaggtccctcgaggatgacttgatggtcttctcgagctcctcggggagttgttggacagcccaggccatcctcctaaggtgcggggcgaggccttccagattggtggagcgcgaaattgtctggcctttccagaggcccgcttcccgaccggcgcgatccagccgggagactgcatcccaaagcatgccgggccctatctcacccgacaagcggagggcctcggcttccccggtggatgagtccagggcgcgctgcatgtccgcgacgttgtgttcggcagctgcgaggcgggcgactaagtcgctttcgcccgtagccgccccgccgctgcgcttcctcgcatccagctccttttctcgcgtctcgaggttagcagcctgttgctccagcgcggctctctcggcgcggatgcattccagattgcggcgcgcctgctcctcgtgcggtgcctcgcggagggacaggctgtccgccagccgttgtgtcgcggcctcggactcctcaagagctcgctcccgctcagcaagcgcgtcctcgcggagccggagcgcggactcctcttcggcgcaggcggcctcgtgcgccgccagcgtcgcctcccggatagcggcggcggcctcgcggtccgccaagctggtctccacggcgccggcatgatcctccagcgccatggcacgggcttcaagggcctcttcgcgccgccgggacgccgcttcagcctccgttgctcgctgctctcgggcagcggcggcgtcgaggaccccctgggcggcgtcgagctttttctttagctccgcctcccagctcccgtgttgaaggcggagggagtcctgcgcctcaatcatcgcggtggtggcgacgagggcggcctctcgctcctcctccacctctcgggcgatctccgccagcgccgccttgcgggcttcaagctccgagatgtggcggcggtgg

SEQ ID NO: 87604 - DNA, 869 bp, Oryza sativa
cataaatccaagtagtttccctaatggtactccgaagatgcacttttcagggtttaatttcatcctgaaagcgcggatgcttgcaaaggtttcttctaggtccgtgatcaaatcatctttctgcttggtcttgacgactacatcatccaaataagcttcaacgttgcgaccaatctgagttgaaaaacatctctggatcatgcgttgataagttgctcctgcattctttaatccgaaaggcatggtgatgtagcagtatgccccgaagggcgtgatgaataaagtctttaagcagtcggattcctttagtcggatctgatggtaacctgagtagcaatccaaaaagctgagaagctcgcagccggctattgagtcaactacctggtcaatgcgaggcaacccaaaaggatctttgggacaggacttgctgaagttagtgtagtcaacacacatgcgccattgtcccgttttcttctgaaccaggattgagttggccagccagtcgggatgaaggacttccttgatgaagcctgctgctaacagcttagggagttcttccttgatcgtatccttcctatcctgtgcaaagcggcggagtcattgcttgattggcttagcgtcttccttaacatgtaaagagtgctcaatcacctctctaggaataccaggcatatcggatggtttccacgcaaagatatctttattattttgaagaaaggtgatgagcgcgctttcctatttacaatctaactcaacgcctattacagcagtcttagtaggattagagggatctagaggaattttcttggtcttggcttcgctttctccactctttgggatcttggttgcaggcacttctccttcacttg

SEQ ID NO: 87605 - DNA, 693 bp, Oryza sativa
tgacatgaagcaagtgttgaattatctcaagaaaaaggaacaagatgaccctgtaatgtactacaaattctagctagatgaagaaaacaaggtgacaagcctgttttggactgatggtagatcgactcagctatatgaggaatatggcgactgtatcagttttgacacaacgtttagaacaaacagatacaatgtgccatttgcaccgcttgttggggttacaggacatgggtcaacttgcttgtttggttggcatttttaggagatgaaacggcagagacattcaagtgggtttttgaaacatttataacagcaatgggagggaaacatcccaagactataattacagatcaagataatgccatgagatcagcaattgcacaggtttttcaaaacacaaagcacagaaactgtctatttcacatcaagaaaaattgcagagaaaagataggaagcatgttctctgcacaagcaaatagaaacctgtatgaggaatatgatgacatactaaacaattgcctaacagaagaagaaattgaagtgctttggcctcagatgattgaaaagttcagtttgcaaaatataaaatacttgcaactaatgtggaagaatagagctcagtttgtgcctgtctacttcaaatatgatttctgcccttttatacaaagcacagcgctgagtgagggaacaaat

SEQ ID NO: 87606 - DNA, 1808 bp, Oryza sativa
ccattttcttagcttttccatagggattaattggtaactgtaacagagtaaattattaaccaattaggtacataatatttacacatcagccttgagtttgcctttccagcaacaagatgaaatagcacagcacaatccaaacactgcagttttgaggccatcataaattaattacctgacgtgtggtttctacaataggcatcttctctggttctccataggtggcacatgtactagagtaaataagggtcttgactccatgagacgccatagcctccaaaatcaataaggtgttcgatgtaatattgtgatagtacctgttaaatacttaagattatcagagatatactagacatgtttcagatatattatacagttcatcatatctgtgatagcagataatataaatatctgagaactaaaaatcagaaagcacttgattatggagttaacattgtagcataccaagtaccatggattaatagtgaaaactgttttttatcataaggaccttttcccctagcactacaattaggccattagacaagggtgtgtacaatggtaacgtctgtaggggttagtagaataagaggtcccccaagctcatggaactgacaaactgtcaataaggtaatgacttacctaaggggttccaatgtactctcacccacataggcaacagcagcaaagtgcataacagcatcaaacgcattttcggcaaagatcttgttgacctgggagccagttaagtgaaaaactggcatttgaacattttaaaaattacgaggaggtaatttagaagtacaaaatgaggatacagttttttgatctccaagaatcagcatagataaactgaagtcttcctggctgggggaacaactcttggagaacctttactgctcccatgtttcctctagaaagattgtcctaaaaatcacaattaaccatcaagggtggcatttgaagaacaaaccagttcagaaattcagtacaaaggaaaacttaattaccacaatggtaactcgataattgtcctttaacaggcgtaatgaagcatgtgacccaatatagccagctcctcctgttactaagacatgagtaacaccaggttcatggcgagaaaactgcaagatacataaccccacaatcagttatacagttgaattaaaaataggggaaatataagaatggcataataataattgcagcataagaaacataacaggcggatttgcatgaagagttgaaagattaagcaacagaagtcaaaacagatggaacatatccaagtttagccatacacatactaggtctgcatcgcagcttatacatgtttctagacaacaaaagtaatgtgctatgtttgaccttcactctgcaacagtctcttaacattttattctaaagaactggatagttagcctgtagttttagagatgtgatatatttacatctgcaaatcatatcgtagttttcttgaacaggaacatgtcaaaattattatgcagattgattagctgtcagaaggtcttcgtggctgaaagctacagtttgttaggatgccatttaggcatcaacttgccgcaacgaaaagtggcaaacaacttatgaagatatgtgtattgaaatatcaagttggaacatgaactaatgtaatagacattgcaataacaaaggcaattggatggagagatgtcactttcctcacctgcttgttagcactgagagcagaaatgaagatatgtgtattgaaacaactacaatagcagtcatcattttgttttatgctagttatacaaggacatatt

SEQ ID NO: 87607 - DNA, 618 bp, Oryza sativa
ccaagtaaagttggcatttacaatgttggcactgtaagaggtttgacaatatgagctttctttatttactttgattaaatgcagttcgctcatgctaggacagaatcagattttaattaaatgctgcatttgttggttattttacatcaaatttttacgctggaatacacacagatggttattctggtagaataattttttattgtatgcttatgaaaaattgacttctcttgtcaaattatctccattctgcatttttactcatgcatttcttgtgctgtcaatagtatattctaatatatgtatgattgctttcaggtcgttcagtcaaggagtttgtggatgcctgcaaaaaggcaactggagtcaacattaaaattgagtaccttagcaggaggccaggggactaatgctgaagaaacaagtgacccaacaaagatcaacacggagctcaactggactgctcaatataccgacccttaaagaaagcctgtcagtcgtttgaagatggcaaaagtcacatccacgcggatatgggtcaaactaaatatagcttgctgatcaataatcctgctgaatcgtcgatatttgatttttttagttagtggtataggatct

SEQ ID NO: 87608 - DNA, 723 bp, Oryza sativa
atatattttggtgggaacgggaaaaaggttgggttcatagatagcgaggctcccagtgcgaagtcgacccctgcaacgtttaaggttgttgcagaaaaggtttgcagaatgagaagcaaaagcagtataccctaaagttcgtggtcatgcctacttttgcatggatctcatatatgaatactctttgctcgttgatggcttgggaacataaaaatgtttatataggacataaatgttcgataatataattgacatgagtgcactaatatatatttttggtgatcaggtctggatccaaataagaagataatgctggtaaacaaggtgaagcatggggagtactacattgacgcggcttggccattgggtacagctattgaagctgtatcacccaaaaaagggcttcaatagattgatatgaacgattttaagatctactactccctttgtccaataatatggtaattgaatactaaatggaacatattgtagtacaacgaatctaaacagatcttttatccaaattcatagtaataaaatacatatcatttgatctgatgttagtagatctcagatttatatattttaggatggatgtagtacttacttagaaagttaggatatctaatgttgtatgatcgatgtttatatgatggttattatagtaacagagtaacatacactatgttaatagtggagctagctagcagaatacatcaaggc

SEQ ID NO: 87609 - DNA, 619 bp, Oryza sativa
agttcttctacaacaacagcttttattttagcctgaagatgtcccccaatgaagcattgtttggtccaccatgacggacgccgctgatgtggtctaagacaggtgaatgagcggtctttggacctgacattatcaacgaggccgtatagaaagttcgcctgattcgagaccggttaaaggtagcacaatcacgacaaaagagttacaccgacacccgaagaaaaaacctggcatttaatgaaggagattacgtttatctaaaggtttcttccatgaggggaaccaaaaggtttaacgtcaaaggaaaactggcaccaagatatgtgggaccattccagatcatcgccagacgaagagaagctgcataccagttacagctagcagaaaatatcgccgatgagcatgcaatcttccatgtgtcccaattaaagaaatgcttacaagtgccagaagaacaagcttcgttcgaggaaattcacatttgcaatgatctgacgtatccagaacacccaattccgatattggatgaagctggaaagaggactaaaaccaaactctggcgtatgtacaaagtacgatggagtaatcacactgaagatgaacccacctgcgaaagcga

SEQ ID NO: 87610 - DNA, 1439 bp, Oryza sativa
tgtccggcgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacggcccggtttggagtggctaaccgtattattacggataatggcacacaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcacggcgattcatggatcgaggagttgccagcggtgctctgggcaaaccgaactacaccaagccgagcaaccggggaaacgcctttcttcctcgtctacggcgcggaagcggttctcccatctgagctcaccctgaagtctcctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgtcacgtccgggcccgatcactctgcgtcgacgacctcgtcctacgctgcgtccaaacgcgtgctggattgagcaagctctcaccaatgtgggagggtccgtatcgagtggtcggcgtcccccggccgggctccatacggctggccacgggcgacggcactgagctgcctaacccgtggaacatcgaacaccttcgtcgcttctacccctgaggggggggtcgggtgtcaggtttcgggctcgggccaaccccgcaccccctcgggcgtgcagggttggccgggggctgccacacatgcactttcttatttctcttatttcagtatttcaataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccgcgccttttgaggactgggacctgggcacgaacccttaatcaagctaagacacaaaaggaccacggcacagatcatcctcatctcatacacacag

SEQ ID NO: 87611 - DNA, 1005 bp, Oryza sativa
tggggctcctcaccgggagaccgcgcaggcccccctttgccggttcggccgggggcgctaagtgaggttcttcaccctcgatctgtggaatgttcgcgagagagcaaatgcacaagacacgggcgatgtagataggttcgggccgctgagaagcgtaataccctactcctgtgttctggtggatctgtgtgtgaaagagttacagagagccggagagcaagagagttcaggctttagaacccctcttcctctttctctcctctacgagctcaggtattctcagagtcgtctgagagtctctcccttttttttctcgtccccttgcttcggtgggcaaggtcctccttttatatctcaaggggataccacatgcaccatttttacctactcttcttttggatggggacccaccctatcttgaccaaaacttggctcgcgccttcgcctggaagctaaatcacagcttgtccttgagtgaggccttgcgccgtcactcgcctgacacaggggatagccctgtcattccttcattaatgggtggagatttgcaatggccgctgtccgaatgaccctccgatgggatgggtcatacctacctccactccgccggaagcagatgcaacgtgggagcacggttgtctgccgatgacgtgaccggcgtcagaccagtcacaaaccagtcattcttgtctaccacgtgtcagtttagcatgccacacgtctgcccttcttcatacaatgacttccttgtaatggttgcgatgaagcctggtatgaatctggccgggactgacatacccactccaggagctagcacgccggctccggctagggacgagtgcctagaggctatcatcatttcgacgtgacggggcgaggcgtgtgacaggccgcctgttgccacctaacccgcgatctgaccggtctgtgaccggtcacacactgcgactggtcacggaccggataagcgcgcactgcgccgcattaaatgcggcgtgacgcgct

SEQ ID NO: 87612 - DNA, 556 bp, Oryza sativa
ttccttctccggtgaaatcaattgaggggaaatgtttcccgagatcttctctacctttttccttttggaatcgatcgccaattcggttggaaatccgtggattcgagttcgattcggatcgatctctctcctccgaaccctaaactttccttcgcgtcgccggtcgccgtgggccttcgccgccgcctccttgcccctataaaaggacccccggtgtctccgctacccgccgccaccctcgccttcgcctctcgtcgcctgtagagccctagcgccgtgccgcttagcgccaccgtcgccgccgttcgtccagccgtgcgccgccgtcgctctggtcgtcgtcgccgctcgggaaggccaccgtcgggttcgccaagtcgtcgccgtcctcgtcccgtcctccttttttgccgtaggtcgccggagcaccgccgtccgttgatcttccgactttgttttggtcacccgtgagttcgccgtgtcgccctctacgtgttggtgtcctgtgttcgcgccgtcgcgccatcgttcgccggagagcttgcacgcccgagcc

SEQ ID NO: 87613 - DNA, 7329 bp, Oryza sativa
tccccacccatgtggaaaacaacatgcagcacttaatggcagttcagatacaaatcttgcaaggattagccgcagccgtagccggttatcagcacaatgcgcatggaaatggccaccctcacatgggcaataatagatccaagctgacagattttctgaggtctcgtccgccagagttctctcagaccgtcgagcccgtcgaggctgacgattggctgaaagatgttgatagaaaactcaacttggtgcagtgtactccggttgagaagacgctctacgcctctcaccagctaagaggacctactgcagattggtgggagaattactgtaatgcataccctgaacccactaacattgcttgggatgagtttgctacggctttccgtgcagctcatgtgcctgaaagcaccattgacatgaagaaagaggaattcaacagacttaagcaaggcaacagcagtgtcaatgagtacctaagtatgttcaacaagttggctcggtacgcccctgaggaagtggacacagataagaagaagatcaggaaattcttgaaaggaatcgcggttggaatgagactccagttgcttgctcacgacttccccacttttcaacatatgatcaacaaggcacttctacttgaggatgccagaaaagaggctaccgaagaatacaagaaacgcaagtctaaccatcagggaaattcctcccgaggcgcacctcgccctcgctacggtcaacccatgcaataccaccagtcggtcactcaggctaaccgccagccaggctacgccccttgtcctcaaatgaaccgtccggcacctcagccacagcagcgtgcccctagtggcaatactgcgccaaacagtgttacctctttcaagtcaccgcaaggaccgtcagctgttcagtgtttccggtgcaaccagatgggccactatgccagacagtgccctcagaatcctaccaacaccagctcacggcatgctaatggcagcactgccagaactcctactccagcggcagctcagtctcgtcctagctctcaggcaagtggacaaggtacttgtgcttccaacaactttggtcgaggccgggtgaaccacattcaagctgagaccgctcaggatgctccagacgttgtgatgggtatgttctctgtcaactccgtacccgcaatagttctgtttgattcaggagcttcccattctttcatatcacaagcttttgtgaaaagaaatggttggaaaacccaaaatttacgtgtaccaatgatagtacattcccctgggaggaatataagggcaactcaaatatgcccggaagttaaccttagaattgaggaagttgacttcctagccaaaccgatagtcctagactcgcaaagcttggacatcatcctagggatggattggttggctaagcacaaaggacagatagattgtgccgaaaagtccatcaccttgcaaggacctggaggaaagcaagtccgttttacctctaacacccctaccgcaagtcggtctatcttaacctgtttacaagtcacctccttggagtcggtgcccgtagtctgtgaatatcccgacgtatttccagaagaattaacgagtatgccaccagaccgagagattgagttcgccatagaactggcaccaggcaccgcaccaattgcaaaaagaccctaccgaatggtagccaatgagctagcagaagttaaaagacaaatcgaagaattgaagagtaaaggttatgtgcgacctagctcatccccttggggagccccagtgcttctggttaagaagaaggatggctctgagagaatgataatcgactatagagccctgaatgaagtgactataaagaacaagtacccgttgccacggattgacgatttgttcgatcaacttaaaggagcaagagttttctcaaagattgacttaagatcaggttaccaccaattgaaaatcagatctgaagatatcccgaagactgctttctcaacgcgttatggtctatatgagttcacagtgatgtccttcggactcaccaatgccccagcattcttcatgaacttaatgaacaaaatctttatggaatagctggaccagtttgtcgtggtgttcatcgatgacatcctgatatactccaagaatgaggaagaacatgctgaacacctgaggctaataatggaaaagctcagggatcatcaactattcgctaaattctcgaaatgcgaattctggttagaccgagaagcattccttggacacgtgatctcctccaacggtgtcgatgtagatcccagcaaggttgaagctgtacttgcttggaacccgcccaagaacgtgttagagattcgcagcctccttggcttagctggatattatcgaagattcattgaaggattctctaagctagtcagacctatgaccgagctgttaaagaaggaaaagaagtttcactggtctgcagcctgtgaagacagctttcaagaaatgaagaaaaggttgaccactgccccagttctcaccttgccagatatccgaaaagatttcgagatcttctgtgatgcatcaagacaaggcttaggatgtgtcctaatgcaagaacgaaaggttgtggcctatgcattcaggcagctcaggcctcatgaagtcaactatcccacccatgatctcgagttggcagccgtgtttcatgctcttaagatctggaggcactatttaatcgggaacagatgtgaagtatacactgatcacaaaagtcttaagtatatcttcactcagaccaaattaaatatgaggcagagaagatggttggaactaatcaaggattacgatcttggaattcattaccaccccggtaaagctaatgtggtcgctgatgcgctaagtcgcaaggcctattgcaatgtagctcaaatacggcctgaccaagatcgcctgtgcagagaattggagaagttgaggctgaccgtggtacagtcaggtgtccctgccagcttgacagtacagcctaccctagagtcgcaaatccgggaagctcagaaagacgacgaagggataaaagagttaataaaaagaatacaggagaagaaagacaccaatttctccatagacgatcaaggcacagtttggtgcggtccacgcatctgtgtaccggccaagaaggaattaagagatctcatcctaaaggaagctcatgagtccgcctactccattcatccaggaagtacgaagatgtaccaagatatcaaggcatacttctggtggactggaatgaagcgagatgtcgcagaatacgtagccttgtgtgacatttgccaaagagtcaaggcagagcaccagaggccagctggtctgctacagcccctaccaattcccgagtggaaatgggaagaaatcggaatgtatttcatcaccggtttgccaagaacccctagcgggtacgactccatctgggtaatcgtggatcgactcacgaaatcggctcatttcgtgccagtgaaaaccatctttgatggaaagaaactagcagaactctacatgacccatgtcgtatgtagatttggctgtcccaagaagatcgtgtcagaccgaggcactcagttcacctcaaggttctggaaacagttgcatgaagctctcggaaccgatctaaattttagtacagcctaccatccgcagaccgatggtcagaccgaaagggtaaaccaaatcctagaagacatgctacgtgcgtgtgccctggatttcgaaggcacttgggatcgttgtttgccgtatgctgagttctcatacaacaacagttaccaggccagtattcagatgtcgccgaatgaggcaatgttcggaagaaagtgccgcacccccttgtgctggaatgaggtgggcgaagcgctggtattcggtcctgacatactcaaggcagcagaagaacaagttaagctgatccgagaacgtttaaagacagcgcagaaccgccaaaagaattacgctgacaatcggaggcgtgaccttgagttcgaaaaaggagatcatgtgtacctgcgggtatcacctctccgtggtatgaggaggtttgggatgtccggcaagttagcaccccgctacatcggcccctaccttataaccgccagacgtggcgaagtggcttaccagcttgagttacctgaaggtctcgcagatgtgcacaacgtgttccacgtatcccagttaaagaaatgtcttcgagttccagaagaacaagtccccctgggtaacatcgagctggaaaagaatctgacctacaaggaaagaccgatcaaggttcttgaagaggcagtacgtcagactcgaaggaagaccattaagttctacaaagtccaatggagcaaccactctgaagatgaggcaacctgggagcgagaagatcttctccgcgccgagttcccggagctgctcccttaggtgctgaatctcggggtcgagattcttgttaggggggttggtctgtaacgcccgttccgtcgtggcgcctagcgggaaaattatctcttaaaaaccctagttgcgaaatttgtttctttgcttgttgtctagtgtccgtgccatctcaagatctcaaatccccgatctatcgtcgagttcaattccgaatccaaatccttccaaatcaaattcctccgcaaaagtctattttgtctcccccagggtcgatgggccgaatttctctcggcccatctccccccttcctcccggctatctctctcgctctctctctctctctctctccccctccccctccgctccgcccgcgcgccgcgcgcgcgtgcgcgtgagccgccgagccgagccctcctctttgctccctcgctgccgctccccgcgcgtcgttcgcgcgcgcgcccgcgtggtcgtcgcccgcgtcgcgcctacgccgtctgcgccgcccggccccgctgctctgccgcgcctgcagccgctcggccccacagccagcgcgcgtgcccgagccgcgccgctcaatccgccgcgcctcccattgcatcccgcgcgcgcgtgccgtggtggccgaccgcctggtcaccgtcgccatcaccctctgccgcgccagcccgcacctgtcgcccgtgtcgccgctccgctccaaaccgtcccgccgtcatcgccgtcgtcatcgcctcggccccgccactccgcgcgcaagccgccaagggacggaggcagagcccctcctccctctgccgcgacgccccgctcccctcctccttttcccaaagcggcaaggaggcaaacccctttctctccctccttttcccctttttctcccgccggcgttatcctccctccgtcctgtcgccgatttggccgcgagcgccgagcgccagctcgcgccttgaccgcccaaagtcggtttccaaaccgacattgccgcccttaaagccccaggcgccctcccttcctctttccccccccaatcctccccgtttctcgtccgcgccattgccgccgcctcccgtgctctgtctcgcctccgccgttcatcgccgagcgccgggagagccggtgcgttcgaggacgcgaaaggggactccgggcgctcgtcttcttcctcttccccggcccgaggccggagagattactcccgcgccgtcggcctctcgtcactgcgccccgcccgcacggtagtgcctccctccgttcttcctcctcggtccatctcccccccttagttttcggtggtagcatgagtagcctccccgtagctagccggcgccgccccgaccgttgccgtcgctcgccgtgtgctccccgccgtcgctgcccgagctccgtagcacccgctcgtcgccggcctcgctcggcgtagctccgcccaatccgacgctagcatcggattcccgtagccgcgtagatgctctcgccgccgggaattggcccctcgtgacctcgtcgccgtttcccccttttccctccgccgggcgccgccgccgcaatccgccgccgacggactccctccggcgaatccaagccgttggctcgctcgctcttattctccctcgtcatcccggtgtacgccccgtcgcccctcatcgtcgcaaggcgtcccggagaaaccgccgccgcccgcggtccattcgcggccggcgccttcgtcttcctcccgccagcccgcgtggcagcgcacgtaggcgccagctcggccgggtcgagccgaccccggtcagcccctccccgtgcgcgcgttccaccgcgagccgtgaggctgcgcgtgggcccgccgcatccgcatccaccgcgaatcgtgcgcgtgcaccgcgtccctcccccgcccgcgcgcgtgcgccgcgtgctcgctccgcacggtgaaccgtgtcaccgacaagcgggtcccacccgggaccacacgtggtgagcccggttcaccggctctctctctcctccctcccgcgcgcgcgcgccttgggccgccttgggccggccggcccatttagctcggccggaccgctccatttctctcgggccgcgccctagccgcccgagaaaagtctattgtccctccctcttttcttttcttttcttttcttttctaaaaaggatttaattaaatccttttcctttagaccaaaaatccaataatcttagaaattcaatatccttccaaccgtaagtccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggatcgcacttaatctgttgtcccgtctgcaaggcagatcggcggacctacctaatttgttgcatttgatccttcctttgctaattgatataccatgttcccttgtaaccatctagttgcgtcccgatattcgtgcaccctgtgcgagtatcgacggacgccttcaaacttaaaattctgagtaacttcttgggtaaaacttgggttttacaaaagacttggaaaacccgacacctgggtcggtgcttgcgaactaaataaatttccaaaaccgcggaccggggaacgtaccgggtgtacggttttccgctcttgcacttaaggaccgtttccttggaatttcatccaaacataagacaagtacgaccacatgggtggaatgggacacccctggctgagtaactagcttatcagg

SEQ ID NO: 87614 - DNA, 610 bp, Oryza sativa
tcggtaccccaatatgattaattgtaatgcatgacttgccttgctctcgcactgatgagaccacagcaacgtcttcgagaaaccgcagatcgacaaaactgccgaaatctacgcgacaaacaaagcacacaagcaaaacatgctataagactactgaaacagaatacaaaaccatttttaatggattctttgcatttttcttgatctactgagacttgaatggacttaagtggagctcggatgaattagatataaattttagaagataatatgtgtttttactaataaaaaaatccttattcgatttattgcgcaataatacccagggctgacattatccaaggggcgggggcgccgacaggtgggccccacgggtcaaaggcacaaagggcgccggtccaccgtggaccgggaccacacgggtggtccacccccggtccacgggaccgacggtccagatcagccccgaggccgataggacggtgcggcggcggcgaggcacggcacggctcggcacaaagcctgctggccggccatggcaagcggcggcggtgcatggccgccgacggcggcgaccggcggagcgaggcggcggcagacagcgcgaaag

SEQ ID NO: 87615 - DNA, 3553 bp, Oryza sativa
  unsure (1)..(3553): unsure at all n locations
gggccctacctgtcagcgcccgagagagagggagaccgggtgaacttcggagggggagggaggagcaggccggcgcgagaagaggtgggccggcggcccaagaaaaaggaaaatagggaaaataaagaggaaaaagaagaaaggattttccccaaggattaaatattgcactttgatgtttttaattggttaaaattatttctaaggctctgaaaattccactaaaaatcctgttaatcaattgtgacatgtggaacccaagaaaaatcccacaatgccatttccaattattaattgcatttattaattaaggaattagctctaggttaattaaaacaatttcttcagacgatttatttaataaatttttaaagcaagaaaaaagggggaaaacttcagggcgtgacactctcaaactttcctattcaaattctctccaaatataaatcctattcaattccattacccaaatccccttcaaaattcagaaacagtttctattcactttgggcctcctttttattctccccacagcgcaagccggcccatctattctagccgagccaccgctctctcctcacctatgggcgtgcgtggcatgcgcacatgccaccgccgccatcgccgtaatttgcgccgcccccaccgccggccacagctcggtgccgccgccgttgtcttgccgtcgacaccaaggaaccaccgccgacgtcagccaccacctcacatcaccaacgtcagccgcaatttgtttccgagccgaattgccatcaccggccaatcaacggacagagccggcgccatgctcctcttcttcacgccgccgtcaccatgtccttcttgacctcctcttcttcgaaccgacctcttgccgcctataaattgacggcaaggtcccctctttttccctacatcaacagagcttgaagctctgcttctctctctcttcccttgtctggccatcatcaccaccagtcgatctcctcctccgtagctcctctttcagttncctctcaccaccagcctcgcctngccgaggagaatgttagtagataaaccttgtgtgttggcatgtttctctttctgttttgcatgcgtgcgagccccggtttgtggaagctgtgcgaatagatgtcatggcgcgagaatagctcggcgtggcgcaggcgacgggggtgtgcacgcattctgcggatccgtgggggtggacacgatcaaatccgcgacgtgggaacgtttctgaagcacacgtttcccttctttgcatccttgtatttgctataaataaggagaagaaaaaacctgaaaagctgcaagcagtttgcagcgccaaactcctctgtttgctctgttcttcgcgttttcagacggtgtacagtgttccacaaaggtgttcgtccaaagtgtcgcgtgtgttcggctcgccgattggttgggtgattcctgacaattggtatcagagcgaggtttagggcgtggacacgtgatcgcgcactagaagcagcattcatgcctcgccgtcgctcgtcgtccccgatcgggcatactctaggaagttccggcggccgcgccatgggcagtggcgggaatgatcgcgggctgttgattcaccgcgtggtcaaggaggcgggaggtccggcaaacaacccggtgctcatgaagacgaattacaacgtatggtcactgttgatgaagatcaagttgcaagctcgctgcttgtggggagcaatcgacccaggagaggttgagctccatgaagatcggatgacactcgatgccatctgcagcgtggtccccgcggagatgatctccacgctggcgaccaaggagacggcgaaggcggcgtgggactgcatcaagaccatgcgcgtcgtcaacgaccgcattcgcaaggcgagtgcacagaagctgcgctcggaatacgaggctctcgcgtttcgcgacggggagtcggtcgaggatttcgccatgcgcctcaacaccgtcgtgacgcagctgtccacattgggggatcccgagccagatgacaaagtcgtcgagaaatatctctgcgtcgcgcgtcccaggttctcccagctagttctctccattgaaaccctacttgacatctccactttgacgctggaggaagtcactggacgcctcaaggcggttgaggactccggccagtcgtcgtcctcgtcttcaccaggtgccggggccaagctctacctcactgaggaggagtggcttgaacgtcacaagaagaagcagcaggaggccaagaagaggaatggcggagggaacggccgtggcaagcgccgcggcggacaagggcacactagcggcggcggcggtggcgtcgggaacgcggacagcactggcgttggcccagctcgcaagaccgacaagtgccgcaactgtggcaaacttggccactgtgccaaggattgcaggagcaagcccaagcaggagcaggcccacgtggtccaggacgaggatgagcccacgctcatgctcatgacaggcagctgcattgatgaggtggaggagacgggcgcgcagtgcgcgacgccatcgccgctcgcgccgcagcctcgcccagacgtcatcgagctggttgagcaaaaggtgttcaccgcgctggacgacgccaccgaccacgacaacaagtgctggatcctcgacaccggcgcgtcgaaccacatgaccggctcgagggcggcgttctctgacatcgacaccaatgtcgctggcaatgtctggctcggggacagcttactcgtccgcatcggaggacgcgggacggtactgtttgcctgcaagaacagcgaacaccgcatgctgcacaacacatactaccttccgcgtctcgccgccaacatcataagtgtggggcagctggatgagacgggcttcaaggtggtggtcgaggatggcgtcatgcgcgtgtgggatgagcggcgtcgtctgctcgcttgcatagctcgcagcccgggccggctttacttgctcgacatcaaccttgcacggccggtctgcctgatggcgcgcgcgggggaggacgcgtggcgttggcatgctcgtttcggccacatcaacttcgctgcattgcgcaagatgggccgtgagtccctggtacgtggtttgcctgtcttgtcgcaggtcgaacgggtatgcgaggcgtgcctcgccggcaagcaccggcgtgcccccttcgcgcaagaggcactccacaacgccactgagctgctcgcgctgatccatggcgatctttgtggtccgatcacaccggcgacacccagcggcaaccgctacttcctcctgctcgtcgacgactacagccgctacatgtggctgacgctcctcgccaccaaagacggtgcaccggctgccatcaagcgcgttcaggcggcggccgaacgcaagagcggccgcaagctttgggcactccgcaccgatcgcgggggcgagttcaccgtcggccacttcaccgagtattgtgcggagctcggggtgcaacgcgagctgacggctccctactcgccgcaacaaaacggcgtcgtcgaacgcc

SEQ ID NO: 87616 - DNA, 1310 bp, Oryza sativa
gaccacgatgacgcgccacttcgtttccatcgcattgacgacgtgcttgggcccgcgacgccgccgggacaggccgttcgcgagctgagcgaggaactgttcgcggtaacagcggaggagccggcgtcgttcgctgaagcagagcagcacagctactggcgacaatcgatgatcaaggagatgcgctccattgaagcaaacaagacgtggcggctcgttgatccgccggctcgccaacatccgatcgggctcaagtgggtctataaggccaagaaagacgccgccggcaacatcaccaagtacaaagcatgcctggtcgcgaaggggtacgtgcagcggcagggcatcgacttcgacgaggtgttcgcaccggtggcgcggctcaagtccgtccgcttgctgctggcgcatgcggcgtgtgagggcagggccgtgcatcacatggacgtcaaatcggcgttcttgaacgagcttctggaggaggtctatgtcgcgcagccgccgggattcgtcgtcgacgggcaagagcacaaggtgctccaccttgacaaggcgctctatgggctgcgtcaggcacagcgcgcttggtacgccaagctcgacgcgtcgctgctaatgctcggttttcaccggagcgactcggaacacgctgtgtacatgcgtggcatgggtgtgcatcggctggtggtcggggtgtacatcaacgacctcatcatcacgggcggccactccggcgagctcatgcagttcaaggaggagatgaagggcacttttcagatgagcgatctcgggctgttgaaatactatctcggcttggaggtgaaccagtctgaggacgggatcacgtgtgccagagtgcctacgctcagaagattcttgaggtggctggcatggccgggagcaatccaagcctgactcccatggagacgcgcctgaaattgagtaagtcaagtactgctcctgctgttgatgccactgattatcggcgaattgtgggctctttgcgctatctggtgaatttgagaccagacttggcgtactatgtgggctatgtcagcagattcatggagaaacccaccgtcgaacacctggcggccgtgaagcgtgtgctgcgatacatcgctagcactatcggctacggctgccactacatgaggaagaaggaggctgcaagtctcgtcggcttcagtgacagtgatctcgccggcgacctcgacactcgcaagagcacctccggcgttttcttcttcctcggcgacaacccaatcacctggcagtcgcagaaacagaaggttgtggcattgtcgtca

SEQ ID NO: 87617 - DNA, 581 bp, Oryza sativa
caactgaggggttctcatcatccaatttaatcggcaaaggaagatatagttatgtctatgtaggaaaactatttcaagacaacattgttgctgttaaagtcttcagtctagagacaaggggagcacacaagagcttcatggcagaatgtaatgccttgagaaatgtgcggcatcccaatctacttcctatcctcactgcatgttctagtattgattctgaaggcaatgattttaaagctttagtctatgagttcatgtcacaaggggacttgcataaatttctatacacaaccagagatgatataaacttgtcaaatttgaatcacattacattggctcacagaataagtattgtggtggatgtatcagacgcattggagtatctacaccacaacaatcaatggactattgttcattgcgatctgaagcctagtaacattcttctagatgatgatatgattgctcatgttggagattttggccttgcaagttataaaaccaattcctcaatgccatctctaggtgattcaaattcaacttcttcactcgcaataaagggaaccattggatatattgctcca

SEQ ID NO: 87618 - DNA, 1549 bp, Oryza sativa
gggtgttggtttcatgtcaaacaatatcaagggaaacatcccaaatgatttttcaaagttcgtctcgattgggtatcttgctgcgagtcaaaacatgttgtcaggaaggtttccacaagccatcttaaatctctctactcttgatgttctttaccttggttttaatcatctaagtggagatttaccatcaaatcttcttgactcgctacccagcatagaaatactttcattgggagggaacttcttccaagggcatatcccctgctctgtggtaaactcttccaacctaggtttactagacatttcatctaataattttactgggcttgtaccaagttccattggaaaacctaccaaactgtatcacctaaatcttcagtccaatcaacttcaagcacacagaaagcaggattgggactttatgaatggcttaaccaactgtactaggctacaaatgatctcgatagctaataaccgtctacaaggccatctaccaagttcattaggtaacctttcctctcaacttggaatgctacatttgggaggaaatcaaatatctggtgttttaccttcggacatagaaaacctctccagccttacttatttccggattgataccaatgaaattacaggtgtccttccagaatggcttggttctcttaaacacctacaagtattaggcttatttaacaacaacttcacggggtttattccaccgtccctttcaaatttgtctcagctggtatatttaattctagattttaatgagttcgatggacacataccacatatcttgaaaaacctccatatgcttttatcattcagtgctttccacaacaatcttcgaggtagcataccaaatgagatatttacaatcccatcaatagttcaagttgatttatctttcaacaatctagatggacaacttcctgcggcaatgcaaaacaactttcaaagttgtcacttgcatcgaataagctatctggagatattcctaacactttgggtgattttgaaagcttggaatacattgacttatcctggaataatttcactgggatcatccctgcttccataggaaagataacaagtctagaggttctcaaattctcacacaataacttaactgggccaataccatcattgcttggtgacctacattttcttgagcaactggatttgtcattcaaccatcttaaaggtgaggttccgatgaaaggaatattccagaatgtgacagccttgagcattggtggaaatgagggactatgtggtggatcacgagagttacacttactcgcatgccctgtcatatctttggtctcatctaagcacaagaaatcaattttactaaaaatactaatcccagttgcctgcttggtatcacttgctatggtcatatctattttttttacttggagggggaaacggaagagagaatccctatcattaccttcatttggtacaaatttccccaatttttcatataataatctattcaaagcaactgaggggttctcatcatccaatttaatcggcaaaggaagat

SEQ ID NO: 87619 - DNA, 638 bp, Oryza sativa
gtaccctcacatgtgccacacaccggaacgcgcaggtggtgcacggccagtgggactccattccaaagctcgtatggggtcttgccaccaatgctcttggacgagctcctgttcaacagatacacagccgtgttcatcgcctccccccaaaacatacctaggagtcctttggccttaagcatgcttcgcgccgtgcccacaacggactggttccggcgttcgacgacgccgttttgttgcggcgagtagggagccgtcagctcgcgttgcaccccgagctccgcacaatactcggtgaagtggccgacggtgaactcgcccccgcgatcggtgcggagtgcccaaagcttgcggccgctcttgcgttcggccgccgcctgaacgcgcttgatggcagccggtgcaccgtctttggtggcgaggagcgtcagccacatgtagcggctgtagtcgtcgacgagcaggaggaagtagcggttgccgctgggtgtcgccggtgtgatcggaccacaaagatcgccatggatcagcgcgagcagctcagtggcgttgtggagtgcctcttgcgcgaagggggcacgccggtgcttgccggcgaggcacgcctcgcatacccgttcgacctgcgacaagacagg

SEQ ID NO: 87620 - DNA, 1762 bp, Oryza sativa
tgaatgagagggtcaggggcaagatgaacatttcgcattccattgccaccttggttggtgatggggtagccgtgggccctgaatttgggtgtaaaatggtagaggagagctgatttgtggggacctggggcaaattatctaagttatttgggaagatggcatttgagaatgctacatcaaagtgaatggcaaattgtccaaaatcccgacgagggaatagacaggagaaggcgagcgagacggcggcgcttcagtggccaggaggcgacgacgtcggtggtggattgtgttcccgagcgacgtgcacccggggagggtggtggtcggcagagggagtgggagaggaggccagaacggtggatggaagagctctactccggccggtgtagcagtgatggtggtggcttgattcaaaggggaaaagaagggggaaaggggtaaaatgggttctctgtcaggaatcacccaaccaatcggcgagccaaacacacgcgacactttggacgaacacctttgtggaacactgtacaccgtctgaaaacgcgaagaacagagcaaacataggagtttggcgctacgaactgcttgcagcttttcaggttttttcttctccttatttatagcaaatacaaggatgcaaagaagggaaacgtgtgcttcagaaacattcccacgtcgcggatttgatcgtgtccatccccacggatccgcagaacgcgtgcacgcccccgtcgccagcgccacgccgagctattctcgtgccatgacatctattcgcacggcttccacaaaccggggctcgcgcgcatgcaaaacagaaagagaaacatgcaaacacgcaaggtttatctactaacaaatctccccctaaaccttgcgtggagttttgatttcgatgaggccaatccgagaacgaagttcgatgaatctgtcgcgcccgagtgccttcgtcaggatgtccgccaactgcccgtcagtgccgatgaactcggccttcaccctgccctcctcgatgcattccctgatgtagtggtatcttgtgtctatatgtttgctgcgatcatggaagatagggttcttactgagcatgattgcggattggttgtcaatcttcaacgtgacggcgtcggcctcctctccccggagctcagcaaggagacgcgccagccacacgccttggcaggccaccgttgtcgctgcgatgtactcagcttcgcatgacgacaatgccacaaccttctgtttctgcgactgccaggtgattgggttgtcgccgaggaagaagaaaacgccggaggtgctcttgcgagtgtcgaggtcgccggcgagatcactgtcactgaagccgacgagacttgcagcctccttcttcctcatgtagtggcagccgtagccgatagtgctagcgatgtatcgcagcacacgcttcacggccgccaggtgttcgacggtgggtttctccatgaatctgctgacatagcccacatagtacgccaagtctggtctcaaattcaccagatagcgcaaagagcccacaattcgccgataatcagtggcatcaacagcaggagcagtacttgacttactcaatttcaggcgcgtctccatgggagtcaggcttggattgctcccggccatgccagccacctcaagaatcttctgagcgtaggcactctggcacaccgtgatcccgtcctcagactggttcacctccaagccgagatagtatttcaacagcccgagatcgctcatctgaaaagtg

SEQ ID NO: 87621 - DNA, 883 bp, Oryza sativa
tagggcgaattcgagctcggtaccctcaagaatttcctgatcttcttcttatctgtgtccacttcctcaggggcgtaccgagccaacttgttgaacatacttaggtactcattgacactgctgttgccttgcttaagtctgttgaattcctctttcttcatgtcaatggtgctttcaggcacatgagctgcacggaaagccgtagcaaactcatcccaagcaatgttagtgggttcagggtatgcattacagtaattctcccaccaatctgcagtaggtcctcttagctggtgagaggcgtagagcgtcttctcaaccggagtacactgcaccaagttgagttttctatcaacatctttcagccaatcgtcagcctcgacgggctcgacggtctgagagaactctggcggacgagacctcagaaaatctgtcagcttggatctattattgcccatgtgagggtggccatttccatgcgcattgtgctgataaccggctacggctgcggctaatccttgcaagatttgtatctgaactgccattaagtgctgcatgttgttttccacatgaggtggggaagggaggcgttcttctccagaattgtgactggcagtgtggtgagagcggtgagactgttccatctctgcattacgggaagctgtgcgatgcgagcggttgctgcggcggggttgctcaacttctgcgttgcgggaagcagtgcggtgcgaacggttgctgtggtgagactgctcattagctgactcatgatttgcttctgtcacaactctaccttcttcaaaaccgaagcgggctggcgcacgggctgcacggggggggggggggggggggctacccatctaaactcccagaagagggcgaggta

SEQ ID NO: 87622 - DNA, 908 bp, Oryza sativa
tcactgcttgagttcaagaaggcaatcactcttgatccccagcaagtcctgatttcttggaatgacagcaatcacttttgcagctgggaaggagtcttgtgcagaaagaagacaaccaatcgtgtcatttctcttaaccttacgaaccaacgtttagtaggagtaatctccccttctcttggaaacctaacattcctaaaatttctgtacttagacacaaattcattcaccggagagatccctctgtcccttggccacctgcatcatctccaaaacctctacttgagcaacaacacattacaaggaaaaatacctgattttacaaacagttccaacctcaaggtgctactcctcaatggcaatcacctcattggacaattcaataataatttcccccctcatcttcaagggctggacctttcattcaataatcttactggaaccatcccctcttctcttgccaatatcacggagctattgggtgttggtttcatgtcaaacaatatcaagggaaacatcccaaatgatttctcaaagttcgtctcgattgggtatcttgctgcgagtcaaaacatgttgtcaggaaggtttccacaagccatcttaaatctctctactcttgatgttctttaccttggttttaatcatctaagtggagatttaccatcaaatcttcttgactcgctacccagcatagaaatactttcattgggagggaacttcttccaagggcatatcccctgctctgtggtaaactcttccaacctaggtttactagacatttcatctaataattttactgggcttgtaccaagttccattggaaaacctaccaaactgtatcacctaaatcttcagtccaatcaacttcaagcacacagaaagcaggattgggactttatgaatgg

SEQ ID NO: 87623 - DNA, 616 bp, Oryza sativa
ttgtacatgccttaattatttggtattgttgcacctatttgcaaggaatacttctggctttgtgtaccttcgatttgacagtataccagctgcaatgagtgcacagaaagcacttcatgggaggtggtttgcgggaaagatgattacggcaacatttatggtatggaatacaacatttaattgaggtcaatcttccctttctaaattttgggtttgctgattgctcttttgctgtgtcagtctccgcagcagtactcaacgaagttcccgagctagcggacagcaactttcggttgatcgctgaagattcttgctctattgctgtgtaacggtctcctgtaacattatgtcatgcagccttttgtactttatagcatgggttattcaacactaagttcgcatacatcactcgtttttgcttaagacattatctataagctctcgaagtgtacggcgggcaaatattttaactcttggtgtttcaattgatcgtgccgtgatggcaaatattaaagaaatgttgtcgaattttggggcaatcgtaattgcccaggaaaatgatctcattacttgatttatacccctatcatccgtttgaaaagcagaaattcttgtt

SEQ ID NO: 87624 - DNA, 690 bp, Oryza sativa
gtatcttctgcagcgagatccgggtggaccgcgacacgacggcgttgagccttcgccatcggctcctcatcacgtcatagccgaaggcgaagatgtcctccttgcgtgcaggttggccagtatcacctttaggatcttcagcatccggagctgggtgtcccgggacgcgcccatgatgctctgctctacgtacgaaagtgctcttttcgccaccttctcgtcccttatcagcgcccatctgcgcaacgcacagcacggtatgacgtatatgtagtgtacaagtttttgcgtcgttgtgttcacgtgtcgcttgcaatgtcaggcttaatttgagggcgtgtacccgaatctgctgccggcgtggccggagagcttggaagcggtgaagagcatgacgtcctcgtcggcgggcgccgggatgtgcgtcaggtgaggccagtagtacgcgtggtcgacgatcgccgacgagccggcgaggacgggcttgcgcaacgcggtgtcggggttgttcggcgaggtgacgaactcgatgaagcctttggtggagtttcgcgagccgttgtttgaccacgtagcggtggtgccgtcccatctgtactcccggccgtcaaacatgtcggtttgtgacttgtacgcctacacatatcatcgatcaaagcagttcacttcagcacgacttaataaactgag

SEQ ID NO: 87625 - DNA, 613 bp, Oryza sativa
tatagggcgaattcgagctcggtaccctaaatgccataactggcggttcatctttaggagtcgaatcaaaaagacagagaaaagcttatgtgagacaaataaatcatgtgggcacaagttatcagtcaattccaccagcttactcaaacacagttatctcgtttggcccggaggatgctgaaggcatacttttcccccatcaagacccgttagtaatatcagtggaaataacacagtgcgaagtgcaaagggtgttggtcgatggaggaagttcggcagatgtacttttctacgatgcatttaagaaaatgcaaattccagaagacagactaactcatgcaggaattcctttacaaggatttggtggtcagcaggtacatgcaatcggaaagatatcattacaagtggtgtttggaggaggagaaaataagagaagagaagaagtcgtgtttgatgtggtagacatgccatatcaatacaacgccattttgggaagatcaacaatcaacatttttgaagcaatcatacaccacaattacatctgtatgaagcttccggggccgaaaggggtcatctccgttcgaggtggtcaattagcagcaagaaaatttga

SEQ ID NO: 87626 - DNA, 506 bp, Oryza sativa
atgggccaaattaaggctcggagttattactgcctctgacgctcacaacgtcatttccaagcctcgatctggcagcaaatggacagacatgaaaatgtcctacttccacaccttgctctacggtggacacatctatgccggtccgggccaggataatttctggtgtcatgctgccgccttcttcttgaggaagcctaaggccttaactgcctcggcttgggtaagctcggatgaatcgcgaatatcacgacggaaaatttgcgaacagactgggagcaggttttcttcccatgtcttatccattgcgataaggacgtcgttaatctccttgataatttcgtctcctgctggggttacatcgcgttctggctggcgttctgctgagaagttgataccttcctcaccctcggtattaacatggtcgatggcggcatccaggcgctcacgtcgaggccagtattttgctgcctgcttcacgaccgtctttaggatcatctgctcttcat

SEQ ID NO: 87627 - DNA, 602 bp, Oryza sativa
tactttcagaagttcgattgttttaaacttatttcctcaaataatttcaggtaactgtcggtgcatcatttttatcacaaacattggctttggaggactcaacaatagtgaaatttgaaatatgggataccgctggacaagagaggtacacatacagcactatggttttagcttcttccaatcttgggataatggcatgctgttggtgcattagaagcattggttttgtgagaaagttctagtagtatgtgttactgatttttacaattgatccatcttacgtgccacacatgcatatggtttttctcaatcaagaactcattggtaccagccaattttaggtatgctgccttggcacctctttactacagaggagctgctgctgcagttgttgtctacgacataactagtccagaatcatttagcaaagcacaatactgggtgaaggtatgctatcgccaaattatctgcttttctgatgtctggttgattgattactctttctatcttttactatgagtttgtattttttgcccgaaactgttctagtaaaattttatatcatactgtaagattgctgctaaaatattataaatgtgttg

SEQ ID NO: 87628 - DNA, 639 bp, Oryza sativa
attctttcagttttttctccaactgcattttctcactgtttttaagcttttgctgcctctccatctctgacgtaagatgatcaacttcatgttctaccttcttatataggctttcataatcaacttcctcctttatccttatcgtgttcactattttcattgcctgaaatcacataatgaacgacttaatgtggtgttataacttataacaaaaaaggaacaagaagaaggaaacgatataaaacaactagacaacatgagtttctttctttgagtaaatgcagagttgcaattttaaacaacgagagccattgaattcatttcaagaggaaccagtaacaagtagtttagttcatgcatgaattaagtctctgatgtaatgcaacatgcacagtttgcactgtgtgcaaattaatgctgctcagttcactctagtaatttatccagatagaagcagttgaaatgatgttttcaactccatgaaactaagagcattatgttggtataagacaagtgcatggcataatttaatggcctgggatggagtagagttcaaatattaactaaccatcatatatctaatgggattcactaaaaatatatctagtgggaaaagctctgaataccatttacaagaat

SEQ ID NO: 87629 - DNA, 857 bp, Oryza sativa
acttcgacctacgagttggtacagtacttcatcacttatacattgctgcaacaccctattcagtaagcacggacatcattgtctgaagggagaaagtgcacacctagtgtactatgtcagtgaggccctggacgacggcaagacacgttatccacgagatccagaaacttctctatgttgtggtcatgacatcgcggaagctacgtcactacttacacgcccacaaagggacggccggctcatcctttaccctgggagaagtcgtcaggaataaagatatcatcggtagaattgcgaagtgggtcgaagaactctgccagttacatgtccacttgatactgagaacaaccatcaaatcataagttgtcgctaactatgtagctgactggaccatccccaaaaatagaccaggtagccagacggataatgagacttggaccatggcgttcgatggcgcactcaatagccaaggtgtaggagcaggcttcattctcacatctcctacaggggataagttcaagcacacaatacacctcgacttcaggggcacgaacaacacagccgagtacgagggcctcctcgcaagaattcgagcagcagcagcacttggcgtgaagcggctaatagtcaaaggagattctgagctaggcgctaagtaagtgccgtaacattacagatactctaatcctgaggtgacccactatgtcggctaagtgcgtaggcattgaagtgtgacatgtgtttaataggattacgtcaaacccgccatttagctggccggcatcaggaattgacccctcggaccagtagattcctcggcgtgctgcaaagccatcggtaagggaatcctggagagg

SEQ ID NO: 87630 - DNA, 582 bp, Oryza sativa
ctataacatgcaattgagctacatctttgcaagttttagtagcccgtttggtccccagaggaacatttgacaaaggagagtttggtaatgcaataccaattttaatggttgttccctcctctgataatgaaccacaaagaaaatatggtacacggttcctcccaggttccttttcccagaatctcggagtaagctacagtaagttgaatatttctttagcaatgttatagagaatcacaatagcatgcataaatcaatagtatatgtgctgtttagtttacctcaaagcaaacagcagttccatcagccacacaataagccgcatagcctggatatcagcaaaacaaaattacaaattcatgaattatcatgaatatttgacatttttactctgctcacatgtgtggaactaaatattgatataaggctataaccgatattccgatacttgacatagatatactatggttggacatgaggtgaaatgcacctgcaatttctgaggcatggacactccagatcaaatattcagacaattgataggtagaaacaccctgagttttcattccaacaaatggcctt

SEQ ID NO: 87631 - DNA, 1197 bp, Oryza sativa
  unsure (1)..(1197): unsure at all n locations
ctggtncnnattttgaactcgtncttctgcaagcagctcatcatcttatgggccatccacaccactccaactntgtccaacanagaaacactgttctttctcgtgtacggctctgaggcagtactccctttagagttaagacatcagagcacatgagtccaaaattactcaaatgaggaacaagaggaaaggcacaacgactatgtgaatcttctcgaagaacatcgagaacgagttgccatccgagcagctgcataccagcagtccctagtccctatgccgatatcaagagaaacgtgttcgagcccgcacacttgccgtcagcgattatgtcctacgacgagttcaatcccaagcagggaagaacaagctttcccccaaatgggagggaccatacacagtggttcgagtattgcggccagacgctttcaaaattgcagatggtgaaagacgcggattatctaattcttggaacattgatatgttacgtaacttttatgtatagctccaatgtatccacatctgtaagttcccttacagttcaatacatatatatatatatatatatatatatatatatatatatatatatatatatatatatatatatatatataccactactcggagggattctggcattctaaaatactgtgttttgccatatatccgccatcacgaatacacctaacaaccctntatgcccgtttgacataccctccaagtgcctatggggaacttggtagggaccccacagcttataggtgatgttagatgctttaaaccataccaccatgtaaaaatcggcttgtagaatgttaaatgagggggttttaaaaaatgtgtaaaagggaaatagttttcaaaattccaccgtggggttgggaaaacaaagttaaaagggggggtttttttaaattttgtttgggaacatttttcaaaaaaaatgggggtggggaatatccgttaaaaaactgcacagttttttgaaaatttctaccaaacttcccaccaggaaataacttttccggttttccaaaatgtggaataccaatggggaaaattcctttaggaactctgggttattgcgggttttccaaccaaaggagaaggcctctaactttgcaaaaaaaaaagaatttgtccaaaaaagcaaagagtttccaaataaatgtgcggggggtattatacaaaaca

SEQ ID NO: 87632 - DNA, 850 bp, Oryza sativa
  unsure (1)..(850): unsure at all n locations
ccttgagatgcacattggttcatcagacggcccaagaagccaccgcccacaatgcagttatattgcaaaacattattcatgattttgtttgtatttttggcactgtcaagtgcaggttgagtgtgcctgttaagcttgaaactgtaggatcgaatcacaagaactaagccaaccagaggggggatgaatggttgatataccccaaaaccaaaacttttagcggaaataaaagttaccctcaaattcgatgtaaatcggtctgaccgaagttgatccgccagtctgaccgcgctcgtgccgccggtctgaccggtgttgatcactcggtccaaccgcctgaagatcacctgccgcgtgtgaagttgccgccggtctgaccgcccttgcgcatcataagaagaaatctcagagtaccacactgcctcacgctcaggacaaacactaggacaatcgttattaaagatgctacttacatgaatacttttcgatgttcccggataagttcaaactgattgaatctcagttatcttgttgtagcatcagtttgaatttgatgtaaaatgtataaacttgcatacttgataaaaatctgcaattgatccatatgtgcacacacaaacatccatttactaaaatgtgttttgccaatgtgtgcacaagtccaagtagcatacttgcaattattgtatggntttattgtttaaacactggtcactattcttnttatttatatggaatggnggatcgaataaatttttaacctagagcacattggcctttgtaccaattttttttgtgaagtgtcctctgtgtataaggtcactttaggcgccacatgatatgtccagtt

SEQ ID NO: 87633 - DNA, 651 bp, Oryza sativa
tgatacttcttcacttccggcgagcctccagtgccttcttcaactcctcgctcgcctcattcgacaccggcttcggtccactgtccaccatctccttgccgttcccgtggcgatctggcttcgccaggaatggttgtggtggtggtggtgccagggacgacggcatccttcgggcgtcgcctttaccgggcattgaggcggctctatttccaccgatctcggcacgcaggtcctccacggtacgccgcagcatgatgctctctgcattgagcacctcgagctgcctcttgacgagcgagaacccttcagtctgaaattccggcgcatccttcttcttccccttgtcggcatcggaatgtggaggattccgcagcgtgtgctcaattgtgatcttgttcatgaccagcagcggcaacttgttgatggccaggttacccgccttgcggccgtacccgtcgtcggcgagggcggccttcagctcgggcggcacgcgcagcccccactggaaccgcaggctcgccttgctccacagcggcagcacgctcctggtcgtgaggcgcatcccggacagcagcgcgccgaccccgccggcgttcttcccgtcggcggctcacgttcgcggcgaacccgtttcccgctgaacgagaacgc

SEQ ID NO: 87634 - DNA, 1937 bp, Oryza sativa
tgtgcttttggcgtatcggctggtcagtttttgggatttcttgttcatgagagggggattgaggtaactcaaaagagtattaattcaatcaagaagattcaacctctggaggacaagaagaagttgcaggagttgatcggcaagataaattttgttagaagctttatctctaacttatctggaagattagagcgttttacacctttcttgagattgaaagccgatcaagaattcacctggggggcagaagagtagaaggctttgaataatattaaagaaatatcttagttctcctccagttttaatccctccacatgaggggattcctttcagattatatctctcggccggtgagaagtcaatcggctaagttttgattcaggagcttgaagggaaggagagggctgtattttatttgagccacaggctcttggacacagaaacaaggtattctcctgtggaaaagttgtgtttgtgtttgtatttttcttacacaaagttaaggcattatctattgtccaatgaatgcattgtgatatgtaaagccgatgtggttaagtacatgctatcggctccgattttgaaaggtaaggttggaaagtggatatttgctttaacggaatttgatcttcggtatgagtcaacaaaggcgattaagggacaagctatagccgattttattgtggatcatcgtgatgactcaatcggctcagtcgatattgtgccttggactttgttttttgatggatcagtgtgcactcatggttgtggtatcggcttagttataatttcccctcgggggaaagtttcgagtttgcctatactattatgccatatgcaactaacaatcaggctgagtatgaagcagttctcaaggggttgcagttgcttaaggaagttgaggccgatgctgtcgaaattatgggtgattcgttattagtgatcagtcaattggcaggagaatatgaatgcaaaaatgatacattaatggtatacaatgagaagtgccgagagttgatggatggatttcggctggtgattttaaagcatgtatctcgggagcaaaatgttgaagctaataatttggctcaaggggcatcagggtacaagccgatgatgagggatatcaaagtagaagttgccacgataacagccgatgattggaggtatgatgtgtatcaatatttgcagaatctatctcaatcggcttctcagaaattgcattataaagctttgaagtacacattattggatgatgagttgtattatcggatgattgatggggtgttgcttaaatgtctgagtgccgatcaagccatggttgtgatgggtgaggtacatgaaggaatttgtggtactcatcaatcggctgataagatgaagtggctgctttggcgttgtcggagatatgggtccggggatttgcgaagtgtggggaatctaccttcctatcctgctgcgtgtccgtacagcctggccctgcccccgagcacgcgaaccgctggagcagccggggggggtcggggcctcggggtgccacgtcatgcccctcgggcccttgcactgcttcgccccgaggccctcgcctagccaccatttggcggggggagcgagcgaggagggggcccaggctgagcttccattaatacgcgcaacgccccaactgccccgtgtcacatttaatgcagtgaggcagacgtgcggcgtgcgaatctgacgcgccataatcaagaatgaccggtctatgaccggtcatgacaccggtcacgtctgactagaccgacaaccgtactcccacgtcgcgtctgctcccggttgagtgggggtaggtatgacccgtcccatcggagggtcattcggacggcggccaccacaagtcttcatccattaatgggggaatgatagggctgtcccccgtgtcaggcgagggacggcgc

SEQ ID NO: 87635 - DNA, 1197 bp, Oryza sativa
catccacaccacgctaagttttcacccccacccgtcaaaaggcagtgggcggtcccctactgcgccgcggtgaatccggcagctggacaacctgacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccgtccagtgtattttaattagctaacaccattgcggtggcaccaatccaaagctatgctcatagttaaagtctatgtaataatgtgatccctatttgtgtgctagttgagctaagcatggctaagcatttcctaaaccaacatctaatcattttgatacccaggttatcaatggcatatggtaaacaataaatggctgagtaataggacccatcccagatgacattgtaaaagaatgcgacatttaatagaaatgcgggacatttgtagattgggtacaatatgatcaattgtaatgcatgacttgccttactctcgcactgatgagaccacagcaacgtcttcgagaaactgcggatcgacgaaacggccgaaatctacgcgacaaacaaagcacacaagcaaaacatgctataagactactgaaacaggaaacaaaaccatttttaatggattctagggatttttatgaatttactgagacttgaatggacttaaacggagctcggatgaattactaataaagaaaaagtccttaattatttattgcgtaataaatcccaagggctgacgtcacccaaggggggggcgccggcaagcggggtccgcatgtcagtggcacaaggggagagggagggggcgccggctggtggctcaaggggaggggtggtccaccagctggtggggcccaccgggcagcagcacaaggcgggaggggagtggatggtggttcggcacggctcaagccggccgaccatggcaaggcggcagcggccgcaggcggcctccgacgacgaccggcggacggcgaggcggcggcggccggcgtgaaggcgacggcgcacggccggaacagcggcgtggctcggcgctcgcgggaaggggaaggaaaggaggaaaggtgtcctcacc

SEQ ID NO: 87636 - DNA, 2351 bp, Oryza sativa
cagccggcgccgtgggccccactcgtcagccgcacctaagggcacgggtggctgacggctgggccccatgcggcggccacacggcgcgcccggaggcagccacgtcggcgtggccggcgggaggcggcggtccacggctcacctcggtcgacgacggcgacggaggaggcggtcggtggcggagggagacggtggcgcggctcgggttgacgaggacggaggtgttccggcggtcggcgagctcggctaggcggtggacggggtcggcggcggtgcggtgaagccggaggagacgacgtcgaggcgggggacggtcctggcgagcggctaggcccggccgaaggtcgacggcgacggcagagagagaggacaacggcgtgggcgttaatccgacggggaggaggggcggcaaatggcggaaacggactagggaggtacggggagggtttatatagggttgggagtgagagagggcagctagagggtaaggaaaccagcgtgggggtcccggtaggcatcaatggcaccggcgagatttgcgggagcaaatctggccgtttgaatgcgggagggggaggggaaaatgggggggaaagggagagggaatcacgggggacatttcccccctcttgattgcacgcgggaacagtcggggcggcggatttggcggcggtggcgctaggcgcaggcggagagagcggcgggaggaagggatgacgggtgggccccacccgttagcgagggtggcgggcaggcggaatttggccgagagagagagggaggggatttttagggttttctttttatgaaaccttttcgactttgtttatttattgataattattatttgtgctgtgaaaattctactaaaatttatttacacattttaggcttttaggaaatgtacaaaaatcctccaagccttatttgacttttaactttgcacattttaattttggaggctttcacttggattttaattattctaggcataattttaatgatatatttttagggttgtattgggacgtgataaacctaccccccttaaaaggaatctcgaccccgagattcggaagaactggcaaagaggttgggatgggctgccttcagcttgtcttcatgctcccaagtagattcttcctcggcgtggttgctccactggagcttgcaaaaacggattacccgattccttgtcctgcgctccattgtgtccagaatcttcactagcttgtccacgtaggtcaagtcttcacgaacatcaatctgctctgaatcggcctgctcggacggcactcgaagacatttcttgagctgcgacacgtggaacacatcgtgcacattgcccaaggatgcgggcagctccaactggtaagcaacttcttcgcgtcgagcgatgatacggaaaggtcccacatacctaggtgcaagcttcccttttgtctgaaacctgtgcactccccgtagcggcgtgacccgaagatacacaaaatcgtccactgtgaactccagatcgcggcgtcggttatctgcataacttttctgccgagactgtgccaactttaggttatcccgaatggttctgactttagcttcagcttctcttaggatatcagtcccgaatacttggctttccccaacttggtcccacaacagtggagtccggcatttgcgtccatacaacgcttcatagggtgccatttgtatgtaggagaactcagcataggggacacttttatcccaggtcttcccaaaatcccgaacacaagtgtggagcatgtcttctaggacctgattcagacgctcggtctgtccatccatctgcgggtgataagcggtgctaaaattcaatcgggtgcccagctcttcttggagcttcttccagaagtgaggtgaattggcttcccctatcagacataattttcttaggaacgccatggagactcacgatcctggcgaagtaaagttgagctaacttgttccctccataggtggtcttcacagggatgaatcgagccaccttggttagtcgatccacgactacccatatagaatcatatccaccttgggtttttggaagtccggtgaagaaatccatcccaatttcatcctatttccattatggtatctgtagaggttggaggagtccggccggtcgttggtgctcagctttgacacgccgacacacatcacaaagggccacgaactctgcgatttccagcttcatactgacccatcaatatttctctttcaagtctaagtacatcttcgtactgccagggtggctggaataaggactttcatgagcttcctgaagtatcaactgtttaagttccttgtcgtccagaatg

SEQ ID NO: 87637 - DNA, 1797 bp, Oryza sativa
  unsure (1)..(1797): unsure at all n locations
tgtgggaanatttgaatttgacatttcctcatacccgcatgcctgcaggtcgactgtagaggatccccttcccttttcccgattataaaaataatatcctttcgcttccttaggataccccacaaagaagcatttatctgatttaggtgtgaggttgtccgattgcaaacgttttacatagacctcgcagctccaaatctttagaaaagacaaactgggatgcttcccaggccatatcttatatggtgtcttctccactgattttgatggaaccctgtttagtgtcaacgcagctgtctctagagcgtaaccccaaaagcttagcggcagatcagtttggctcatcattgatcacaccatgtccaacaatgtacgattcctccgttcagacaccccattccactgaggcgtttttgaaggagtgagttgtggaacaattcaacattcctttagatgattgccaaattctaggctcaagtactctccaccacgatcagatcgtagatacttgattgtcttgcccaaataattttgtacctcattctaaaattccttgagcttttcaaaggactcagacttatgcctcattaagtagacataccatatctacttaagtcatcggtaaaggtaataaagtacccaaaaccacctttggcagttgagctcattgatccacatacatgagtatgtactagtcccaatagttcacttgccctttcattttgacccgtgaaaggtgcctttgtcattttgccaagtaaacaagattcacatgtctcaaatgattcaaaatcaaaagagtgtagaagtccatctctatgaagcttctccatgcgtttctcatttatatgacccaagcgacaatgccaaataaaagtgggattcaaatcattaggacgttgcctttttgcattaatgttatagactgaacatccatcaagattcacaatgtataagccattcatcatgggtgcatggaaatagaaaatgtcattataatagactgaacaaccattgtccacagatctaaaaccataaccctctacttgcaaacaagaagtagagataacgttcttacacaaagctggaatgcaataacaattatttaactccaaaactaatcctgacggtaaagataatggcatagtgccgaccgcaacagcagcaactcttgctccattgcccacgtgaatgtccacttcgcctcttgctaagctcctacttcttttcagcccctgcaacgatttgcatgtgtgagcaagtgacccggtatcaaatacccaagaatcagtataggaagtagcaagattaatttctataacattaatacctgaggtggaactctttccatcctgctgcttctgcttgagctgctctaggtatttcttacagtttctcttccaatgacctatctccttgcaaatgaagcactctgcatccttagctggccctgtcttttgaaccttggtcttagagttgctagtagtcgtgatctcatcagagtttagctttctcttttgaccactcttcttattgtttggcttgcgcttatgcatacccatcacatggttggagtttttcttaatgctttcctcggcagtctttagcgtcacatgcaattctgccaaggtcctgttcaggttgttcatgttgaaattcattatgaatggctcaaagctgggagggagcgactggagaatcaaatcagtagccaactctcggctaaggggaaagccaagcttatccagactctcggtgtaaccaatcattttgatcacatgtgggctcactggatta

SEQ ID NO: 87638 - DNA, 578 bp, Oryza sativa
gagtccattataaaagttctgcaggatcagccagttgtccatcccatgatgaggacaggcgggcacgtactcctgcagacgctcccatgcttctagaatagactcatctcttgtctgttggaaactagaaatccttcgactaagggcattggttttgcctatcgggaagaatttcgagaggaatgccgtagagcatttatcccaggtgttgacagcagcacgattggcatagaaccactgcttcgctctcccaagaagggagaacggaaacaatcgcagcctaacggctttgggactgacgcccttgatggtgtacgtgctacatatctccaggaactgtttttttttactgaaagtactgccagggctttgcccagcagtttaaattttataaaatataaatatgtacaaagttacaaagggaaggcaaaacaaatatgctacaaagtttgtatccaatcagaaagagattgcttgagtggatctttcattctacacatatgtagaagaacttctttaacaaacatagatttccatgattgaagtgatggctgaacagtttgaaagattaatccatt

SEQ ID NO: 87639 - DNA, 657 bp, Oryza sativa
aacactacacttggttggtgggctttgatctttgcaactgccattttcaaataatctgcttcctggagcaaaaaggacatgacaacgcatcaccaatagcaacataacattcaatctataccgcccttaaaatgaacttcggctttacaacatatgcataaaaagatattaatggcaatacctgctgcagtaaagtatcaaaacttgaaagcaaattcgatatgcgctgatattcaagtgcaccaccaaggatcaggatgcgtggcttttctttccgtgacgccatgcgccgatgagcaacattctttttacaaacaactccttttacaacaaaactggaaataaagaaccaaaatgaagctcttacatggagcactaataagatacgaaaaagtaataaagtgtgaaatttcaaaggccaataacttgataaaacaaaaattgccagcaagtttgcatcatgaatttgaattacaaaaagctgagtcactgtcggattcatatttttttaactattaggaaaatgaatactccaaagcggaccagtataaaatcattaaagtttgaccataatctgcagaagggtaaattttgtttacctatcacttggacgaccacaagccaagcattttacctttacatagccaccagggccct

SEQ ID NO: 87640 - DNA, 3368 bp, Oryza sativa
acccataattccctgtacgggcaagccctagcggcagaaaagatgaaatttagatgggttgggggtgaatacctgagatggggtcaattggcaggatttgcacccgctcagagaagggtagtcggtgacggtggatactcaaggatgggcggcggcaccacgctacggcaatactcaataatggaaaaaaaagaaagagaagataagatatatgtatgaacgatcactcatataatacgatatatttaagattcacacgtagaattaaaaggaatgacagtgacaactgtttttttgaaaaaccaaaccttaaattcaaatttgctgatttccagtaaaagaaattcatatttgctgattataatctgcaacaatgccaaagaaaaaattctctagttctgcatcaaacacttccaacaagaagcattggtagaagccaagatgccaacaaaagtgtgtgcagtttgtactgcattttacagccagcttagggaaaagttcagtcactctcttgatccaagtacttggatccaataaatagtggggattttcagaatttttggggagttgatgaatctactaaaatttgaaaataataaaaccaagcaagcacccaaggctattaaacatcctgttatcttgtaatgttgtgtttaccttgtgactaggagcaagacacaaaatttcttcttcctaaaaaaagagtggctatggctactgagccatcgcatgagtgcccccaaaagagagagagagagagagagagagagagaaagaaaagtgcagcccgtgagtgaacctgtactatatcttttgacctggataccaacaacggcaggagacaactaatttcacatggctcttaatttgctgctaccccagacgaccagatgttagaaaattaattttttgtgtagatttcagttagtttgcttatatgtatggtgtacctgagtatgcagtcccttctccttgaagaatctgtgagggagatcccttgcccgtgagcctattatgtcgcccaagtttgaaaagaaattagcaagtttaagaattggaaatgaacaacattgccgtaatgataagatgagattcagtatgaacccagtaatagatcataggttagctcttgcaaataaaagtaccaagaaaatgagagctaccaagatccctcttggaatcagaagatctactcctgtactcagaatgaccaataataattcaaacagtagatatcagaatcagcttgttgtacaatatataatatcattaggtttcaataataaattatcagaagaacttttttttttcaaactaaacagtaggccaacatatttttatccaaactgatcagtagaccacaatatgtccaattcatccttaacatcacatgagccaatcgagcaaaagaggaatttggatggaggcaatcactgatatcattttgttaacctcatatggcaaaagtgcacggcttcatatggcagaactacattatcaagaaacggcatagctcaaggaaacgtttgacatttcagttttttaaaaaagtgttgtttcagtccaagttgtataaacacaaagtcaggcattgaaggattttgtaggtacactttaatgtttctcaaagatgaattggcgttcattcacacaaatcacaggtcaaatcttagctcgtatgtaagcacaattcacatgctatcttatgcgcaaaatggaaacattgttgacatggtagtcctcacatcctgttgacatcaataggaggaataaagagcaggagatagagtaggcagcattttatcgaggacctacagatgcagtttatagagtcaccttgatatgccttaggagatctttattgaaagcctaaattccagtgacgctgacctatttttaacatcaacatcatgaggaaaaacaggaatccccaaataatcaatgcatagttagatcaaaatgataagctgagttaatttgcattgggatgcttgtgtgcgaggcaaacacgtctctgcaaatagtcgatcgagtgtacgcatcgatcctgccatatattgatttacatatcgtgcacatatataactgcatgcagatcaaataatcgatggagaattcgagatgacaagaataaaaatcaatggttcaagaaactgaatcatatgtatcagaaattagatgtaatcacaaattacttgttcagaaataatttatgtagctgtagtgcaagtcatctaacctatatcacaaaatggaaataagatgtaatctgaacttaacatttttttattgtcttgtgaagaaaaaggggaaatggaaaaacataaatgatgcctatatgattttggttgattggggaggaggatgatatctgtacggtacctttcggcggtgggcgagtggaagtggatgacgaggcggagtggagaccggcgaggcgagcgactgtgttcgggcggtggagagcgggggcggcgcggagaactacagcggagatcggtgcgcgaggggcgagaagggcgtgtgggagcggaggcgggggcggcgagtgtgtagatcggcggcggcggggtggcggtgagggtgaggcgtgcggcgtgcgagggaggagaagggcgcgtctggcggcagcggcgtggatcggggctgctgtggcggcgaccgagaggagagggcgtgcgagagggagagaggttttttcacctgtgtgtgtttggttggtgggatataaccggataggacatagccgccgctttttggagggtgtttggatgctgggcgagagtgggatagggcggcccagaggagaatattctctccagatgctggatagagggatctggccgatttggccggatgcaaccgcccgaggctcgggcgagccgggcaagcgagttgcgtgactcgcgtcacccctcaccaccacgacgcgagcgaggcgacgagctcggcggccggcgagagggccggcgcgggcgacaagcgtggcggccggcgagagaggcaacgagctcggcggccggcacaggtgacgagagaggaaggcggcggcgggaggaggcgagccgcggtggtgggaggaggcggccggcggcgggaggaagccggcaggaggaggctgccaacggcgtcggcgagcccagatctggcactgcttttttttttcttttttctttttttttctatgtgtatttataatggagtgtgtatttataatggagtgtgtatttataatggaatgtgtattatgtattaatttgatgaggtatattcaccatctcaagtgagaggtgaccacacctacaaatccaccatacttcctccatcccgtcgagtgatagggtaccgagctcgaattcgccctatag

SEQ ID NO: 87641 - DNA, 961 bp, Oryza sativa
attagaggcctttcaaaggcagaaagacaagaatatgcccctccagcaggctctggcttcatctctggcttttcatctatctcaggccggtcattgatagacaaaatttcatcagctcgtgattctccttttggtcctacctcatatttatcagcacaggcaagagtagttgatgattataccatgtcacaaattattctgaaagagcttaatggcggggatacttcaaggatgctaattgttataacgggtgcaagccatgttatttatgggtcacgaggaatcggtgttcctgccagagtatctaaaaagatgccaaagaaagaccaagttgttgtactacttgatcctgagagacaaagcataaggagggaaggtgaaatcccggttgctgacttcttatggtattcagcagctaaaccttgcagtagaaactgctttgaccgtgctgaaattgcacgagttatgaatgctgctggtaggagacctgaagctttgcctcaggtttgctgcttgatcttcgttttagtccattgcttgttaacttcatgtcgtgatagacctttgagaaaaatctgtaaaatcgtgtatttagtgaaggtaaccatgaacaggctcttctagatattgctgccctactatcttcaggagaagaaatattgaatgagtaatactgagcaagatttgacaagaaaccttcagattacctaaatatcttgtgttgatttgtattaagctttttattctggttttcgagttccagaaatgtgccccagagtagtacaggtagcacaataaaacctaagcctctagcattttctgaaccctggctgtgacacagattagctaataaaatgcatcacattagtcaatatgcccagtgcagtaacatctttttcacatgacccaaaaaattcttgtaagtcatagagcaggagctttcttctgtggccaaaatgtt

SEQ ID NO: 87642 - DNA, 977 bp, Oryza sativa
ctgagtttctctaacaattgtgtttcagatcattgctggtttagtggagcatcggctaggagagagtctagctactagctacaatcagccacttcttgctagtttgttgtcctttgtggcaaggacagtgaactcatactggggaacacaggttgagcattctctgcacatttctagttatatgtttgtgttggtagcatagtgcagactcaagatgtttagatcactttagactaaagaactcttcagggaatctggctatgagtaatggcattgcactttcccatcctacatcccgatttatattgtttatttaattcaatcaatggtcacaggaaccttaacattcacatacatccattaaagctttactgctattaaaggaatattttagttgagctttacctcggaggcttcaagcagctttcctatgataatttacgcatttaaactccttaatatattcatagtgcttttatggttttgaagcttatattttacacaagataggagcttacagtaaacctatcccttctctccttactggttattctgtttggtgcagcaatgggttgatcttgcgagatatactggactacaaaaaaccaaggaagttcctcctgttgaggccacagcaccacctgctgaaacgtcacagttagccacaccgcccgctgaaacatcacagttagccacaccacccgctgaaacatcacagttagaggatggtagaacagaagtacaaaatttggatgacaacagcaaccaatcaagtggttgaacctagtgatttggttacttcacaatgccttcaaagtacataacgatatagctaggtttgtatcacaattccttagagttagggagtacatcacttgttaacccccaacacagtacatgcatgtactgcttgtgattttagagtaaaaattggaagggggacacttgcagtcttctgaggattgcagcaacaaccg

SEQ ID NO: 87643 - DNA, 1594 bp, Oryza sativa
ctgaatttctcacagatggaaatgcaccctggttggaagaacaataagattttcgaggcctgcaaaaaacatggaattcatgttactgtaagatataatttcttatgaaaatcagatacaataagctaacctcactgatgcaatttccgtgcatgtttttgttataaaaacaaacgctctttaacatttttcttgtatatttaattatttatgtcacttttgcaggcctactccccactgggttcttctgaaaagaaccttgcgcatgatccagttgtcgagaaggtagcatccacaaatgttcagatagaataaacaatatgaaaagttagcatgctcttcaattacgtgtactcgatagctaaatacaaccatataaatgcagatagccaacaagctgaacaagactccaggtcaagtgctcatcaagtgggctctccaaaggggaacaagcgttattccaaaatcaactaaagatgaaaggattaaggagaatatgcaggtgtttggatgggagatccctgaagaggacttccaggtcttgtgcggcatcaaagatgaggtgaggattgaccttgtgcatcccgtttgtagcgtgtgggcttgtagactgtagctcagctgtcctaagagctcagaggttgagtgcaaagagaatatgtttaatgaaattactgttaaagatggcttgatgtggatgttattgttcttgatatggtagactgcttagaaaatgaaaacttggtatagtagaggtgtgaaacatcacttgctagttttgacccaacgacattgcatggcaattcagcactgcacgggcggaatctggatctatattcctatatatactgcaatagaataatccactccatagtgacaatgcagtagtaagattccgtcagtttgtacagctttactacatgttttaagtagtttcttcagggtatcttccaggctagccaggaagacatctcacacagaaaatttcggtgttcagaacttcagatagagcatcatttgatctgttcggtgtgacatctaattttaaatactggacttaactaaacacatatgctacacataataaactactaaataagccccgtctacttagctacaactaatctttttctctgatataatgtgattggaccttggtattgcagaagcgagtcctgacaggagaggagctcttcgtgaacaagacccatgggccatacaagagtgcatctgaggtctgggataacgaggactaagctgccatgtttcacccaaagatatggcaaataatggttatgatgttggtcatgcacgaaggagttatgtgatgttctccaagcactgtgacgaaaccagctaactcagcacaagatgtactactatgtgtaaaactagtattgttctatgtgtgctcttcttcaagctttgtgtaaccagcttctcagcacaagatgtacagccagtgctgtaagataaataaaagtatcatggctttgccgttgcacttgctactacatgctttgcctgcttagcattatggttgagtttactctttcttcatagaaatcgaaatgtgctgcctgcctgtcaagct

SEQ ID NO: 87644 - DNA, 1295 bp, Oryza sativa
taagattaccggcaagcttgcacgtagtcggattatacaggttcgggccgctatggagcataacaccctactcctgtgtttgggattatggatgagttttacaagggtttcttcactccagagagcgcacttgcttcctctcttcttgagttcagattttctgggagtcgtcccctcatctcagtgggaagggtcctccttttatagcttaaggggataccacatgtgccgcctctacctaccctccataggggggaccccactccactttttgggctttaaaccgggccttctcccggaagctaagcaataaccgattctcgagtggaacccggcgccgccccccgcctgacacgggggacagccctgtcattccctcataaatgaacgatgacatgcaacagcccttcctcgagtgacgctaggatgtgacaggtcatacccacccccactccgccggggacaagggcgacgtgaggacatgattgccctatccatcggatgtgacggagacgggccggtcacaaaccggtcacatccaatggacaggggttagctaggcgcgccgcacgtctgcccttactgcattaaatacagtaagggacagttggggcgtcgcacatttatggctgttcagcctgtgctcccctcttgccctctccctctgccgcgtggcggccgggtgagggcctcggggcgaagccgcgggagagcccgagggggtgacgtcatgccccgaggccccccccccccctcagccgctttcacgactcgcgtgacgcgcgagtggggccaacctgcagagtcatgtggccggagggaaagtaattcccctctacttcacatacccccgggcttatatctccgacacctgggtacgtcggctagaggaaagctacactacaagcccagccgttgcctacgctggcttgtggtaagtacaataggttattccagggcatcccgcgaaccagtccttaattgccatgggtgcgactagcaaaaccatgcatccacagcccaccattcaatcgcattttagttggataattacgaccatgaagcatggccagatgtctcgagcacgcagctcattctgatactaaaaaggtctaatactgtaattatcccatcaactgagctagtggtaattaagcatggctaagcatgtagttctagctaggtcacataagtaacatgagctagtcgatttattacccaatgttaacaaatgacagatatcaactaaacatggcacaagcgagcagataggtaaaccctattcccatgtaatt

SEQ ID NO: 87645 - DNA, 693 bp, Oryza sativa
gggcgaattcgagctcggtaccccccctattcaagctcctcaagcgctccgggccgtttgtatggacggaggaagctgagcaagctctcaatcagctgaaagcttacctcacttccccctcatcttggtagcctcgggaccggaggaaccattgctactctacttggccgcgaccccccatgtggtgagtgccgccctagtagttgagcatgaggaaggcgaacgagagggccctccggcttgcgatggcccctcgtcccccgaaggtctagcgcccaaagcttctagcccccaggagggccccgaggcccccaagggaggagcggaggctttggcaggtggccctgagcttgatgatcccgaggcagtctgggatccccccaggacctccgaacaggtgcgccccgagttaccagcccttgacagcacgaaccggcccccccgaaaggtgcagcggcctgtctacttcgtcagcgaggcacttcgagatgtgaaaacccggtatccgcaggcccagaaaatgctttatgccgtcttgatggcctcgaggaagttgcgtcattacttccaagcgcatcgggtttccgtagtgatgtcataccctcttggccaaattttgcacaaccgagagggtactggacgggtggtaaaatgggccatcgagctggctaagttcgatctgcacttcgaacc

SEQ ID NO: 87646 - DNA, 713 bp, Oryza sativa
ttttcctaatgcaaaatgaagactaataatatattagtaaactacatataagcgttgttaacggtctacatggctatcagctaagcaaaacgaaagctaactcatctactggaaaatctctcaccaaaagaaacctgtctagatggctgccacatttgccatttcagtccgacagtgtccacagcggcgagtcgacgatgtcggcgtcgagctcctcaaccttgcaatcccgagtcgtcatcacagcgtcgacgtcgaggtacatggcgatgtcatccagacactcgaacatctccagctcaggccaagacgcgtcccactcccaatcccaatgctgcgccattgcctccgtgccgccgccatcctggagtatggccggcaacggcaacggcaacaccaccggcttcacgtcacgctcctcgaacactgcgccgccgccgctgccggcgacggctgcaggagaacagcccggggtttggcgttgctccggcgcagtggcggcggcggtggtggcaggagaacagaacgggggttcgcattgctccggcgcggcgatggcggcggcaggagggctgaatgccgggaagttgaggaccgcgcggggaccgaggatggacgcggcggccttgtcgtaggcgagggcggcgtcgacggcgctgccgaaggtgcccagccagtgccgcttcccgcggttgggctcgcggatctccgag

SEQ ID NO: 87647 - DNA, 552 bp, Oryza sativa
ctatcccaaccagcagcaagatgctgatgatgagctgcaaccgtccgctcttccgcaccgtagggttcatgaaatcttcagctagaaggtcgacgagcgccatgtagttgaggattccagcagccgctgcgtcgagaatgccttccacgatcagggccgtggggctattctcattgtaggcggaggagatgccgataccgatcataatcccaaccggtgtggttagcgagaagaagatggccattgtcactgcagacttaagatggaacctagcctgcaattatatattaagtgggtaaatttcaccgccctatatatcgatcagcgtgcatttgtataaaatgatatttctacgtttgaaaggagtctcactactgatatttttttttttggaatctaaaattctcgtattttcttttaatgtatctaacatcttttacttacaagtgttttttttctttctacatgttaagttttaaaggttatgaataaaactaagagtcatagacaaaattgtgtggaaaaatccgttacttatgtttctaagtttca

SEQ ID NO: 87648 - DNA, 631 bp, Oryza sativa
ttaagcacttcatgaaacttcctaaagtaaataacagaaattcacacataaacacttagctgttaatctgaaatagttgaaacaaatggaaaaatagtcctgattgttacaaaataatcaccttactaattggtacagatacacctacagtagtcatgtacagttgtacaccatttgtcttacctcatgatttcttcatggaggacaaaatacaaacaatgaggatgaaaggttaagctatgaaaatcaccaataatgggacgcagatattcaccaggatccatgatagaactccacaaaccctgtagtagaagctgcaggctgcagcacgccagtaccataacgtactgatcaactgatcacttagctgctccttcaaacaagtgctggatgcatgcctcaacatcttctggggtgtatttgatgtacaagtcatgcctggcttcgggggatgatttcaatctagaaatcaaggctgtatatactggcattacagcttccgccactgctgccctaacatccacccgcagctgttcatctgctatcacccattctgattgtacttcatagatctcctgaaagtaggtattaaacatccggagtttctgcttcattgccgtggcagggagtc

SEQ ID NO: 87649 - DNA, 712 bp, Oryza sativa
ccaagtagcaatggccagcaaaccaattctgtctgtatttgcaaacaacttaatagtaaaccatctccaggtacgaggatatgcatttgtagtttggtacagtatcatattaataccatctcgaaaaagactacagtagtatcttgggctagtaactgcgcatcttctgtgtgatagactgctctgtatttgcccatgtcatagagatgttcgtcaacatactacctatgatcggtcgagagaatggtacactgcttgaatattgcaatcttgtcttggagctgaaactgaggcttgaacctctattcttttctgaaagctatctaatgggaccttcactgatatagcactaagctcgcatatcgctaaactttccaagttcatctgatgtatagacagctgcggaacctgtttctgatctaagaatgtaatctgaatatctggttactgcaggctggatacaggcatgtagatacggctgctcaatatggaatagaacaggaggtacaccaaaacaatattatgtttatctggtagtctattgcgtgatgtttcgttaagcattctctgcaattcaggtcggcaaagggcttaaagctgcgatggaagctggaatcaacaggaaagatttgtttgtgacgtcaaaaatatggtaattatatttacaatcataataacttgtcctttggtgtaaaattaaatataaatgcag

SEQ ID NO: 87650 - DNA, 1020 bp, Oryza sativa
ctacagtagtcatgtacagttgtacaccatttgtcttacctcatgatttcttcatggaggacaaaatacaaacaatgaggatgaaaggttaagctatgaaaatcaccaataatgggacgcagatattcaccaggatccatgatagaactccacaaaccctgtagtagaagctgcaggctgcagcacgccagtaccataacgtactgatcaactgatcacttagctgctccttcaaacaagtgctggatgcatgcctcaacatcttctggggtgtatttgatgtacaagtcatgcctggcttcgggggatgatttcaatctagaaatcaaggctgtatatactggcattacagcttccgccactgctgccctaacatccacccgcagctgttcatctgctatcacccattctgattgtacttcatagatctcctgaaagtaggtattaaacatccggagtttctgcttcattgccgtggcagggagtccacctactccaggaccgccagtctgcaatactgttgtgaccttgccccatgttacccgctggtaatccatgctccaacgccgcactctgtttgtcatttgcttgatccactcgtcaccaagcaaaacaccaagttcactatcattcaccttctgaatgatgtacttgccattgttcatcaagaagacgcaagcgagtgatggatctcggtatatcttcgactttatatctaaattcttgtgcaagacatccatgatccatgctatgtgcacagcaagcgacgaggtgggacgatcagggtcaactgcagcagccgctccaccaacagcgccgaagtcaccttccatcacctcttccaatgtctgccgcgacccacaagcagcacggagatagttcatgacataccgagtgatgggatgtatgcctccaccttgggctgcaactcgagcaggatcacggcggatgagattttctaactccatgaatatgcctttgatcgatgagccgagggtgttgcacaccgccgtgacctct

SEQ ID NO: 87651 - DNA, 1585 bp, Oryza sativa
atgcatgcgcgttgacgagtgtgaggtttggtttcgttgcagctcatcggcaagaacacgttcagcatcctgatctgcttgtcggtggcgatcacggcggtgtcggtgccggtggccggttggctgtacgatccggcgcggcgctacgccgtgtaaaagcggcgcacggtgcagcatctcaaggcggacgccgacctgcggatcctcgcgtgcgtccacgaccagtcgcacgtccccggcacgctcgccgtgctcgaggcgtcgaacgcgacgccacagacgccgctcagcctctacctcctccagctcgtcgagatcgccggccgctccgcgccggtgttcatcccgcacaagctccgccacagcgcctcccgagccggcgccgcggcggccagcgcggcgccgcccaccgactccgaccgcatcatcaacgccttcttccagtacgagctgaagcacccggagggcgccgtgtccgtgcaccccttcaccaccatctccccctactcctccatgcacgacgaggtgtgccgcctggccgtcgagaagcgcacgtcgctcatcctcctccactaccacaagcgccacatgctcgccggcggcgtgcgcgccgccgtggggctccgcgtcgtcaaccgcaaggtgctggaggtcgcgccgtgctccgtcgcggtgttcgtcgaccgcaacgccgggagcgtcggcctctgcgccttcatcccgggcccggtgcaagaccaatcgacgtcctccaggagcaggagcggcgggcacgcggccagcggcagcggccaaggcttcaaggcggccgtcgcgtcgctcttcttcggcggcggcgacgaccgcgaggcgctggcctacgcgacgcgcatggcgcgccacgagggcgtggcggtgggcgtgatccggttcttgccggcgcggggcatcaaggacgagccgtccgaccgccggatcgacaaccgcgccatcgaggaggtgaaggcgctcgcggcgaggagcaggaacatcaaggtccaggaggagctcgtcggcgacatggagaggatcgtccaggtgctgcgggggctcgacgaggcgggctacgaccttgtgctcgtcgggatgcggcacaggtggtacccggtgatgccggcgaacgggatgtcggattggagcgagtgcccggagctcggcgtcatcggcgacctcctcgcctcgtcggacttcgacacgccgtactcggtgctcatcatgaagcagcaggaccagggcgggctgaacgccgccgtgccgggcgcccaggacgtgtggcacgtgaacgacggcggcgccgaggacgcgccagcgccgccaagaaacatgtcaaccgccggatcttagcaggttcaggcagtaggcgattgttctgttctagcctctaggacctggttcaatgtagactttcagattccctttttgcgtccaagtatgttgtgatgtatagctatcaggattagcatcaatccttaaactgagatgagatcttaagattatttcaaggaaacagcattgtgtatagcagcaatggaacaaatgcatccaatgttaatttgacaattcagtc

SEQ ID NO: 87652 - DNA, 583 bp, Oryza sativa
atctgagcttcatgctcatcctttggggcaaatgacatggtaatgacgttcctgtcaagcaagtatccaccaaagctggcaacaccacatccaacatccaggacagtttttgtgtgtgttccccattgaatggtgggcattatctgtaaacaaaatttatacatgacattagaaacagcaagttatgacttatgacaaagaactggtggcagcagtcctacattcaaattaccgaaccccaacagagtcaatgcaagcatagcctttgtgtttagccccctcaaagtctaagaataaaaaaaattgacaatattgaaattgccagtatactataaagtagaagaaaagaacaacaggaatacgactaaggagggtcctaattcacaagaccaacaactcatttggacatcaaggtacttcaaagtaatatctacctgttcaataaactgaatgtatcttgtaacgccagttttgaattgagttccacctccagggaagacaagatagtcaccagattttgttaacaggaatacgactaacgagggtcctaattcacaagaccaacaactcatttggacatcaa

SEQ ID NO: 87653 - DNA, 599 bp, Oryza sativa
caacgtgtacaactttaggatgctaccatcaatcctggataaagcataagcttgtcaaaatctgttaaaggaaatctttgttactgaacaaatgcatttacgacatcaaacatggaatcgctattaggctcgaactaaacatggtctgcattgaaatccaatgtgccgcctatgatattattttattccataaaatgacatatcgagttatcaatgcgtcacaactcacaacatggattcatctacagaaagtaaacaggaaaattttgttctcccaagcaagtgttcggataactgaagtgaaacaacacagaggagagggagaaccttccgtccatgaactggtcgagctgctgctggaggtcgcaggggaacgcctcgagcgcgaccgccacgccccgctcggcctccgcgcaccgggtcgcgagccccttcatgatctcgagctcgagcacgcggtcgtcggggtcgggcacgagctcggcctcgccgaggtacaccaccctcgcggccgtcagcttctcccagacccgccccctcgagtccttccccacagcctccggctccccgatgaccgtggcatcgtacaccctcgacag

SEQ ID NO: 87654 - DNA, 1781 bp, Oryza sativa
gactttttcttcaagagtgcggagaatatctctttcttctttgagggtaagtgaatttcatctcttggagttgtggagttaatattcagtaacattcatcagttatgctatctgaacaaggaactggttggtagttaaaaaaaaacaagaagataatgtgtagttagtagttacagacctattattgtcgaactgttcttctggttctgttgttgatttacaatggcagcatgtggaggtttacttggatttggatagtgatttatattttatatattttcctgtttcaattactcacagaaaaggcatttggagatgatggatgcttgaaacaggcaaaggaactttcaattaataaagttgggcacggtcagtatgccaagtagaaattggttatacatgtgtgtagtttgtagaatgattgattgagtcttgcaagattattgtgttgttcatgttgcatgggttggaaccagatgccacttgctatacaagttgtaaattgtctagcaggatgagttgttgtgagaaacagtcggggattttcttacttaaatatagaagtcgaaaattgtaatagacttctctgattgctcaaacaaatatttacattacatctaggccaaaagataacaaagctacatcctaaacaagattgcattcgatccagaggtgctggtggaatagtcttataaccactcatgtagcacttttgtggataatactgttcttctgaacataaattttattgttcaaccttgctatttctgctgtttgcatttccattaatctgggttaagacaaattttcttgagtttggtttatttttgaatttgcctgtttggttgctattttctagttaacgttagttagtattttccatgctttgaaaagcttatattgtttgtatacttgtatatttataacaatatatcttgaggtattgccattcactgctcagtaatttttgcagcgttacatgaacttgaccctgtgttcaaaaagttctcttttggagagaatgtttccagcctattctcttctttacgctacaaaagacctgcagttattcaatctatgtacatctttaaggtatcttgatcagtctctagtttcttgttggcattgactacaacttttattccttattgggttaatttatccacaactcagcaaccaggcattggtggcgaggtggtgccacaccaggataatacattcctatatacaaaccctccatcatgcacagggttgtggcttgcactcgaagatgcgacaaaaacgaatggttgcctatgggcaattcctggatcacataaaagtagattttcgtaccaaattatttcatgtcaagaatcctcttgtggttatctgagcttctgatttgattatcatttgcaatgctttgcaccagatggtctgaaaaggcgaatgatcagagatgaaaatgatactcattttgatcatccttcgccaacctatgatctgaaagaatttgtgccattagaagtaaagtcaggtgatttggtggttattcatggagatcttgtacaccagaggtgaagttaccctgttatattgcatagcttgcaatcaactgcttcattttttttactaatatgttttaactttttttgacagctttgaaaatctttctctggtgtcaagacatgcactgagcttacatgtaattgataccgaaggatgtgaatggtcccaacaaaactggttagtttattttaacacttttggagaattcaaaagttaaaattcttatttgc

SEQ ID NO: 87655 - DNA, 1691 bp, Oryza sativa
tttgacagctttgaaaatctttctctggtgtcaagacatgcactgagcttacatgtaattgataccgaaggatgtgaatggtccaaacaaaactggttagtttattttaacacttttggagaattcaaaagttaaaattcttatttgctctaggtggtctttgcatcacttactgtccacagtagaaatctagaattgcctagaaacaagctattctacttccaagcttgtcctaaattgctcaaaccaagctacttgctttagactgtataatcttatactgcataatcttgtacttgatactgtatgatagttttggcgtagcctgtaacacaggacacatattggttacctgtacctgtatatgttgaaacaaggtattgtgccgctgtttgtatttttacgaatgggaatgatgttttactttatctttcctgtcaatcacttacgaatgggaatgatgttttgctttatctttcctgtcaatcacttagaaactccgaagacagaaatttattggtgtccttgtttacgtcactgttagcagaaaaattgtcgataacaagaactccatcttaaacttacctgcttgctctcaattttgaagtggatactacaccagtacacctcataaaacatcgtaaaattatagctatcgatgtttcataaacttttccacctttatttaaattttgctaacaggcttttttatgcttgctcaggttacaaaggaaaatcccacctcagccactttatgaaaattagtacaagcagttacctatgtgtcaaataaacgagtgatgacctagaagcaatggtcagacaatgtaaataccttgctactctgttttcatggatgttttttatggcaataaatttggtgtacgatgttgagtagctatgcttttttccccgtcttcagacaccaagtcacacaactacgttgctactctgtttccaggggtggtatttatgcctaataaaatctatctccagttcttaatgttaccaaatggcgacagcaaatcagcaatgctcgtcatattttcaaacagacactgattgtctgattagcccattgttcggtgaatcgtggaagcggagcaacatttctttagatttgtttccactgctgttcttgcctgatttttaccatgtcgtctgtagctgatcctaggagcaagcggtccaactccgggagtatctgccgtatggttgttacagttcaacgggactaataaacagtattgcaagttaggctgttaactaatcacatggtcataacatgtacttcctccgtcaaaaaaaaatgcaaatcctaggttttcgtgtccgtcttgtatgaaatttttttataattcgtatttttattgttgttagatgataaaacatgattaatactttgtgcgtgacttgttttttttaatttttttcataattttttcaaataagacggacggtcaaacgttgggcacggaaaccagggtttgtctttttttttgggtacggatggagtattattgcattctccttaataaacacagctctcaacgactctgtgttaagaaatcatgcatagtttaaatactgtgcatcaggatatcctcaatgtttatgcaaaaataaagagtaaggtgagctcgtgtcagatgctacaggacacttaaaaaatgtgtaattagctggtagac

SEQ ID NO: 87656 - DNA, 1028 bp, Oryza sativa
aggaagttgcgtcattacttccaagcgcatcgggtttccgtagtgatgtcataccctcttggccaaattttgcacaaccgagagggtactggacgggtggtaaaatgggccatcgagctggctaagttcgatctgcacttcgaaccgcggcatgcgatcaacagtcaaatcctggctgacttcatcgcggaatggaccccggtggacgaacctgtcccatccaatgtccccttctcccccgtagaagaagagaatccaaacgccgacattcgcggcaggcacaggattatgcatttcgacggctccctcaaccttcaaggtgcaggtgccggagtcacgttgacctcgccaaacggggatgtcctcaaatacgtcgttcgtctcaacttccgagccacgaacaacatggcagaatatgaagggctccttgcaggattgagggcggcagccggaatggacatccgccgtctcctggtcttaggtgactcccagctggtcgtaaatcaagtatccaaagaatatcagtgcaccgacccacaaatggaagcatacgtctgcgaggtacggcgcatggaacgccacttcgatggacttgagctccagcacgtgccccgacgcgacaacacagttgctgacgagttgtcgcgtgttgcgtcggcacgagccccactccccccggggactttcaaagaaaggctcgcgcaaccatcggcgcgaccgagtcctttgaaggaccccaacgacgcgccctccgacccgacctctggcgacccgcgcccctcggggcccgagggggtcaaccccgacccccctcgtcaggttgtgtagatgaccgacatccgggcgtatctcaacggcaatactcttactgagaaacgcgtggaagctgaaaagctcgcgcgcatctccaagcggtacgtcctcgtagagggggccctctaccggcgtgccgcgaatgggatactcttgcagtgcatttctcgagagcagggcatcgagctcatagccgacgcccatcagggtgagtg

SEQ ID NO: 87657 - DNA, 558 bp, Oryza sativa
ggcgaattcgagctcggtacccgacttgaggaaaatagcattcatcctatatacgcggataaatattgcaccaggaatttgaagaattacctcggaagcgattgtcatctgatatgattccaaaagtctctgcagtatcgcgaatcatgatgccgcatacgccttgataagaagaggctgatttgcattctgccactgcaaaagccacaaaaccataagaaatgatgataaaactaacagaaacaagaaagcaattgaatacgcagctcatcttaagcatataaatcacctattacaagagccccatgaagatctgctgagaggagggtttcagataactgctttttcctgcagaaaaggcagtacacataaatacttttttgtgattaaataactcatatatggcatagaaaggtcacaataaaagggtcataacgaagttctggaaaaaggaggaattgatcccttactctattgttttatctaagctgttgaaatcattattgcatttgttgatttatccaactctttgaatgtgttaataattcagagctaaaa

SEQ ID NO: 87658 - DNA, 569 bp, Oryza sativa
cgcatcgggcaggtgctcctctccgtgggatgccgcgacgcgaacgccgcgcacgcgcaggaggccctgcgccgcgccaagttcaagttccccgcccgccagagggtcatcttcagcgccaagtggtacgttcgtcaggatggacggccaggatgatataaattctttcgtgtcatctgatgatgatgtgtctcggtttttaactttttattggttttcaggggattcaccaggttcaagcgcgacgagtacctcaagcttaagagcgagggacgcatcgtgcccgatggcgttaacgacaaggtacgtacgaaaccgcggtgtatcgctcgaaacgacaaaattataaccaagttgattaatgcatgtatggtgaacagcggctaattattctatatatatatatataatattttttagaaataatactatattaatgggaaattgcaaagtagagactattttgctaaaattgtaagtttagcaccatattgtataagcaaagtttgatagggtgtatatcgatcaaaatttgattgagtgatatgaattttcatggtgccacataa

SEQ ID NO: 87659 - DNA, 930 bp, Oryza sativa
  unsure (1)..(930): unsure at all n locations
aggggatcgtccccacgctagacggaggggcttgcgctcacacctctcgccgaagcttcaaggccatgagacgagagcttctggccgctgttcccacgcatgaggtggtccggaaggcgcgctagtcagaggtgaatctcacattcgaccagagcgaccatccgacggtgctctctcgggggggggggggggagttggccctgttggtctccccgaccatctacaatgtcaagataaagcgtgtgctggtggatggcggggccagtctgagcatcatctccccggctgcctttgacgcgctcaaagccccggggatgaagctccagccgtcgctcccaatcattggcgttactccggggcacacgtggccgcttggccacgtagagcttccggtgaccttcggcgactccaccaacttccgcaccgagcggatcgacttcgatgtggcggatctcaatcatccctacaacgcggttctgggcagacccgcattggtgaagttcatggccgccacccactacgcctacctncagatgaagatgccgggtcctgctggtcccatcaccatttttggtgatgtcaaggtcgccctcgcctgcgcggagcagcgcgcagacaacctggcggtggccacggagccacaggcccccgaggcctctgcgtcccgcgcttccaagaagcgcctcacctcggctgacgaggtgccagtcaaggaaatcccccttggcaacgatccgtccaagaccgccaagattggcggaaccttggacgccaaataggaaggcgcgctcgtcttcttcctgcgggcaaattctgacgttttcgcatggaagccgtcggatatgcccggggtctccagggaggtgatcgagcaccgccttgccgtgcggccggatgcgcgacctgtccggcagaaggtgcggcgtcaag

SEQ ID NO: 87660 - DNA, 1929 bp, Oryza sativa
atgtgcagagtgagcagcaggatggggtattttcttagtagtgaggttagcatcgagatctacaaatgtatagctgagcagtagacctgagcattgcacgggtggcacctgagatctctaaataaaatgtctgaaactctcaaagtcttaggggaagaagtgtatatatatacacacaaagtcagacgattatgataatatgatattagatcgcgacagtggagcatacatacatatacaggtggattaattgtttaactatatatatatatatatatatatatatatatatatatatatatatatatatatatatatatatatatatatatatatatatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacaagagatctaattaatatacacttgtatgtatttgaatcggagaaatataaatgtagagcatgtgtactcacaggaaatttgaacttccgcctaagtcattctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgagccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtctgtgtccctgatcctcgctccgatcatctctctaccggtggcgctcatctccatgtacagccgatggaacttgtacatttgtgtgggtagggactgcagcagctcaggcttgacaagcggtttaccgagttcgtacatgtatttcacttccgccttttcgattggtgcgactcctagcaattgatccgtagttagaccgt

SEQ ID NO: 87661 - DNA, 880 bp, Oryza sativa
aaaaaaaattgacaatattgaaattgccagtatactataaagtagaagaaaagaacaacaggaatacgactaaggagggtcctaattcacaagaccaacaactcatttggacatcaaggtacttcaaagtaatatctacctgttcaataaactgaatgtatcttgtaacgccagttttgaattgagttccacctccagggaagacaagatagtcaccagattttgttacccagttttggtccttcttatactccaccaatttagggtgaggaacattgttgtaccaaatctggatttggaaatgaaatgagatggcttcaaatagtcagttaatggcatcttaaccataagatattcatgtaactatcataaatacacacactgcactcactgccttgaaagttgaaagcctataaaacgatactagtggttaaaatagtatatgcacaaaaggaaatttagccacattaaaggatcactaagcacaatctgcttgacacccaacattacagctcttatctggcattctctattctgcctcacgacagtagcttcctaaaacagaagataacagagaatgttcttagagtgtaatgaacactaaggaatattatatacgaaaaatggaaaagagtatcaacagccagagccactttccctccctcaccgacggaggcaagcgcgcgaggtcctcaccatgtcacggctgcgcggccacggcacgggcgaccggtacccggagggcacccgcaccaggcacctgggccgcggcgccacggggcagtggcgctcccggtgctccatgtggcgcctcgagcgcagcgccttgatcgccctcatgttgtcgaggcacgggatgtagtccgccgacgacacccct

SEQ ID NO: 87662 - DNA, 575 bp, Oryza sativa
atttacccccaccccgtccgggaagtgggaattccagcaagaaccgaggtcctcgtcaccgtcgccatggttctccaactcctccccgctgcgaaaccttcgccgaggaaggatcccactcgttcgggtggttcggctctctctccgccccctggcggagggagcccgcaatgcgtcggggcacgacgccgtctcgactatgaagacgccggttcgccccaaggcacgcttcaggcagcaggcgcccttctacggcatcccccggtaaacccggagccggagactcctgtttagcgctggctggacgacgtggccaacttggtcattgctgcccagcgacagttgcccacgggtgcccgatccactgccgctggtacatcgtgtacctcggtcaccccctcctcgtcggcgagaagaagggctcgtcgatcggccacgatctcgaggcggtccacggttccaacatcgtcaggggcctcgggaagctgaaggcatcatgacggcctctacgggacgcaggacgctcgagtcaacatcgagcgacgccgggacgagcgctgagctgcccgtatggg

SEQ ID NO: 87663 - DNA, 578 bp, Oryza sativa
ccgcactccgcttttgtgggatcaaacgggagaacgtcaggttttcgggacggatatcttgagggaagcagaagaaaaggtgaaaatcattcaagaaagattgcgtgtggcccagtctcgccataagagttatgccgacaatcgtcggagagatctaagttttgacgcaggagattatgtgtaccttcatgtcacgcctcttcgaggggttcatcgttttcataccaaaggaaaattggcaccgcgttttgtgggaccttataagattgtcagtagaagaggagaggttgcttatcagttggaattacctcaatttggcaggcgtccataatgtgttccatgtgtcgcaattgaaaaagtgtttaagggtacctaccgaagaagctaatcttgaacagatagaagtccaagaggatctgacctatgttgagaaaccaatccgtatcttggaaatagatgagagaagaaccaggaatcgagttatccgtttttggtaagtccagtggagtaatcactcggaagaagaatcaacttgggaacgagaagatgaattgagtcagctcatccgcatctgttcg

SEQ ID NO: 87664 - DNA, 654 bp, Oryza sativa
caggtcgactctagaggatccccactctccgcttttgacagatctgcatatcctcgggccaacttatccagtactccgtagtttgccgatttattcacccgccagaacaccgcctcacctgcatcggcaagccggggggaaaactgataccccagtagccagaacagaccgaaaataatatcgctgctacccgcagtgtctgtcatgatttcaactggattcagccctgtctgctgctcaagaagtccttccagtacaaaaatcgaatcccgtaatgtaccgggtaccacaatgccatggaacccagagtactgatcagatacgaagttataccaggtgatgcctcgtccagaaccaaaatattttctgttagatcctgagttgatggtcttcactggtgtgacaaagcgcatgccgtcagctgatgccacttctccacctccccaacgaccagcaagctccagtgtggactgaaaatcaaccaggcgggcattggcgctgaccagcgtttctgcacgaaggtaattctgtttcacccaactgagccgatggcgggtcagtgctggtatattgtgctttatcagcggttccagtccgatattacaggcttcagccatcaataccgcacataaactgatgtgcaaatcttgcgct

SEQ ID NO: 87665 - DNA, 1356 bp, Oryza sativa
agataatcacaaccatcacggggaaaaaaccaagcaattagtaggttaggcgagctactaaaaaaaatccaatacattattgctcggaaaaaaaaaagctgataagatgggatgacaccgaatacaaagcaatctggatccagacacttcaattatctacgcagctgttagtacaccatcaatgaatatccagatacggcactagtacagtacaacagttcaacacctatattatagatacacaattgtaagacaagaagacaaggaaaacaaggttcgttggtgtatgtgcatgagcacgacagatgcaacaatcggcatctagcatggtcaaaatatagcagcataaaagctttctagaatcatcgacccaacacctctaattcaatgccacatgctaacatctttgcacacagcgattttgccaaaatggactcaacctagctctgccaacaatcgagtatgatgaacaatattatacaagacaataagtgcagctcagcagctgttgtgttggggctccgaccgaacacatgattaagataacaaaaaagggagtgtggatcatgcgtatcactctctcatacagtatcattcgttgggtcaatagcagtggtatggtatattacaatacatgccgataagcttataggcactacatcagggagaaaacacagggaaagacagaaccatctaatttgaaacaattatctgacttccgatccataattcaagagaacataagggcaaactcatgaacatatgctgaatgaatagattatgcctgcagggtaacaaaccgagacattgttacctcaccgtcccttggggttcatgatctgcgagaagacagcactaggcgtcagcccatccgagtcaatacttgcaacactctgctcacccatgcttatcgaggtagttgtcgttgtcgtggtgcttgactcgatagatggatcattgggatccttctttccaactatcacaaggggagtgctgtcgtctgacatcccacatccaaggcttccgctctcctctgcactttcttgcatttgaagggcaaattccaagttccacagcacatctcccatcgaaggacggtcaatgccctgatcagaaacacacttctcagctgtttctgcaaacttcttgaaacattgtggagcaatctttcccttcaggtggggatcaacaatctgatcaagaatacccttcttctggcagtgtaatgcccactcagccaagctaacttcttcctttgcaagagtgggattcaaggcaggccgagcacataggacctcaaacagtacaacaccaaaagaatagacatcagatttgtcagtaagctgctgcctgcgg

SEQ ID NO: 87666 - DNA, 651 bp, Oryza sativa
ccaagttttacaggcatgaaaaagaagaagaagattcatgtgagtttagttggttacaaattacaaatgcctgttgcaatgtttgttggattaatatttccttctgtactattctatttactaattttgcaaatttcaggtggagcatgatacatctcttactgaagctggagatggtgaagatgctataggtaattgtggcttgctcatatttgccctggttgcgttgttttgctttgtctgatcatatattgttcagatgatcaaatcggagaggatgaagaaggagaagggattgtgcttggaggtgcaactcgatacccttgggaaggaactgacagagattataaatatgaagaggttaatactccttgcctgttcaaatttttgtgattctatatccttgtcatgttcttgacagatcatgacttgtaaattccatataagatatacatatcaaaatagaaagctgtggagttttcatattatgtcacctgcaattatatttttaagttaaactcccttcggttccataattcttgacgttttcgacaaagttgaggtcaaacttttataactttaactatcaataactttggaatattagtttaaaggtctagacaacatatagatttgtcttacaaatactat

SEQ ID NO: 87667 - DNA, 558 bp, Oryza sativa
actatagggcgaattcgagctcggtaccctgtagcatgaccaataccttctcatgttttagcagccttaactgttgaatggctgcatgtgtcttcttctcactgggctgcataaggacagggaccctgttctccactggtgtttttctatgcttgggcgtatccttcggtttagatttaaaaggaagtagatgctgcagttttgcagggatctctataggattaaacttccgcactttccgctcaatgggctgccatttggagataacatgatatgagcatgatattaagaaaaataaacacaaaagatttcgacgctcagagaaccttataaactgaatctgtgttgtgcggtataggaatattatgtgccctccgcagctcagcagtagttctcatgccttgccaagtctcatcttggggttgaagagcagttgtcacaaggttacagtaggtgggaacttcaacattgacccatgcacgcatgaagacaatgtcactcataagaattctgtcttcaaatgtgcaccttgcaatcccgtctatactttcccctttt

SEQ ID NO: 87668 - DNA, 846 bp, Oryza sativa
agcgccacgctcctcttcacgaggcggccctcctcccacactcacccctggggggggggggggcgggttgtagggcctacatagcgagtctccggaatgtccagaaaaccccgaagtttcgccccaaccttacgaagaagtatgatggtagcatcaatccctccgagttcctccagatctacaccacggttatcgtggcggcagggggtgacgaccgggtcatggcgaattactttcccatggccctcaagggtcaggcgcgtggctggttgatgacccagccccccgactccattcactcctgggaggacctgtgccagcagtaaatcacgaacttccagggcacgtatcctcgcccgggggaagagacggacctacacgctgtacggcggaaggatgatgagtccctccgttcgtacatacagcgcttctgtcaggtccgcaacactattccgtgcattccagcccacgcggttgtatatgcattccggaacggcgtgcgacataatcgcatgctggagaaaatcgcctccaaggagcccaagaccactgccaagctcttcgagctggcggacaaggtggcccggaaggaggaggcgtgggcctggaactctcccggcaccggtgcggcggccgcggctacccccgagtctgtcccccgctctaagcggcctgataggagaggcaaaaggaaaccagcccgctccgatgacgagggccatgtccttgcagcagacaggcccacgcgggccccgtgcaaaggaaaggcccccggcgataagccgagccccactgttccctctggcgagggccagtcggcggacaagtggtgctcggtacacaaca

SEQ ID NO: 87669 - DNA, 741 bp, Oryza sativa
acgcgcatgcatggctccattatcgattcgaatatcttgccgccattgggaagattaaaattcaccttgttggtcaagaagaagttgaaggtgatgacctcgacgatgcccttggagttcatgaagaggctgagcgagacagcgtcgcggagtgggatctcaaggtacagcgacgacaccatgacgccgacgagcttcccgacccaggcgaggaacatgacgacctgcagcctgccccagtgcatgcgccacacgtcggtgctgagcccggtcatggcgtagtagagcggcaggatcaggccggacaccatcgcctcgatcttctcgccgagcgccgtgccgagcggcgggccgtcggggatggccagccccagcatcagcgcgccgtggaacgagttcgtcccgatgacgtcgctgtagaagccgacgaggaggacgacgaggaggaagacgaacacgtaggtctcctccaccggcttgcccggcggcgtgcgctcgatcacccgcagcgcgacggggcgcaccacgaacagtatgaacgcggcgagcaccgccagcgagaggaacgcccagatcgacgtggcgggcgacacgaggaacgcctcggcgaggatgtacaccaccatgatgatccacgcgatgccgtccgtggtcatcgacgccgacatggcgatgcggccgaggtccgagttgaggaggctcagctccgacaggatcggcgacagcaccgcgaacgacgtg

SEQ ID NO: 87670 - DNA, 696 bp, Oryza sativa
attggaacacaaaaacttcctttccctgatgaggcatttgatgttgtccactgtgcaaggtgcagggtccattggtatgcgaatggcaagtattctattacttcaccaaatttataagaagctaccacagtgtctatattattttctcagaaaactgtccgttttggtttcttgcaaatttcttttttaactattatttgctactgggaatttgcaggtggaaaaccattgttggagcttaacagagttctcaggcctggaggatattacatttggtctgcaacccctgtctaccgtcaagaaaaaagagatcaagatgactggaatggtttgtgtggtgtcatgttctattatctgccaagcattcagcttagaatatcacccaagaaaacttttgcttagtactttcctaatgaaaatagcctagtacttttgcttcttcccaaaacaatgtttacttagcaagttaacatttgtcgtttatttggtgggttatatctgtgttcactgaaatatccatttcacatgtggcagcaatggttaaacttaccaaatcaatctgttggagaacagtggtaaaatctgaagatagtaatggaattggtgttggcgtatatcataaaccagcatcaaactcttgctacctgcagagaaggacaaatgaaccccctatgtgttctaaaaaagatgggcccc

SEQ ID NO: 87671 - DNA, 1799 bp, Oryza sativa
tctgcaaattaatattgacattgcaaaagttagtggcctgaacatttgcacttgatgtactgaatttttcaagatgctgttaattatcaaaccaggtggcaactaggtacgtcatatggtatcagggagtcatctttgaatgaggggagatgatcctctgggttccactggtcatcaccagctgttgcaaacatctacagcgccatattgtgttaaaacacaccatatttaagaattaaaatagtctagagtaattggaagcacttactgcaaaatcttgatttaagaaatgtctccagcctacaaaatcagttcctccaaatctctgtatctcatccgctgctaatacttgaactgcaacattgaatgtttcttcttgcatttgagtgtctagccgaatagcctgttgtatgtcatgtaggcttaatgacatagggacaggttgggagatgtgaacccagattttcctgttaaatgtgatatctttacaattagtggtgaaagaaaggaacatttcaggtaggtggcttacattagagcttctgcataagcgattgaagttgtatatgtgtataaatcatcaagtgtttcagataggtggcttacttaagagcttctgcatcagtgattgaaattgcatatgtgtataaatcatcaagtgccttctggtcatgcctgacgaaagagtgttgcttgctcagaaatggtgatttcaccgaatggcttggtttaatcgacctctttggccgatcgaataggatatcagaaggaccgccgataattctcctcttggatttaggtgggagctttgtacatgcgtactcctcacgcatgaaaattctcgccccactcgtctctttcaacatagagtccggagagagttaactaagtgtagtttgttggtaacctatatcagacagaacagtaagagtgacacatattatgtgcatgtggttggttatgaatgaaaatcaaaaactgacacaggcttgtgggtatcattacctccattcgaagagggagttttgtgcactgcattaccttctccggatttgtcagaggcatctactgactttgagattggctgatctggggtacgtgatagaaagttgagttcgtgttctttgtcagagtcttcagccacattggagatgtcatgacctggggtacatgccaccatgtttgcttctgcgatatcttgtgttattcctagattaaagcttgggggctcgatgtcagacctggcatcgtaggtacgatccacatggatagcctgtgtacagatatatcaacaattcttatggaaaaatggattctttttatattgaatagattgacaaactacatgagattgcacctctattgcacccgtatgatggccaagattgtatttttcatcatgtttgtttcgcagctgaaacccaaaaaaaatgtcaatagtctgaagtttctgcacaagggaaatttcaacaagaatactctaccggcaggagagttgattttaccttcatctttccatacgcggggaaaggattccggttcttgagaattacatccctctcaatgaattctgctatcatggagtcattgtacacgccaatccttggaatgttttcctgctcgggagtgtccgtcccgaaatccagattgtccagataaaaaagctgagcagtataaattatagcatgtgaaaagatgttgcgggtatattagaaagtaaaaggcaaataattcgaacgaataataggataatctcacctgaggtagtataatgcagccattgatgtaaccaatgcttt

SEQ ID NO: 87672 - DNA, 1704 bp, Oryza sativa
acttaaataatgatattaaagatcttaatatggctagatgctgatctacataatatatgttatcaaacaaaaacacgacttcatttcttgttttggatgttaatcaatcttattttgttgaaccagttttgcagcagcacttgttgataaaccattatgggtaatgaatgttgttccggtcggtcagcccgatactttgccagttattttcaacagaggccttattggggtatatcatgattggtgtgaatctttcaacacgtacccacggacctatgatctccttcacatgagctatcttcttggaagtcttacaaataggtatgcagcgaggccttgaaatatttactacttttgctccattacctcataatcatctagggtgatctttgcatctttattttaggtgtgacatcatggaggtagcagctgaaatagacaggatattgagacctgacagatggtttgtgttgagagacaccacagaaatgataaaaaagatgcggccagttctcaagtccctgcactacgaaactgtagttgtcaaacagcaatttcttgttgctaaaaagggtttctggcgttctggcaagtgagcctcctgatcagaatgacgctcaaatgttttcagggtagtcatcaacagcaaacaattcaattgattctttacatccctattgattagttctttatacagaagacagagtttgatcaaaccaaggattaggcatgttgattctacaaaatacttatacagaacagttagttcgacaaaaatacatatacacatcttgtttatggggggccattacagtaataggcttaggctagtccactagtgctcacaagtttgtaatcatattattattcttttacattcagaaacagatacttttcaggaaaacattatgctctttcacgaatacatcctctgtccaaaaaaaatcaaactttggctatgaatctgaacaagaaaatcaaactttggctatgaatctgaacaagattcatagctagagttcaattctttttggtacggagagagtatatgtgatctgcttgcttcgatccgtgatgcaatgtaagctttgggccatttctgtctcgctgaatggaggctagtgtacccctggtgtaacgtaccactgcttaaaactctgaagcgcgtgtggtactttttacctcgcacgcgtacacgcggcagggcgtgtcggtcgctgagtgcccggctcagcacctggtcaaagatcgccggccgggacccctccggcccacgttttccgccggcgggaagagacatcagttaaagcagtgcgcacgcacgcacgtaaggagtacgtacttacgatggtacgaacgtacgcctgccgcccgcccgtacatgcatgcacataggaacccaaaacaaaaattatcgaaagtttaatacatattagttaacatgctataattcagctagaattaaataatccacccagggtactataaagcctagcactagtacaaatccgagcataccaatcgatttatatgtgacggaggtggcccgttacaataaagttattcatctttgtcaggttgtaaaaagccccatcgcaaagacactgagttagggctaggccagtcaccgatgactctcatcggttacggggattggttgcagctcattcaaggtaatcggtgaatgatcgatacgatacccta

SEQ ID NO: 87673 - DNA, 1144 bp, Oryza sativa
aattttattatagcatatagttcttattgaaaaacttgagttcaaaagggtagaatcaaattagtaaacctatcagctaattctatcaaagaaagcacaagcagccaaaggtcagtgaggttagaagctaacatcgagagactggtagcagcagaacccaacatttgtgcacttaatgttttttcgcttttactgcagttttagtatataacagaataaactttatgccccaagcaataagtaaagaaccagaaggtgagaacagtaataacataaccaaaaagatggtggaatccatacggtgtgcttttggtaagctctgtgatatactctttccacatctcatgcattggcttgtagaggtcaaacctgcaagggcaagccacatatgtaaaaagtacataatgtccaaaggtactatattatgtgaagattcaatcaaacatgtaaagtgtagtttaatcattaccctaaagggattccattttatcaaaagaaaaccatgataaggaaattatgactgaggacaagaaaaggagtcaatctatgcacttattcggaacaagacttacttgcggagtgtctcaggtaaatcaaatgacccacatttcttatgttgcttaagtgacatgtgcctttttgatcgctttgaatgaattaacaaagattttgcctgtgcatcaactaatctaggacccctgtgaacatagttatccagcagaatccctttttccagctttaactttttggctcccttggtaatttttccagcatctccacctttctgaattatgtcataaacaacattgtgcacaacatccatactgtccaaatcctacaacaatgaagtacactacaataaatatcataagttatttcctcatgcctaaatttaatttttgaaacccacacacggagaataggtaccgaaatgcttctttggagcaaattatcatgtggagcaaatgaaagttcagagtatacaggattggtttctccacctacaaagttaaatgtacatgtcaaacagccacacacagaactcacagatctatgtatgttagagcctaagaaggcacctgaggaagcagaagaactggagattgctagacctgagatcagaagcagtgttagaaaaaatggc

SEQ ID NO: 87674 - DNA, 1444 bp, Oryza sativa
cggcataaagcattttctgggcctgcggataccgggttttcacatctcgaagtgcctcgctgacgaagtagacaggccgctgcacctttcgggggggccggttcgtgctgtcaagggctggtaactcggggcgcacctgttcggaggtcctggggggatcccagactgcctcgggatcatcaagctcagggccacctgccaaagcctccgctcctcccttgggggcctcggggccctcctgggggctagaagctttgggcgctagaccttcgggggacgaggggccatcgcaagccggagggccctctcgttcgccttcctcatgctcaactactagggcggcactcaccacatggggggtcgcggccaagtagagtagcaatggttcctccggtcccgaggctaccaagatgagggggaagtgaggtaagctttcagctgattgagagcttgctcagcttcctccgtccatacaaacggcccggagcgcttgaggagcttgaataggggcagcgccctctcacccagcctcgatataaaccgactcagggcagccatgcatccagtgacgcactgcacatccctaagcttgctggggggcgcatcctctctatcgcacgtattttctcaggatttgcttctatgcctcgggaagagactagaaaaccgagaagtttgcctgccggcacaccgaacacacacttatcggggttcagctttacgcgcgtggacctaagactatcgaaagttttggctaggtcctatagcaacgtgtcctggtggcgcgtctttaccaccagatcatcgacatacgcctctacattgcgccctatctgattacttaaagtaatacgagtcatgcgctgaaaagtagggcctgcattcttcaacccaaaaggcatagttgtataacaaaaggtgcccacaggagtaataaaggcggtttttttcctcatcttccctagccatacgaatctgatggtacccagagtatgcatctagaaaacacaaaaggtcgcaccccgcagtggagtcgactatttgatctatgcgtggcagagggaagggatctttggggcatgccttgttgaggtcggtgtagtcgatgcacatccgtagcttgccattggccttcgggaccaccaccgggtttgccagccactccggatggatttcctcgcgaatgaaatcagcctccaggagccgcgccacttcctccttgatgaaggcctgccgctccggggcttgacgccgcaccttctgccggacaggtcgcgcatccggccgcacggcaaggcggtgctcgatcacctccctggagaccccgggcatatccgacggcttccatgcgaaaacgtcagaatttgcccgcaggaagaagacgagcgcgccttcctatttggcgtccaaggttccgccaatcttggcggtcttggacggatcg

SEQ ID NO: 87675 - DNA, 1112 bp, Oryza sativa
tccaaacagtcccgcagtcttgggtttttcctctgtcgtgtacttgtgtcaatgacggtgggcacaatgtaaacaccgggtccacatgtcataggtagacccctcttcttcatgttctgttgatgaggccccgggtttgttgggatgaacgcttctttgctggtggaccgtggaactggtccatatgtagctgtccgtgacggccatgtgaacatttgttgggtcggcccggcccagcctggcctgaattttcctaagcttgggccttgacttttttgtgtaaggaataacttgtcaacgaatctaattctcatcctttaacagaaaaaccagatacaactagatacaacaagtccctcaactattaaaaaccagtgcaaatgaggtccctcgctgatttggacagcggttttgactgacgtggtgactacgtagctaatttgactcggtcttcatctaacgtggcattgacgtggcaattcgatccagaaaaataataaagccgtgggaccccatatcaatttcacatgcaaattaataaaaaaatggtgggggtccacgtgggccccaccgtctatccgcagggtggcgttacttgtcgcgccgaagtcacattggccaagggagagtagctgcatcatgttgcagctgccgaagagaccagcaatcgcgtcctcctcgaagccgaaggttttgcaaggtgaggctggtgaggcacctgaacggggccgggtaagcgtcgaagagtgactggaagcgttgtccgaagaggcgcctctgttcgagggtcgcggcgccggcagcgacccgatcggtccacatgtccatctcaaggctctccaggctgctgttgctgccgtcaaggaggaggtcgtcgacggcgcgggcgacggcgtgcagcaggtaaggctccgcgatgaggaagctgagggacacgctcttgatggctctctccgcgcttggagccaacaaccaccttgtcgcgttagcatacgccgacatgatccggtgtctgtcgtccgacgaggaggagtcgccatggtcatgcggcatgaagtctgcgacatcgatgtcaagcctatgggagagcagatgagggacgcgcctctacc

SEQ ID NO: 87676 - DNA, 571 bp, Oryza sativa
tactatactgaacatttatgccttccttcccttagtcatttaagccatctgcattcttctaaatcactgcaacaacaatatttatatagataggcaacacagcaagttgagctgttaaaatgccagagtaagacaataatgagtatcatatcatacttttcattcgttctccagaatgccccagcattgtcgataaccatcttgagcaactcaagagacaacaccttcccgcgcagcaggacctgatcttcgggattatccggcgtcgagaacttcatggacagcttgcacaggttcttgaacagtgtcaacccatcctccctgatcttgctcatgacaacatcctccttcccatccgtctcggccggctcaaccggggaccccggctcagggacatcgcttccctccatcgtctcgtttatgaagctctgcgccgcatggacaatgctggagtcattcaggttgcggtcagacatgtccatcatgtcggtgatcgacaccgtgcgcacgcgcacatccatggagtccacctccacgcgcgcgaacacgatcaccagcacctgcgccagcg

SEQ ID NO: 87677 - DNA, 711 bp, Oryza sativa
acgtgcaccgcgtccgcgagcgcccggagacgacgctctacggctcccgcacggtgttcttcctcaccggcgccggcacgctgtcgccgctcgccatcgagctggcgcggccgcagtcgccaacgaggccgcagtgaggccgccttcgtccacgggcccgacgccacggcgtcgtggctgtggaagctcgccaaggcgcacgtcctctcccacgacaccggctaccaccagctcgtcagccactggctccgcacccactgctgcgtcgagccgtacatcatcgccgccaaccggcagctcagccggatgcacccggtgcaccgcctcctccacccacacttccgctacaccatggagatcaatgccctggccagggagagcctcatcaatgccgacggcatcatcgaggagtccttctggcccgggaggtacgccatggagctcagctccgtcgcctacgccgccacgtggcgcttcgacgccgaggccctgcccgaggacctggtgcgccgcgggctcgccgttcgacaggaggacggcgagctcgagctcaccatcaaggactacccgtacgccaacgacgggctgctggtctggaacccatcacagtgggcgtcggattacatcgacttctactacaagtccgacgaggaggtcgcctgcgacgaggaggtgcgggcgtggtgggaggaggtgcgcaccaaggggcac

SEQ ID NO: 87678 - DNA, 1303 bp, Oryza sativa
tgaacatgtgctccaagtgccacaaggagatgatcatgaaggaggagcagcccaagcttgctgcctcctccatcgatagcattgtcaatggttgtgacggtgggaaggagcatattgttgctgccagtggtagcacggcggtggcggtggctcaggtcgaggcgaagacgctcgttgtgcagcctaccgatgtcgcgggcaccagcgaggaggttgctgtagtccccaaggtcaaggaagggccgaaccggtgcgctacctgtaggaagagggttggctgacgggattcaactgccggtgcggtaacatgtactgtgcgttgcaccgctactccgacaagcatgaatgccagttcgactaccggactgcggctagggatgccatcgccaaggccaacccagtggtgaaggctgagaagctcgacaagatctaaggcggctaggggcgtggaatggattgcaacctacaagatttcaacatccacctttgctgctctatcctccacttttcttgtcggctgctacatttcttaaattgttcaactttgtgatgcacactgcatcctggcagccgaaagaattcatcctctcagtcaagtcaagtggtttgcgtgttgggtatgttgtgtaatctttattcttggtggctttcggtcagtattgtggtgtctcatttagctagctctgtgatgtactatgtcccatgcttgctacatttcaatcagtaatagttatcagcaatggtccatcatattgccaacatgtccattattcatttttccttaaagattatttatgtatgcacctttatctggtgcgcattcaaattcatgtatgttcaaagaagtttgccggattgtgcttggttggctgggtctactctagattgaaaatcggatctgagaggaaattgtgacaaatgaaagttagttctcaggttattactctatccccaaatggtcattctttaatgctactgagaatagttgggattagatctgcaacatgtaacactgaaagttcagcatgtgaagctgttctgtttcagtaatctgggatgtagttaataatctgccttaaagttcaaacatctattaacttgtgatctgaaccagcatacatattgttgtcacgaagataaccattttgtcgattatttcctggtgcaaggcagctgcagttctgattcgattgataatttcacagattctgacatctgctaccaaattctgccccccttatattatccaattgaaatccttaggtggataatttcacagatgcttacattttgttatatcact

SEQ ID NO: 87679 - DNA, 757 bp, Oryza sativa
ccacgccatcctggtaacttttctttcagctgctaaaatttacatttttgtgatatttgatgatattctgaatccagtagtattcatgtaggaccataagacatgttggaggtgccatgagaggtgctggtgcagagcaaatctcagtccttgtgcggtcaattgtagagagcaaagccagcaacaatgtattgcgttacttctacggtatagggtacaagttagatcatgaagttctgaagggaggatttgcatttcgtttccaccgaggtgcccagataactgtgaccgttacctctgttagcaagatgacaaaactccatgctaccaacgaagctgtgccaatcactcctgcaatacagctagtggaaatcacggcccctgctgctgctgacaattacaacgatgtcgtttcagccgtcacttcgttctgtgaatatctagcaccgtaagtaactaagtgttccttagctatctcaagattattactagactggcataaacgaattttctcacttttgactgcaaaacacactgcaggcttctgcatctctctaaaccaggcaattcgactggaatcgtcccgactgcaggcgctgctgccgcctcactcatgtcaagtggtggtggtggtggtggtaaaacgttgtgatcggtcatatgtgttggctgcaatgccatgatgatctccattgaccatcccacttaaaacattgttgccatctttagttctgtaacttttagtcagtagcaccat

SEQ ID NO: 87680 - DNA, 1082 bp, Oryza sativa
  unsure (1)..(1082): unsure at all n locations
ccaccaggcgccggtgcataccntgctcttgtattatatttgtgctgggctctaggcacacactgttcttcgggagctcaaaaaaaacgagctccacccggtcgttgaacgggtcggtgaagacgatgtaccatgtcagatcgagccacccaagctatccaacgaactccaccgcctcgatgtacatgtttatctgccatggaaccggaagcggggatggtttcaaaaaggaaccgccgcatgttgaaggctccactgttactgtcctcgcagagcacggtgacgacatagctgtcagccggcccgtggccggcatcggagcaggtgaagaggctagtgttgcggcacccggggaacatggtgctccgcttggtgccttcgatgtccgggaggcggaacagctcgccggtgagcgggttgcagacggattgcatgtattctggttctgggtcaccgaggtggcttccgcgagtggcgccggtggcggcgacatgcttggagaggccgctttcccaagtagcacgggctatgaggtcggagacgacagaggccgggacgcgggcatccatgtagatgaggtggaggccattgccgcttgtgcgtagaccttgccgcttacgaaccccatggtgtcgcttgttggtggcctagctcacaagatcacgcactcacttattgtttacacactatagaaagagtctaacagatgaacataagaactctcacgcacaagcgctagatgtacgcacaagcaatattttgtggcgctgcgcaccagcgcgcagctaatgcactgtctattctccacaaacaatataactaaacggaatgcttacatgcttaattagccacacaataataaaacaataacttagccacgattggccgcacgacgcggccgagcattctcgtggctaagtacccactcactaacttatcgacatgcaagccacaattgcttgcatgcagatcaccactaacatatgcatgcatgctagctgatccacacttcacgccataactctcacttcacttgacttggccactcctccaaggcaacttgcactagctgcatgtaatca

SEQ ID NO: 87681 - DNA, 603 bp, Oryza sativa
tcatgttgcctttaaattttgtatatagatccttcaagtcctttttttcagaatctgaccctctgtacttagcttcaaattcttcaatatcagcctcagtaacctgcagaagtgtaggtcatcaccgatcattgtataggtgaacagatagcacaagtttttttgttgatatggaccaaaaagatacctttttgtaaacagctctgaagtactcttgaagattgctgcagcttctccaaccagtgcctacaggaaaagacaaaacttcagaaaatctactgggagtgaaaggttggaaatcacactacttggaatcaggtgctcacatcatcatcagcaattccagtctcatcatataatgcccttttctcctcatcccaagaatagatatcaccttctgaagctgctgaaatttctccttggcttcctgacatcacataacagctcaattgagacaaatggcacttaatccatggaaaaaatttggaaacaagatcctacctcatctccaggattcttgtctggatgaagacgtaaggccaacttgtgataagccttctttatttcctgctgtgaagctgtcctctcaacccctaagatctt

SEQ ID NO: 87682 - DNA, 1651 bp, Oryza sativa
tttcctttgctagacatgtccttcacgaaaaagacttgcgttacatcattggcaaggacaaaaggttcgtccgagtatccaaccttgttaaggtcaacagttgtcatcccactatcatcaatcattacgcctccaccagtcaacctaacccattggcaccggaacagaggaaccttgagaggaccatagtcaagttcccatatgtcctcgatggcatcgtaatacgtggcagttgttccatcgtgtcccatggcatcgacacgaatagcgctgttttggttcgtgctcttcatgtcttgggctctcgtgtagaatgtgtacccattgatctcatatccctggaatgtcgtgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtctttgataaattctacgcaaaattcgatgactcctctgttccataacccttggcgatgcttgcctctggacgagcacggttacgaacatacttcttcagaacgcccatgtacctcttgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatatatccggatcgatgaccttctgcgaaattgcgttcatgaatgcacatagctttgttattgttgtccggacattgtctggaatgataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggtccctttccgaacactactttaagatctttaaccatagcaaacactgttttcccgctgcgatgtttaggcttcgtacgatggtcgaccttatgttcgaagtgcttgcctttcttccgtaccgggtagtttgctgcaaggaatcgacg

SEQ ID NO: 87683 - DNA, 877 bp, Oryza sativa
tgtctttgatgagaatgtttttccttttgcatccctccactctaatgccggtgcaagactacggtctgagattttattgctgccacctacacttctgaacccggatgatagtactggtaggggtacaacaataggagatgaccatatgcttgataatcctgaacatactaatacttttgctgaagaaaatgcagagaatacagatcatatagagctggatttcaacacagccacacaagatccggagttcacagaagatcatgatgatacgggcggagattctcccgctctgtcgtcgccctcgggatcgggagctgctgtcacgtcgccgtcatcgttgcctgtgattcctaaggctccggtgtctcctactgccagccattcagcgtcggccacgactccagatgctcccgaggcacatgattcagctacgtccgctgctgctggattttctacaccggtgcccacacggccggtcacacggctacagagaggaatacgcaaggaataactttatactgatggtacggtacgctattcgtttttagcagtaaatggtgaacctcaaaatctagatgaagcctgtctaacaaaaattgggaaagtgctatggatactgagttttctgccttgatgaataataaaacttggcatttagttccaccagaaaaagggaggaatattattgactgtaagtgggtgtataaaattaaaaggaagtctgatggcagtttggatagatacaaggctcgtttagttgcaaaggggtttgagcagagatatggaattgattacgaggatacttttagtccagttgtaaaggcagctacaattaggactatattgtctgttgcagtgtctagaggttggtctctta

SEQ ID NO: 87684 - DNA, 671 bp, Oryza sativa
ccctactggcctcgtccactgccggccacgcctcttcgcgccaggtcggtctcccgccaccggccgcacgaccggtggctacgcctccttgcgccgtgccgacctccgctgccaccggcggaacctctatgcaccaagctagcctctgagcactcctcccgccgctgccgcgccggccaaatgctgtcatctgccacgccaccctggctagccgcccgaggccgtccttgcctcctctcacaatcgtcgtagcccgtttccagacgtcgacaccgcatccacaccttcctcgcctctacatgctgccaccggcaaccgacgccgcattcacagccgttgccgccgtcagccaccgccgtcgccagccacaaccgccgccagcagcgcctccagccgctactaccaacggccggccggccgctgtcgccgtaggcctcacgccgccatcgacctgccgcgatgggcgctcctactgagagctcgcccgctatcgccgacccatcgccgcgagctccgctgcccccgctgcgagctcgcccaatctgaccgccgggtggccagatccgcctccggggggccggatccggcgcgccgtttacatccctgcctccgtcgacccaaccatgcctctaccgtcgtcgtcgccatccccgccgacagccacccccccc

SEQ ID NO: 87685 - DNA, 529 bp, Oryza sativa
taacgccgcttcggtcggcgagcgtaattaacgcgcgcacgatacaatccatttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgcttccttcctttcgccattggtcctcttgccttcgccgcctgagctctaactctttctctgctaccccctactttcgccacacgcgctcgttctcaatcatctcttcctccaccgccatggcacggggctctgctctgctcgacggcagtgtactaccgccttcccgcatcgtgagcgagaggcacgccggactgccgcgccgcttcatgccggagtccgccaccggtcgggagatagtgatgctgggcgaggggcgcccggcaccagactacccggggcggtccatcttc

SEQ ID NO: 87686 - DNA, 707 bp, Oryza sativa
tactgagcaaagtccggaatattgtcgtcttccacttcatcttcttccatttcaacaccttgctctctgtgggatgtccaacaattatagcttggcatgaaccccgactcaaacaagtggaaatgaatagtcctggatgcagaatactccttctgattcttacacttattgcatggacaacaaataaaacccctttgcctgtagcttcggccactctcaaaaaatagtgcacaccgtcaataaactctttggaccgccggtcagcgtacatccattgccgatccatctacatgagtcaaaaaaaccgtacacaaataatattcttacaataatgacagtcatacaataattataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaacctttt

SEQ ID NO: 87687 - DNA, 611 bp, Oryza sativa
atccgggactaaagatcgagctgacctttttttttttcatggctctgttgctgcatggtttatatatatatatatatatatatataaaccatgcatatatatgtttcaatacatatatatgcatacatatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaataaaacaagaaatcgctacgtactgaaattttgaatttatttgtacgtacatcgagctctcttgtggtgatgatttggtttgcaaggcagtggcaatactcgcacacgta

SEQ ID NO: 87688 - DNA, 703 bp, Oryza sativa
ggtggttgtccagttttagcgtggtcacgacgtgacgttcccacgtttgtctcaagagatttgcggtggggatctacatatttggatgaagatttagttgatcacgccaaaaaatcacagattctgatgagctttttttgtcaaaaaagaaatcacaaattgcattaccagtggtagctccggtgccttcttacggaggatgcgccgcgccatgtcagcggccatggggtgcacgatcgccgaccggtcaaacgccggcgcggggggagatggccggccgcgcgccgccgcggaccacgcgtccatgaaccgccagaagctctggccgtatgccacggcgtggtgcacgcacacgcccaccgagacgccgcccccgcccccgcaaccgacgaagcgcgtcacatgcacggcgagcaccggcgcggggagctcggggacctccaggctgggcacgagccgcaagaacaccaggacgtcgagcctctaggtgggcgtccgtgccggcgtgcaaccgtcgaccaccacctacaagaacgcgaccccgtcggcgacgcggacggcgagtggtcgtgtcgtggtgtaaccacgatcgcttcaaccaattcgcggtggggagctacaaatttaaacggaaattcagttgaacacgtttaaaatcagacgacatgatgaattttagccaaaaatgcacgagcgcacatac

SEQ ID NO: 87689 - DNA, 605 bp, Oryza sativa
tagtccatcatgtttccggctgcacggctggcctttatgccgccggtgttgggcgcctacctcttcaccgaccggccgccttgttcgccgacgactggtgcttccgcctgcacggctgacttattatgccgccgttgttgggcgtctacgtcttcaccgaccggccgcctcgaccgcgccgactggtgtttccgcctgcacggctggcctattatgccgccgttgttgggcgtctacgtcttcaccgaccggccgcctcgaccgccgccgactggtgtttccgcctgcacggctggcctattatgccgccgttgttgggcggctacgtcttcaccgaccggcttgccttcgccgctgccgactggtgtttccgcctgcacggctggcctttatgccgccgttattgggcgtctacgtcttcaccgaccgacttgccttcgccgctgccgactggtgtttccgcctgcacggctggcctttatgccgccgctgttgggcctctacgtcttcaccgaccggacggctcgttcgccgacgactgatgctttcgcctgcacggctggcctttatgccgacgttgatgggcgtctacatcttcaccgacc

SEQ ID NO: 87690 - DNA, 547 bp, Oryza sativa
gcgggcacaccgttgagcgtcacctcgtagtgcagattgcactcgttgtcaatggacatccaggccatgccgacggcatgtggattctgtgcatccgtgtgctcctgtcgcttcagcagaatgggttccgccgagtcccgagcatcggccactggacggggcactaggcggccacggatcaggctcgtctcatgctcggtggccacattaacgcccagttcgccggcatacagcgactcgaggaccttgggacccaacttctccacactaccaatggcctggttgaagttgaagctcggcgtcagatcctccagcttggccttccggttgccctgctcctcaatcaaactgatgttgggcctatcccgggtgttcacgtgctccgtttcgatgttgtaggccagagatccatcggtgttcaagtagacccacgccaaaccgctgctcttggtcgaggattcggcactgtgcggcgccagcagggtctggaagatttcgcagctggctcgggtcacgatgtgtccctggatgcgcagatgtgggtact

SEQ ID NO: 87691 - DNA, 870 bp, Oryza sativa
gtcgtagacgcccaacagcggcggcataataggccagccgtgtaggcggaggcatggacgcccatgaacggtggtgtgaccaaccaaccgtataggcgaggacaccagtcggcggcgacggaggcaggccggcggtgaagtcgtagacgcccaacagcagcggcataataggctagccgtgtaggcagaaacaccagtcggcggcggcgaaggcaagccggtcggtgaagacgtggacgcccatgaacggtggtgtgaccaaccaaccgtataggcgaggacaccagtcggcggcgacggaggcaggccggcggtgaagtcgtagacgcccaacagcggcggcataaataggccagccgtgtaggcagaaacaccagtcggcggcggcgaaggcaagccggtcggtgaagacgtggacgcccatgaacggtggtgtgaccaaccaaccgtataggcgaggacaccagtcggcggcgacggaggcaggctggcggtgaagtcgtagacgcccaacagcagcggcataataggctagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccaaccgtgtaggcggaggcaccaatcggcggcgacggaggcaggccggcggtgaagtcgtagacgcccaac

SEQ ID NO: 87692 - DNA, 4468 bp, Oryza sativa
aaatatatggtatatatggtataatattggagtaagtaatattataaaggatttattaattgtttgaaaaatgattataatatataattagcctaagctataatattggtcaataaaaatgcacacttacgtggcaaaaagtaatgatattgtatttaattaattgcttgataaacccaaacagcaccttgactatataaaaaagtcagcggggcagctatataaagctttactgtttgacaccttttaagatgcatggtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagttggcatggagatgaaatgaccaacatgaagacgaaattgctcatcagaagtaacggaagatgtcagtggtagtaaagatgccaccgatcaaatgtaatgaagttgcataaccatggaggcgaagaaaccagttggcaacagtcaggtcagctagcagtgaatatgtaggcgcccaacaacaacgaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtaggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagtgactcattggctgattaattgattttttcagcttgacataaaatttgtcaaattttgagccttatatttgtgtagcccccgactctttggttagttgggaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagagtttgccagtgccgaagataataaagatgaagtcgctccaccatgatgacaaagttgtattgccgtaatgaagtgaacacaagtcggcggcaacagaagcaaaccggtagtgaagacgcgcagttgtgaagataaaagcaccagtcggcggcggcataatcagtcggcgacggaagatgatgatgtccatcagtagtggtagctgtataaaccagacgtagaggcgagggcactagtcagcagcagacgagacgaccagcgatgaagatggtaaggccaatcaacactggcagaatcatgcagccatggaagtgaagaaaccagtcggcagccatgacaaacgtaggcagcttgtgttgaagatactgatgcctattagtagtgacagcgatgtacccagccgtgaagaagatagcatcagttggcgttataacaggccagccgtgcaggcggtgccaccagtcggcggcggacgaagcggccggtcggtgaaaacgtatacgcccaacaacggcggcataataggccagccgtgcaggcggaaacaccagtctgcggcggacgaggcggccggtcggtgaagacgtatacgcccaacaacggcggcataataggccaacgtgcaggcggaaacaccagtcggcagcgaacgaggcggccggtcagtgaagacgtagacgcccaacaacggcggcataataggccagccgtgcaggcggaaacaccagtcggcggcggtcgaggcggccggtcggtgaagacgtagacgcccaacaacggcggcataataagtcagccgtgcaggcggaagcaccagtcggcggcggacgaggcggccggtcggtgaagacgtaggcgcccaacaacggcggcataaaggccagccgtgcaggcggaaacaccagtcggcagcggagaaggcaagccggtcggtgaagacgtagacgcccaacaacggcggcataataggccagccgtgcaggcggaaacaccagtcggcagcggcgaaggcaagccggtcggtgaagacgtagacgcccaacaacggcggcataataggccagccgtgcaggcggaaacaccagtcggcggcggccaaggcaagccggtcggtgaagacgtagacgcccaacaacggcggcataaaggccagccgtgcaggcggaagcaccagtcggcggcggacaaggcaagccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcagcggcgaaggcaagccggtcggtgacgacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccccaagcatcgggagtcggcctaggcatttcccaaacatgcatatgagtgacatgagttcgtcattaatggaacaaagtttcacggatcagaatttactactcaggtacttttgcaattattaagagcagaaaataaatttatctcatctctatgcttttgatttattccaaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagacgcccaacagcggcggcatattaggccagccgtgtaggcggaggcaccagtcggcggcgacggaggcaggccggcggtgaagatgacgatgcccatcaacggtggtgtgaccaaccgaccgtataggcggggacaccagtcggcggcgacggaggcaggccggtggtgaagtcgtagacgcccaacagcggcggcataataggccagccgtgtaggcggaggcaccagtcggcggcgacggaggcaggccggcggtgaagatgacgatgcccatcaacggtggtgtgaccaaccgaccgtataggcggggacaccagtcggcggcgacggaggcaggccggtggtgaagtcgtagacgcccaacagcggcggcataataggccagccgtgtaggcggaggca

SEQ ID NO: 87693 - DNA, 1950 bp, Oryza sativa
tacgcaaatgggcatggtcgagagcatgcctgccataattaatgatttattgacaacgaaatggatatatatatatgatgtataattaatatgacagttacagagatttacagtagtacaagtgttatccatgtgagtacgtatcactgatgatcgaacattgaaatcaatggatttcaaccagattttcttcaaccatagaaatgtcgtagtaatcggatatatacactagatatttcgtgaggatttgtatgcatggtgaccgtgcgcttctctgttccattagggcatatattaatttggcaaaatttattacagatccagagatcattgattccagttttgggctacttagagcaggtacaataacaggctataagccagctataaacatattttaaaaagataaaggaagagagagaagagcagcgggctacagatctgtagccagctgcagcacggacgtcaagacataatgtgtgtatgacaggtgggaccaggtattgatagtatagtaaacaactattgtatgaattggctatagatgatttggagctagtagtgggctatactattaaacttgctcttagggcagtcccaacccatagtgtccataagcattgtttatggtgccatgttaataagacgtcacaatagaaactacactctacaacccatgatttcttaaagtgggccattaataaatacatcatctctcttctctaccaatcatatttattcttcatctattatgaacacactattctcccaatgcaaaacttgatagtgtctagtgcatataggttctcgtgttgaagctgtgtcttgcatgagacccagtttcttcctctcttcactctctctcttaattaatatagtgccacataagataaaaatcctacatgacaatgtagttaatgtcatagacaccatcctaggtggagggttgagactgcccttagtagctactatagaagacagcgtaaaatcatactatttatgttgtaccatactcaaaataattttgttgtttgctactccacactatgctcctgcggtaaaaaaaaaacacatcacacatgcgattttattatatttaattttaaatacatgtatacagctgcctattcccttaattatctgcaccttctttctccccttatttcttttccaaaccacctcacgccaaggagcccaaatctgaagggtatttttttctttttttgaaaaaagaaaatattacagatgcatgctagctcaccatgtgcacactaattaacccctataaatacacatgcacactctactacctttatgagtatatctaaaagattagaccagcatatcttaagattgataaagttatcacggatgtgtcgctggtgcacgactaatacattacctaccattaaatgaataattactcataaacgcaagcactcgttccaagtttagtatgtacttgaacccggatatatgggtaggttatagcacaagaaatccattgaattgagctacgcttcctacgtaaatccaaagagtaaaattggaatactagtttgaaccaaataaaatgtacttgaccccaggtcgaattaattataaactttgctttaccaaattggtcttgtaatatataagtccatcggataaagtctccgttacacgctagacaaatgtcgccaacacactttcctccgactttttatcgtagcgaatggccgtggtacgcagcttcgcgaacgatcgatcgtttggctgcacgcattcggcttgccaaggatcggagacaacttcctccgatctagaggcgctttgtcatttgtcaacacaagacaaaacaacacgtacgttgctacctcgatcgcatataagcaccatgaactatatataagataatcgatcgatcgatggatctgccctttggagaatgcgtgtttccaacgtaaa

SEQ ID NO: 87694 - DNA, 930 bp, Oryza sativa
ataaaaaaaattcgtttcatagcgtcatctacaaaatctcatccgtcgccgtctccgcgctcgcatggtaatccgtcgtcctcgccgggtcccagccggacaacggcggcgccggtgccaacgccgacgctgacgcgcgcgcgcccctcgtcttcttcgccgactgccgccgtcggctggacccgcccgtcgacgcggcctacttcggcaactgcgtcgccaaggcggcggccgcgcgcgaccgacctggcccggccgacccccggcgcggcgtcctgcatgcgcgcgcgccacgcgatccagagggccgtcggcgttcgtggcgtttgctccggcagccgaggttcgtggcggcgtccgcctcgccgcggtttcgggcgtacgacgcggcggattttgggctggggcgcgccaaatcccagccaggtacgagctctggcaacaacgaagcactaccaaagccgtagatatgtctccattgattgaacacgttcgaccatgagatcgcaaacatcatgcttgttaggaaattataggcaaataaactataaaaaacaatagatcaatcatagaagatatgaaatttaacgtgaaaaaccctcccaaattagaagagaaaaaaaccattgaacgtgaaaaacctttccaaaatagaagagaaaaaaaccattgacgtcagcaatatatcttcactatatcaaggtgagattaccacactgaacggcagcttacaagatatatatacaaaggtgaaaccctaaaatataacgatcacttctgctcaccctctagcatctacgggcctccgcttcgctctggtaaaagctacatttattatgtataaatgaatttggatcacagctcaacggtgctgtcactcaccagtaaagaagttgcgacctaaacgcctccatatgctccggacggagc

SEQ ID NO: 87695 - DNA, 1572 bp, Oryza sativa
ttttttactgctgtcagaatattgttgctcaaattaatcaagcaattgaagctgaggaaattgttagtatggaatgcaaacaagttgtgggggactacggggacatgatcctcgagatgctcatagcacaggtttgccacttgtctgaacattggattgaatttttcttgtgatgcttcatttttttcattgatcttggattctctgaccaaatataaaataattttgtgactgagcaggcaagccccatgaaactgtgctctcagattggtctctgtgcatttgatggtactcgttctgtcaggtcagcacaacacatacatgacattttaattgccatcttaatatatctatgttcctcctttttgttccctttccatgacagacttgtttcacgaatgaatatgtagaaacaatatagagtctgttgttgataaaaaaaaggtgggctcagatctttcctgcactgcttgcgagatggctgttgtctggatacagaatcagctccgacataaccaacaagggagctcattttgcaatatgctgaccaggtaagtagtgatcattacgtcctttgctatgtcgcaccagcctttcctgattgcaaagcataacattccaatcccaatttaccgaagctctgcgagcgtctcccaagccccaatggcgaatcggcagtcgactgcgatgagatctcaaacatgccgaacctttcattcaccatagcaaacaagaccttcaccttgacaccagagcaggtggctccctcagtgacacacttggcccatcctcttaagctatactcatgcttttctaaatctcaccgtcgtcttcttcaactatgcagtacgtagtgaagctggagcagcaaggtcaaactgtttgcatcagcgggttcatggcgttcgacgtgccacctccacgcggcccactctggtacacaaattacactgtcatcaagaagcgggagctccatgttgttaggttctttgaccgtttgacgtttagcttctcgttatctgacccatcttgttgcattgcgtttttgcaggattcttggagacgtgttcatggctgcataccacactgtcttcgactttggcaaaaacaggattgggttcgccgagtctgcttgaattgcttggctagggccttcaggatcatacaacatatcaagtattgtaatgtttgttaggcagcttgtttactcggtattgtaacctgggaatgtctaaaggtatagtgcattagtagtagcatgcaaaaccttgtagaggaataaacgttttcacgatggagctgtatcagctatggatatgcagatatggatcttggatggtgcaatgcagatgtaatgagcaaatgagcacgatgagaattagggctttttaatctgatctcatcatataggtaatggtttgtctggcatataatgatgggcctaaaacttctggcgaggttaataatggctgtactgactgtttatgcaccttaacattcagagttcaaaatctctcattaaccaatttgtgatggatgcagctatggtgatctttttttttgtttgatgat

SEQ ID NO: 87696 - DNA, 1602 bp, Oryza sativa
atatatatatatatatatatacttaatatagattgtgtgatgtatatgtattttgtattatgagttttttggttagtgtggttttaggctaacgtaattgctttcaattccacagatgttttattttgtccaatatttggagttggtgagtttacttacttgacaggattaacttcacgtagtgcaaattaactaattttactttgaaaattgcagtgcacgctccaactagtttatgttgagcaataagctctagttagctcatcatcctgcctagtactatatagctcagtcttatcttgaatcctactgtactttatgtaaaataaatcggtgtgattattgtacttaattataacttgacacaagcatgactacagtttgagagtcatacatatattagtacctaatttctagaaagttataattgactagaatataatccaggacactagctaatgattgtgtacatgcatgtaatggcacatatgtacgtacgcgtaggttctattcatgtctgtgtttttgttcgtatatatttctacttgggcaaacatatatagttttgttcttatagttacataactccttgagcacttttgtaattaattcgtcagcaacaataccatagatcgagttcgtccacatattaaaatcttcacgggtttgaatgtgttcgtcctcgtacatgtgtgcacatccacacaagtgaaaaataaggtatcatccggagaggcagattctcgtcgtatcgggcctgttcactttgatgccattttcaatcttagcaaattttggtaaagttataaaaaagtggttatatttactttgctatcaaattttagtaactatataagaaatcctaccaaaattttggcaacttggtaaggttctttttttgcgttaaagtgaataggccctacgtaccaacaattatgctgtgtttagaggtggaggttagaaactatatctccccacacacaaaacataatgatccgttagcgcgtgtttatttaactattagctaaaataaacttaaaaatagattaatatgattttaaaacaatttatatatataacttttttctgataatacgtaccgtttagcagttgtaaaacatccgtgtggaaaatgagggagtaccagtcgggaagatgtgataaaaacacacccttaataatcacttaattagccggacagttttaattaattaagataatttgaattagttgtaagcataactggatggttaattgttgttaccgattttatttgtttttgtctgctcgcaagtatagcacgtacttacgtacgtagaaacgtacgtatacgggtagtattatacctgcatcatgagggggaggtcgagggggtggacaccgggggcggcgtcagggaggaggtcatcctcagagatcatgagcgggtggtcaaggccattcacatcatccaagctccaaccagcaacagcctccacaaaccaagcaccctcaccaatgcactccacacaaacactccccaacccaccaccaccatccacaaacctccccacaaactaatagtattccaccagcgccttccccagcacctccttaatcacc

SEQ ID NO: 87697 - DNA, 693 bp, Oryza sativa
ggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggtggtgaagtcgtagacgcccaacagcagcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggtggtgaagttgtagacgcccaacagcggcggcataataggccagccgtgtaggcggaggcaccactcggcggcgacggaggcaggccggcggtgaagtcgtagacgcccaacagcggcggcataataggccagctgtgtaggcggaggcaccactcggcggcgacggaagcaagccggcggtgtaaatgacgatgcccatcaacggtggtgtgaccaaccgaccgtataggcggggacaccagtcggcggcgacggaggcaggcccgcggtgtaaatgacgatgccccataacggtggtgtgaccaaacgaccggattggcgaggacacca

SEQ ID NO: 87698 - DNA, 1188 bp, Oryza sativa
  unsure (1)..(1188): unsure at all n locations
tcggttggtcacaccaccgttgatgggcatcgtcatttacaccgccggcctgcctcagtcgccgcgnactggtgtcaccgcctatacggtcggttggtcacaccaccgttgatgggcatcgtcatttacaccgccggcctgcctctgtcgccgcngagtggtgcctccgcctacacagctggcttattatgccgccgctgttgggcgtttacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcttattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgctgctgttgggcatctacgacttcaccaccggcctgcctccgtcgccgccgactggtgtccccgcctatacggtcggttggtcacaccaccgttgatgggcatcgtcatctgcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccaccggcctgcctccgtcgccgccgagtggtgcctccgcctacacggctggcctattatgccgccgctgttgggcgtctacgacttcaccaccggcctgcctccgtcgccgccgattggtgcctccgcctacacgggtgggctattatgccgccgctgttgggcgtctacgacttcaccgccggccttgcttcgtcggcgtcgagtggtgccttcggctacacggctgggctattatgccgctgctggtgggcgtttacgactttaccacgcgcctgcctccgtcgtcggcgactggtgtcctagcctatacagacgggtgatcacactcaccgttgttgggcat

SEQ ID NO: 87699 - DNA, 505 bp, Oryza sativa
tgtctaacttgttatccggcatagtccaattggcaacgaaatcggcgagtatctgggacttgatggctgttcgtggcacaaagtggacatcaaactggctcagctcgactacccatttcgcaatgcggccgacaacatctttgtttctcacaactttgccaagagggaaaaaggagacaactgtgactctgtgggcttgaaagtagtggcgtagcttccttgatgtcatgatgaccgtgtaaagcagcttttggatctgtgggtatcttgtctttgcgtcgtggagagcttcgctaacgtaatagactggtcgttgtactttctctctctcgacaacaatgacggtgctaacggaatacggtgtggcggcaatatagaggaataattcttcattaggttggggagcaacaagtacagggggtttgataggtagcgcttgagtgcaacaaatgcctcgtcggcttcctgtgtccatacaaatttgtcttgtttcttcagcagagcg

SEQ ID NO: 87700 - DNA, 509 bp, Oryza sativa
agcaacgctaattgggaaaactgctggatgttgcgcaggagacgagaaatctgacagctaatgaacgcatctttcgcgatgatttaaaagcaaagatcctaggcttggctgtccttaataagatacagattcgcaatgatcgaggttaacgtggttaaaggaaggtgatgttaattccaaattctttcatatcaaagcaaactcccgtaggagaaaaaacttcatccagaccctgcagtccccaaacggtttagcagtctcggcctaggataaggctgatactctttttcgcttctttttggataagctgggaactccatcacaaagacagtcttgcctcaattgggaagcactcaacttcacatccttcgatctagacgatcaagaagacgatatcacagaagaagaactaaaacaaacagtattctccatgcccgtccgaaaagtcacccggccagatggtttcattggagctttttttaaaattgcttgggagataatcaaagaca

SEQ ID NO: 87701 - DNA, 762 bp, Oryza sativa
ccattacaagcaagacattgtatgaagaggggcgaacatgcagattgataaactgacgcgtggtggacaagaatgactgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagaagggggagattttgtttggaagggatccagaacgatcagagagggagagagtaagagctctctggttctccagctcttttgtagcttcttcatacatagatccaccaaaacacaggagtagggtattacgcttctcagcggcccgaacctgtatacatcgcccgtgtcttgtgtgtttccattctcgcgaaccttccacacaccgagagcttagaatctcacccagggcccccggccgaaccggcaaaggggggcctgcgtggtctcccggtgaggagccccacgctccgtcagtgtgattgggaatgaggggtgggtgatatgtgaatgaggggttatatgtgattgtgaatgtgaatttgggaatgtgggtgatatgtgaatggaattgggagggtatgttcaattttgcaggatatgtgaatttgtcaaattttttaaataa

SEQ ID NO: 87702 - DNA, 624 bp, Oryza sativa
agctaacaataagggtcacaccgccgagtggataatgaaagaacacaagcgtctcttcatagattggttgcgagacctagacttacctgagggacaaactactgatgaaataactatgaagcggttggcttgtggtccatcaactacagtaaattcttggcagggatatgacattaatggatactcgtttagtacaagagcccgagataataagatctgtacgcaaaacagcggtgtccgtgtggaggcaattgatgaagccgaggaaaaacaatcatacttcgggtttattgaagaaatatgggaaatcgactatgggcacacagtgcaattccccatatttaagtgccagtgggtaaaatacccaaacggggtcaatgttgataagttcggtcttactattgttgacctggcgagtgtgggtcacaaggatgacccttgggtactcgccaatcgcgtggcacaagtgttttacgtgaaagacccatcaaatttgaagaaagatatagtgctacccgggaaacaaaagatattgggagtggatggggttgaagatgtcgaagattacaatcaatacgatagtatgccactttatagtcagtttgtacagaagattaagaatgt

SEQ ID NO: 87703 - DNA, 519 bp, Oryza sativa
gaatttccccccctaaacctaaaaactagacattactcaccctaaactttcaataccggacgaattacccccctcgatcaaatctagagcagttttgtcctacgtggcgtacgcgtggcaacccaatcagcattttcccttttcttaacatggtggggcccacttgtcaatctctcccatctcctttttcctcttcccctcttcctctctctcgtgacttcaggcacggccgcgcgggcggtcggcatgcgagggggcggtgggcggcagcgcatcgtcaggcgctgccgcgcgggcggtgggcggtggcgcgggtattcaattacggatagtatgggcaatctagtagttagccaaactagtgaggaaacaacaacatattatcaagaaaacattcacatcacgaagacgaggaaatcggaagaacacctagagtctcctgaacgcgtcggacatggcgtcaggccggccacacacggcacatccaatcaaagtggggatcctctagagtcgacctgc

SEQ ID NO: 87704 - DNA, 2052 bp, Oryza sativa
cacaagccttgccttgtacttttcaattgtaccatcaggcctaagctttttcttgaaaacccatttgcatcctacaggcttgcacccatatggatgctcaacgacttcccaagtaccattagacataattgagtccatctcactgtgtactgcttccttccagtagtcagcgtcaggagatgaatatgcctcttctatggttcttggagtgtcatccacgaggtatataatgcagtcatccccaaaggattttgcaaccctttgtctcttactcctacgagtatctacaatgctatcctcctcacgatttccctcaggcgtttgatcattgtgttctatcggtgcaaagtgctcataggatatgacagtttcttgactagaagtgctaggtgtatttttcatgggaaattcattctcaaagaatgtagcatccctggactcaataattgtaccaacacgcatgttgggtactctagagtttactattaagaatctataacccacgctgtgaatagcataaccaaggaacacacaatcaacagtattcggtacaagtttacgctttttggctataggtacatttaccttagccaaacagccccatgttcgtaggtatgagagatttaatttcttcctttcccatttctcgaatggtgttacttccttatgcttcattggagttttattcaggacatgacacgcagtcaaaaccgcctcaccccaccattccttggaaagtccgtagtgtctaacatggcattcaccatctcagttagagtacggttctttctttcggctaccccatttgattggggtgaatagggaggcgtcctctcatgaataattccaaactcctcgcaaaaggatgtaaactcattggaaaaatactctccacccctattagacctcaaccgtttgattttcctttcaagttggttttctacctcagctttataggtcttaaagtaatgcaatgcttcatcttttgttttcaatagatacacataacaaaatctagtgcaaacatctatcagtgtcatgaaatatttctttccccctttagtcaacacgccgttcatttcgcacaaatcggaatgaacaagttctagaggtgccaaatccctcgcctcagatgccttgtgaggcttgcgaggttgtttcgattgaacacaagtatggcacgttcttcagctgcacggtctttcccaaagtaaacttcagatcgaccgtaccaacaccatgaacagccgtaagtgacccgtttcccatcaacaaggaggaacctctcccgacctgataagaagaaaacagggaaatatcagcacatacatgaatattagcaccagtatcaacccaccaatctggtgaatgaaaaatagagagaactgtaggtaaaattttaccgtaccccgatgttcctctgccctcgctagtgaccatgttggcagacttcctatctttgcgcttaggacagtccttggcccaatacccagacttgccacacacaaagcagtctccctttgcctttcccttgcctttcttcttaaaattggttgtagccatgggtttaacatcaggcttgaatttcttgttgttgtgggatgcatgagggttcttcttctgtaccatattggcactagaaccaccctcaacctttttgtccctgttgtcctttgccctcgcgttctcttcaacacccaaagagctaatgagatcagaaacactgaactcttgtctcttgtgctttagagaagtggcaaagtccgaccaagaagttggcaatttggcaataatgccacctaccacaaacttgtccggcaactcacaattgttgttctcaagttacttagccagcatatgaatctcaggagcttgttctactacagaacggtcatcgaccatcttgtagtcatagaactgctccatgacatacagctcactgccggcgtcggaaactccgaacttggcctcaagtgcatcccacatgtccttccctgaaggcatgtgcatatacacgtccactatattgtcagcaagtacactgatcaatgc

SEQ ID NO: 87705 - DNA, 591 bp, Oryza sativa
tatatcctatgtatgtcacaaatcgaaatcaaacaagaatttcaggcataatgtgactttcaggagctaaaggcatgcgcacataccgatctggggatcaccagtgttggcatcaatattccccagcagaccattaattcttgcagtctcaagctcatggtggcagctgcaaattttccatggagatatgacactgcctctgtaagctaccttgaatgacgttagggaagcaagaaactaacctatgtccagatagagtagcgtggttgcattcaacatttatcttgaattctcctgtatatggtgaaaaagaatgtactttagattatttcacaatacacggttaactccagacagacagcagtaaataaaattgttcaaaacactaatggtgttaatacatgaattcctgaaatccaaataacagttcaactttcgaaatcactgtaacccaataacaaactacatatgtacctgttagaccatatttctgtaggaaagagaatgtggttgcaacatcccaatcgtacctgggagaggacaaacaagggttaggattgtttaatcctgtgacattttgttaatgtaaac

SEQ ID NO: 87706 - DNA, 563 bp, Oryza sativa
aatatgctttcagatttacttacattaggatatttcgatccagaaaggtcggtagctcaattccatctatgtgataatgtaaaataccttgtccatttggtacaagaccaaataaaaatattgttcttataatcggtatggatggaaggtgagttaaattatgataatattttctcaactttttctttcttagtttagatgaaaaaaaatctgacctctaatgtttgtgcagtttttaccggtgtcagtttgatccagtaaacggtggagaaatgaaacagcttgagtacacgaattttttaaatatgtagggatgatgatctgttcaaaatcagaatatgtattgatattatcatagttgacagagaagttatcatttttttcacttgtcttatttcgatttggagtttaaaagatatttttgccttcatagatttgatttatttgggtatatagtgtcatcggattattctctttatagtgtagtgacacgataatatacaataatacttagcacactttgaatcaaacttaaatctcctaaactgattgatttaatttta

SEQ ID NO: 87707 - DNA, 1300 bp, Oryza sativa
gacggcgcacgacgcccgcgccgtgaggtcgctccgcgcccgcatgaacgccgacgtcgagcaggtgctccgccgcgccagggccgtaaaggggaggctccaggcgctcgaccgcgccaacgccgccagccgcaagctccccggccgcggccctggctcctccaccgaccgcacccgctcctccatcgtctccggcctcggcaccaagctcaaggacctcatggacgacttccaggtgaggaaaaaaaacagcagctaaaaattatggctaaaacttttatatctttgagtgtattgttagtggtttaaaagttaatgctggaaaatagactacaatgtaaaaaactaaaatcaacttcaaatttcagttttaatattggtttcgatcagttttaatagtggctgttgcgatcaggtttccaccatattggtttgcacatttcttttcacaagggggacgatcgaaaagattttagaaattgaggaaatttcggaatcaaacaagttaaagctttaacaaatttatgttgaacttcaaaaatgcttgattaaaaaaataaatatttcagagatcataatgtcctatcgcggactataggacaataatctctaaaattattgaaattaatatccgaaacattaaacctgaccgtgataactgataaaccaataagaaaacgatgaaaaacaatgcaatacgtgcaggggctgaggagtcggatggcggaggagtacaaggagacggtggcgcggcgatactacacggtgacgggggagaaagccgaggagagcacggtggaagccctcatctcgtcgggggagagcgagacgttcctgcagaaggcgatccaggaacaagggcgcggccaggtgctcgacaccatctccgagatccaggagcggcacgacgccgtgaaggagatcgagcgcggcctgctcgacctccaccaggtgttcctcgacatggcggcgctcgtcgaggcccagggccaccagctcaacgacatcgagagccacgtcgcgcgcgccaactccttcgtccgccgcggcgccgtcgagctcgagacggcgcgggagtaccagcggagcagccgcaagtgggcatgcatcgccatcctcgccggtgttgtgctcgtcgtcatcatcgtccttcccatcatcgtcaacctccacctcttgaccattagatagactccctttctttcaggaaactattctaatccctctcgagtgatgtcctctcattacatcaaatagttgtaaaagatttgatgaaatagattagtatgtgatatatgat

SEQ ID NO: 87708 - DNA, 1315 bp, Oryza sativa
attggacattgttacgagacacttcgttgattcaggtttgggactatcaaacgaagagctgtgttcaacggcttgaaggacatgcacataatgtctctgctgtttgtttccatccgaagttacctataacacttactggctccgaggatgggacagttcgcttgtggcactctactacctacaggttctcttgctctctccccctataatagaactcataggatacttcatgcatagtttgaattttgagataaattcatgtacttgttactctcatagatgtgatgttctattgatggcaataaaaactctgttcggtggcataaaatctggttcttaaataatcattggtgtgtcatatctattgatgaccttacaagtgtagtttctggtctccatgtccttgtttcttttggaattagtttgtgcatttagtaatttattatttagccatgtaattttgattgatgcagcattacagtctttaatctagatataagcttttgagtgaaagtgttacatttacgcctatagcataagtttgtattacaactcagtcctattttagtaacaatataggtcaatttacagcttgaagtacgactaactaagaggaatattttctattaaccctgtcctgactggtatcagacctggtagtgatggttgggggttaaactaagagaatttggagttaatggaaacatgaaaatattcaactatactacttcctaacaattggtgatctctgaagtgaagcactgtgtccagagaatttgaagctaccattttcctgtggtgttgagaacaaggagattctcttgccatattatgaaactacttcgtccgtttcataatgtaagactttctagtattgtccacattcatatacatgctaatgaatctatatatattataatgtctagattcattagcatctatatgaatatgtgcaatgctagaatgacttacattgtgaaacggagggagtagcattctacaccaggatatagataaacattttttgaggggtgcgaccaggatgcacatcacgcccatgccacaaacgttcactttcgcgtcgcagtttactatatatgcttatgcttagttggcacctggcaagatattcttatctctgtgcattggtttgttcttttctttttcttttttggaagactgctttggattgttccatttttgtcaatcattgttttaggccttttattcttactgtagacaggaataacacgttgcttgtttcttacaggcttgagaacactcttaactatggccttgagcgagtgtgggcttt

SEQ ID NO: 87709 - DNA, 1210 bp, Oryza sativa
cagcacaattcaacacctccggtgagtaaaatgtctattgtaaaccaaagctcttcttccaaagaaacctgcaaggatcagaacttaaaggaaacaagtcaaagttaacaaagtctgaagaaccgtttgccatgacagattcaaaatcaataaaagttgcacattctaatcaaacttcacgcaatctaaataatgagctatttgaggacagcacaccttttgctgttaaaagtggtatgtctgaaccacctgaaaatcgatcttctgaacaagctttggatttggctgaacctgcctccagtgatttggcctactttcagactacagctgtaacttcaagctcctcaaaggcttccggctctcagagaaggaaacaaaacttccacgttgcaaaaacttcaccaattgagtctgtctcttcatcaccacctagaatctctaacaatgacaaggtctcccatgacaaaatactgggaaaggaggatctacatgtgctaatacaaacaacatgcagagcttggtaaagaatactgaagttatagtagataatgtcggcaggccaggaagtcacatgagagcatgcttgctagtgaacctgttatgaatggtttttcacaagggaactctgataaagataatgaattgcctcagttaactcaaggccatgcttccaatgggattattcggggaaggagtttggatgatgatctgcagcatgcatctgggaggaaagattcttctttgaaaagctccaatgcagctagaagtcatacccacttgcattatgttaataaaaataacttgcttactgatggctcttcaatccaacataggatggcagtcttggatactaaaggtgattccatggtacatgaaaacaagagaagtgttacttctctccaagacagaaatggatcaactcattacccaccagatggaaatccccaatcagaggtgtcattcggaaaagaaaagtcacatcccaagagcaacaagcatgatatgcagaattccaaagcccaaatgctccctcacctctgaaagaaagtaaagtggaatcccactccgctccattaagatctaatgcatcaaaattgacagcacagttaaagcggggcaatgttgaaaatggagggcaacatggcattacaaaacaagcaatttctaatcctgcagacacttccagtccagttaggaaggataataactc

SEQ ID NO: 87710 - DNA, 583 bp, Oryza sativa
ttatatacaatggtttaagatgccgattctctgtcccctcgggtttctcgaacactgcctattctggtgacaaccaacttagccgattcctcctccacctcgtcgacatcggcgtgatcgatcccgaattctgctggcagggtaaagaccatgttaaccggtgccgtcacaacactcttcccttttgccaacctctttgcctcatcggctgcaacatcatcagctacaggaacctgattcttaacacgccactcctgccttggctttgctttcttcagccgatgatttatttcttgttcaacctcctgaaggcgctccctgttactcaatctttgaacccttctcttctgattcttcttgaaaataccagaaggacaccattgattcttcctgattacattgtcctcttggccatgatcttgatttactggacccaatctttgatgaacagaaactcttgtctgccttagccgattacccctattatatgatcggcttgagttctcgacgatgtcactacacccagggcagttttcaatagatggcaacctcataccttcattccagtagaatctaaagaact

SEQ ID NO: 87711 - DNA, 621 bp, Oryza sativa
atgtgctattgaagtttcccacacccaaaatgaatcacagtataaagatttgattagtttagcgtatatgttctctgctccatagttctctccaatgtagctataaactttttcgttgtctgctaaacagtcttattccacaatttgctcttcacagaaacccttttcttttcatgttttcattaacttcttccttttcaagttaatttagtgatacgggaaaaaacttgacttgtgcagggttgtgatcggatatgatgaagggacaataatgataaaaattggccgtgaagttcctgttgctagcatggacagcagtggaaaaatcatatgggcaaaacataatgaaatccaaactgttaatatcaagaactattggtgcagaaccaatgagggtttttcttgttcaccatgctaatatgttgaaaacttgaataactttcttatacgtcttggttactaacctgttccattttttcagattgcagatgggtggaagcgcttacccttggtctggaaaggaagttgggaaaccctgtgatcttttatccacaaagtaagttcatatttgctattcaaacgaatgcatcattcgcataattgatgttttccaatagaacc

SEQ ID NO: 87712 - DNA, 1035 bp, Oryza sativa
tttcggatatattccacctgcagtaggaaatctgagcagcatacgcgatctaatatttgcaagaaataatttctttggacatattccatctaccgtaggaaatttgagcaacctctctattctaagctttgcacagaataatctctttggacatattccagagttcgttggcaatcttgtcaaactaaccaatctttttctacatggcaacagcttcagtggaagcataccttaagtttgagtctattctctaatagcatacactcttttataatttaaaaaataccgcaaaaacaatatctttctttaatagctttgctaccatgctattctggtagaagacactcaactccaatgctctctccaattcacattcccaacatagagacaaaggcaggcctactattgagacaaggtgcactactgattcaagaaatactggagacaatctgttgtagcaacaaagatgctttaagagtttgcaagtcgcgtggctgatagttttaaggtcatacatttggtccatctgtcaatatgggagttgtaccaatggtgtcataagttgtgatgtattgcatatagaatatagaagaaagtctacttggtcttgtgaactttggtgatccatgacatgtgggaccatgacaagcatgtattgtgaatttgtgatatgatcatatgagcagcaaatcctcaaatggatcaatccttcaactgtatgcttccactgagccaaggatcatatagcaaatcaggaacagtggcggagggagctgggtacatgtaacttcaatactgtacacatgtacacaattatatactcaaataaaaatctagctgtccaagggagtaaaaaattcatttgtattaatctatatcatatgaactagtttgataattcgttgataaatgtcactattttctaatcatgccacaaatcgggccgccactgaccaggaactagaactaacacaaggataattttggtcggtgtcgctagctctctggcccctattgtccctagaatgaactgat

SEQ ID NO: 87713 - DNA, 4229 bp, Oryza sativa
gtggtgacgcccgtgtacatcctcaaccgctcgcctaccaaggccctagacggcaggacaccgtacgaggcttggcatgggcgcaagtcgacggtctcccacctgtgggtcttcggctgcctcgcgttcgccaaggagcttggccacatcggcaagctcgacgataggagcacctcaggggtgttcatcagctacacggagggctcgaaggcctaccgcattctcgacccggagacacagcgtgtgcgcacggcgtgcgacgtagtgttcgacgaagggcgagggtgggcatgggacaaggcggtggacgatggttcgactccaacatacgaggacttcactgtcgagtacgtccactttgagggagctgggagagtaggcagctcttcttcaccgagcgtgtctaccccagtccccgagccaccaccgactcctacaccgacacaccctcgagccacgacttcgactacaacgagctcttcgctgacaccaccacagccggcgaccccatgcactccagcaccaacagccactcttccgggcacgtccactccgacgccagctcgcgttgagcacagcccagtggagtttgctactcctctctcccacaacgaggagcgcatcgacgcgtaccacgacggcgagctgctgcggtaccgtacgatgaaggacctcctcggcgaccagctagtgccgggactggtgcctcgcgacctggaggcgcagttgcaccttgcgtgcgacgacagtgagcctcggtctttcgtagaggccgagggacacgcggcatggcgcgccgcgatgcagtcggagatggacgcggttcaggagaaccgcacctgggagcttgctgacctccctcgtggtcaccgcgcgatcacccttaagtaggtgttcaagctaaagagggatgaagccggagccatcgtcaagcacaaggttcgcttggtggcatgtggtttcgtgcagcaggaggggatcgacatcgacgatgccttcgcccccgtggcacggatggaatccgtgcgactcctccttgcgctggctgctcaggaaggctggtgcatccatcacatggacgtcaagtcggcgcttctgaacggtgagttgaaggaggaggtctatgtgcaccagcagcggggtttcgcgatccccggcaaggagggcaaggtgctacgcctgcacaaggccctctacggcttgcggcaggcaccgaggagcacgactcaaggaggatgggcttacgatgcaaagcccggcacgagcgcgaccatctaccggcagggcaatagaggaaatgccttgctggtgggtgtctacgtcgacgacttggtgatcaccagcaccaaggatgcggaggtggcgacgttcaaggaagagatgaaggccaccttccagatgagtgatctggggcctctctccttctaccttgggatcgaggtgcaccaggacgactccgggatcacacttcgacagaccgcctacgccaagcgggttgttgagttggctgggctcaccgactgcaacccagctctcactccgatggagactgaagctatgccgcgatagcacgacggaggaggtacatgctacgctgtaccggcgtcttgtggggagctgtcgctacctcacccacacacgaccggacttggcattctccgtcggctacgttagtcggttcatgcagcgaccgatgacggagcatcagcaggctgtgaagaggatcatccgctacgttgcggggactctcgaccacggtctctactacccgaggtgtcctggcaaggcacacttcgtcgggtacagcgacagcgaccacgccggcaacatcgacaccagcaggagcacgagtaggattctcttcttcctcggcgagtgcctcgttagctggcagtcggtcaagcaacaggtggtggccctgtccagctgcgaggccgagtacatagcggccttcaccgcttcgacctaggcgctctggcttgctcaactgcttggtgatctcctcggcagagacactggagcggtggagctcagggtggacaacaagtcgctctggccctggcaaagaaccccgtttttcacgaacggagcaagcacatccgggtgaggtaccacttcatccgaggctacttagaggaagggagcatcagggcgagctacatcaacaccaaagaccaccttgcggatttgctcaccaagccccatgggaggatcaagttctttaagctttgctccaggattgggatgacccaactttcccacgagacgacgcacaagacttagggggagaatgatggaataagctaggtctttggtctttgtggtccttcccttacttttaggttgtttttctcctttttaggacaacatcctttcagttttgcttttagcatctttcagttttacttttagcatcttagtacaacatctctgctagcatctactttatgctttatgcttccaaatttcgaattttagactagcttccagccatccagccagctatggctatatatatatatgtatctaacctcccccgggacggcatggctttgagtttgtgaacggaagaaaaccagaaaattgccccatcttgggtgccatcctcttatcaatgagagtaaccattgaaatactaacacaaaagaccctatctcgcctttgtgcgtatttccatatcgcgcgggacaaagtgacggtgcaagatttcgtgcgcgcgtgccgcacgtgccaacagaacaagacggagcacctccatccagccgacctgctgcaatccttgccggtgccttcggcggagtgggctgacatcgctatggacttcgtcgaggggctcccgcgagaacatggcaagacggtcatcgtaacgttgcccacttcatcccgttctcatccgtacacggcgacatcggtagcagctgccttcttcgcggagatcgtctgcttgcacggtgttccggtctccattgtcatcgaccaagatccagtcttcagcagccctttttggcgtgaaattttccggttggcgggtgtgcagccgaatctttcatcagcccttcaccctcaatccgatggccagtccgaggtgactaacaagatcatcgtgatgtatcttcgatgtttcactaggaatcgtccgtgtcaatggcttcgatggcaaccgtgcgcggtgtattgctacaacatgtcgtatcagtcatcacttcggacatcgccgttccgcgtcgtatattgtcacgagctgccgacgctgcgtgcctacgatccgagttcatctcgtctgcccgcagttcaacagacgttacaggagcgggatgacttcctaagggcgtttcgcgatcgtttagaacaagctcaacagacttacagtttcgcgatcgtttagaacaagctcaacagacttacaaggctgcgtatgacggcaagcatcgtgcattggagttcagtgtgggcgactgggtttggcttcgtttgcttcaccgtccgattgcgtcaatcgctgtcaagggacgcgacaagctgggatgcattggcattggcgctgtggcgtatcgccttcatcttcccccgggcactcgattacttgacgtgtttcatgtggggttgttgaagccatttcacggagttccgccggagctagtaccactgttgccacccactcgtcatggtcaagtttgtttacagccggccaatgcttcctagagccgtttggcgcgtggtgttcgcgaagttcccattcattggaaggataaaccggcagctaaagcttcgtggatgtcgctggatggatttcggtcttggtatccagattttcaactcacggatgagctgcttctccagggagggagagatgtcatgtggggattatagtataaacgacaccgcaacaggagcagcgacggcaatgcgttacgaggaatagtgtgtggtccggtttagagtttgttagggagtttgttagttctatatctcttaagttgctaggattttattccttagatttgctttaaatttgtaggtcaattcaattgagatcagatcacatctcctgtatttcctgcctcgctggtgtggtgccaaacatggcttcgccgcgctgacaaggtccagggccatgcccagcaactgcgttcaaatactctcttcgccgcaatcccccttccaatctcctcgcccgtgacatcttgtccgtgttcaatctattatcgcgttgacttctatgcgctttc

SEQ ID NO: 87714 - DNA, 8181 bp, Oryza sativa
ctatgaacttgctcttatgcatatcgcctctataaataataacgacccagcacgaaacgcgggtataagatatgagcagtgtgcagatcgtttgagcagctagcaacaaattacaagagggtggcagctagctagttaggccggatggcgcggctgcagcgacgacgtctggtgctggcgctcctgcagctcgccgtggcgctctggttggcggctaccagcggctgcttctgccgccagccgccgagtccgatagccggcgtctcgtcgccgccgattctgccggacggcaaccggccaccgaagtcgcctccaggtgatcagagattcattttaccactacatacatacatacatacatacatacatacatacatgcatgcacctatacgaagctcaagctaaatttcaaaggccattaattgcgcgcatatataactaagcatatcaacttttatatatatatatatatatatatatatatatatatatattatcttccttttcaaatatatctgaataacatgtcgtttaattattcgtcttatttacaagaactatatgtaaatgacgtctatttcctcgtggcttgttttattataagaaatataaataacttgtattcttttaatctgtatttaatttgtgataatatgaatatccacacgccatcataaatataaattcaaaagcaaagagagtattcgttaatcttattttatgcgcgacataataataaataaatgtgacaatatactgacgcagttttgcttttcccttgttttgcagctcccgcatccgcacaacacatgaaccgctcctttcagccgggctgcccgccggattgcaccgaccagcaacgtcagccttaattagttatggactatcaacgacgtacgttcagcatatatactctggttgcaaacgtgttagtatgtactccactctgtaagttcgttccgatttcaaatgtaataatgcaaatttagcgcattgtattctcaactacttgtaagtataatttctattttactagtataaatgtagggccgagcgatcagattggtacatcttcaaaaacaatatcctagacttgattaattatatgtaaaaacgctcaaattaattactgcctctcctttcataaaagttacacctattacttttatccagtggcggatcccgaaaattggttcgttggtgtcatagcgtgtctatcggtgtcatagtatactaattatgcttagaacatgatgttatagtatatggataagcagttttgttattggttttgccgaaagtcgtcggtgtcgcctgacaccgatgattatactgtagatccgcccctgcttttatcaccaaaacttataagaaattggactctatgtcatctcccttccatgcatcgtgcatatgcaggctatgactatctcaatgactccaaaactgtacctggtggaacagtgggaaattcagcacccatatacatatccattagtttccttcaaacttccaacttttctatcatatcaaatgtttggatatatgtatggaggcattaagtatggatgaaaaaaaacaattgcacagtttgtatgtaaattgcgagacgaatcttttgatcctaattacgccatgatttgataatgtggtgctacaataaacatttgctaattacggattaattatgcttaattgattcgttttgcagtttgttttgttattagtctacgtttaatactttaaatgtgtgtccgtatacatcaaaatgtttttgccaaagcaactaaacacggccatatttggtttgccgttggtgtattgtgttagttattatatgcttatttttcaatttaagtttatgcgaaaaattaaagcctacaattagtacatattttcatgcatgaatcaaaattacaatgtgcgaaatccaagtaattaactcctataagtcgctgggctttccaatcccacccccctcaacttaatttgttcaaaacgtactccctataaatccacttactattccaacttcccacctctctatctctagttttcattgattcctcgtcacacatagagatttctcgcatcccatggatctcatgatggtgtcggtaaagttgctccttatatcttctctcctttggaatgagatttaatacaccattttcttgtagcatgtgataattatcatgtttcgttaccttaccgtttgtggaattattaaagcgtgcaacagcgaaaggtgcaaggaggattaggtgtacaccttttgtggaattattaaagcgcgtgcaacagcgaaacatgcaaggaggatgaggtgtacaactttggtttaaagggacaactttgcagtttgcacaccgtgatggaggtccatggatcatgagaaaaatagatagaggtggaaagttgaaaaaaataggagtgcacgaaattaaattataagaagagactgaaaatactagtgacttgtaggggtatttggattttcccccaattacaatttgatagaagattgaagtgcacacaggccatccctaaacttgcatagatgtatcatctagatccctgaactctcaacaaatatatttttgagtcgtcgaatttatctttgatgtcatataggtctaaacgggctccaacctcctccgtgcgccgacgtggcatgccgcaatggaatgttagtaggatccacattttagtcacatagaaaaaataaaattgaaaaacatcttttctcctcttaggttatatatgctagcaaaggatatacaggtatgatcaaattaactagggattatccagcacaattttatatggtgctagattttgagatacaattagacaattcttatattttatttataatcatacaacattatttctacaaaatagaacttaaacatataattggattccgaatacaatatgtagcttctatctcttagatataatggtattttgtacgcatgcaattatgatcgatcaatttgcaacggtataatatggcccaccaaagtcttatggttcgaacccttttctttttatctgagtaatgtggaaatttttaaccttctaaatgagacgaacgtagtgacttctttttgaattatcaatataacataacactaatgatataatagattatctatgatgttgatagtgctacggggggtatgcattatgaatcaacttgtatcacaatagtgtgagagagaacaaactttagtcaaccatacatgtacacttgtgtgaaccacctgctgctgtcaaatcctgagtacactagtgttctgttttttcttcattgagagctttctggtttctggccaaaccacggagttgtgttggacgaacatagaaaatcaagcacaccaaaagctgtccatttgtcgtatatatcactgtcaacgacgacgacgacatcaatcatcaatggatcggtgcatgcactcgatcgatcgcctctatctacaaatctttgcaagtgtgtacgtgcagacgagccggccgatgatccactgccaccgatcgagcagatgagcaggcagccagaactagctagctaggtaggtggtgttcagcgtttattagcaaaaaagaaggccatagcgtttagcgcgcgtcggcgagatggcgcttctgcagcgacgtaggcgacaccgtgtgttcgccgtcgttcagctccccctggcgctgtggccagggttggaaatttcggaccgaaatttcggtcattttggtcccctccgatacgatattagtttggccgaaatttttaaaatttttaattttttcaagaatttgggtaatatttgtttaaattcaactaaatattgtttaaattttggaaatttcggatcgaaatttcgggatttcggtgacccccgatcaaaaagccctaaaccgatatagtgaaaccctgactgtggctggcggcgacgagcggctaccggtgtaagatgggagtcgccccgccgccggcggtgggccagctggtggtggacggcagccgtattccgacgagccctccctgtgagcaccgatcatcgagctgagcactccgtttcttcttcctcaggcctttcacagtttcactcatgaatgtgacgaatagaattaatttgttttatctcgttttgcagctccacaggtgcactggccatggcgcacgcagccagagccggcgccgacgccggtctgcccgccggagggttgcatcggcggcggccacccgtctggccgacagccttagttatcagagatttggagcaaccaaagtgtcacttgggaagtcccaatggactactgtgtggctatgatacgtacgtgcacacagtagtttcgtataagtatgtaattatctgatctgaataaatttggtgcacgttatacatcaccaatttgcatcgattgaaagattgttattacttattacactactacataattaattttagtggaaaagatcctctttaatttgtagtggatcataactgctcgcatctgcaaatgtcgcttcccataaacagctcaagggtcacaagcaggccttaacaggcccgtatgtgaaaataagcatattttcgctggcagggctgttaagtggcccgcttgccaccagcctaccaggctagcttcccactcccttttccactaaaaaaaagtgtatcctctctctcacacactctcctcatactctcctccatcatcctctactccttccccatgtcctctcctcttcctgtctcctcaaatccaggcaatggaagatgggagtggtgaccacgcgactgttaacaaccaaatttagtaacatcggtgtcaggaaagaagattagatcaaagcgaagtcgaaggtggagatcgagttcggaaacagaacaggactcgactggagtccagatcggctacgattaggatcggctgggtctgagtcggactaggtaagccgatacagccgattccgacaatacgacttggtgtacaacatcggattgagacgatataattcaagatgattgccgcacatggatagagtcctgagaaggcaattgtatctattaattaggatgttttatgtaatttccttagagatatgcttaaggcaaaagtctgccgcaaagacttatggtattttagagtttgttagagatagcagtcgtgtccgttatggacatatcttgtaattcttgggtataaatagacccgagccctatgtaacttttaacacacacgttcaatacaatttcggcgcatcgccacccttttgatttagttttgtttcaacgagttcttgctttcaggttgagctgcatcggtttcgatcttcaacaagaggtaaaacttgttatgatggcttgcgttcataagattagtgcttccatcctcatgatactctaatcttgtttatgtgattcgtcgagttatcatatatcttacataatctccggcaatatcgcggtttaacctacgatcggctaacatctatcgaggaaggtagccgattaggttaaattctgacgttgactcagattatataagatatttaccactctatgaaacttccagcgacttgattgtctagatattgttcttcttttcatacttaatgctgcattaattgagtttgatctattaagtcgtgcttagaagatcaatctctagcctatcttctggttgccgattagggtagcatcagagtttcagccgatcttatctgatttaactatatttgctttatatgcttcattgatacgttaaatttgccctttaatcaagatattgctatatttaaatatattaggcctttgtttgatatattatacctattttaatatcctgatatagagtagtatcggagtattagccgatacatgctaggtctatttgatcggctatgctataaacatatatagtcctgttgttaatatatacttcgatctaagtgatttatactgtctcggcatggtgaccgatctaccccaatcacttgatttaagtatatatcgatataagaactatatattagaaatatctacagctgatcgaacagatttagttctttattgcctacttacaactgccgatcgattcatatatgacatcggctcaaggataaatgatatgtgctatcatttatagatttaaccgcggtttctttgcttctgtttcttgttgattacaggatcaaatcaactggcacgctaatacacctgaaggcgagctttggacctgcactggagttaagcagatctcccaggcctcgtgttttctgtcaacacgcttttggcacgcccagtggaacttgtaagaagtcagccgacagttcctcctcatggccgaaaaacaaccaccaccaccatctagtccaggctctgttaaggaaaagattaaggttaaaactgttaatacacagtaaaaatacacaaagagaagaaccatatcagcataattaaaatataggttaacatcactaacaaaaatctttacaaatttgcaagtcttcacataaatcaagtgtctacaaagacgagatttttcacacacagatcacaacacaattcgaaaattgcatgtaagaataatgataaaagtgatataactttgcgaaaaacatcatgcaaattacaaagtaataaaggcttgatagactgttagcaaatattaaaacaaatgatttatgataacctgtgatataaacgttcgatggaaccagctttattacatatatggataataccttaatttaaaccaaatttaagttgcacaatttgcacctctgctacattaattttacatagcacactcatatagctatatacctaggattaatgcgattctagttgcagaatgcagattttcatcctacttgtctcatcaaatacaacctagtgttctgaggcagatcgtccaaaacaaagtcaatcaacaagataaaatctcacctctttttcataataagatagtaaattttcatgtcgacattaaggttaagcacaacaaaaattgcagaacaaaacaaccattgcataaattaatcaaaacaatagtaccaaatttaggtcagcgtcttaccaggagcactccagtggctgcagggcagacagggcaaccaggacggagatgggaggcgtggggaggctgccggctcgacgagtgcactctcaccgccgtggtttgggcaaggcacaagctgtgggaggtcggatgcgggagagaataggctagggctggaggcaaggcgccggggacgagggagacgccgggcgcgtggaggttgggcttctctcggcgccggaggaatcggtacggaagcgtcggcgcgggagcgatgtgcgccaggggcagtgacgccggagacgcgagatgtgacgagaagaaacggatgacgacatccacaggaaaaactaacgaaggaaaattaatccgggtgaaattaattctctaatttaaatgaccaaaaagaccttttcagactcttacctaatactaaaactacccttgtatatactgctagtgtatactagcagtagaatgtaccataaaagtcatcttataggatgccacatggcagccttagagcatttgtagcaagtttaatgaatttttagcagataataatagatagatatactcggttggcctccttcggcaaaatgtatttctgtgaatagtcctgtacatagttcctcgtaaacaatagcaacaacacctaattactatatcacgatacacaaagtaagtttggagcaacttcagtagacttactagggcaaagttctacaaaaggaagaacataaagatgatatagagtaataaaaaatccctgatttgcgataatttgaagagagcatgttgcccaatatctctgtttctcgtgatgtgagtatttattcgttttgcagcggtcagaggatgtgaaaccaccgtatcctgttttttcttggaatctaaacaaatactggaaatgcaggacgacagtgcgcctaactgtattgggcgtgtcatccccctcggctctaaagatccaaagacgaggcctatctcctccttgtggcatttcgacaaacacctccggctcatcttgtcagcagctaaactgcaatcaaattcctgaagtacaaattgcattcccaccaagaaaaccaaatcaaacacgcacgctgccat

SEQ ID NO: 87715 - DNA, 1204 bp, Oryza sativa
ctccgcgcctcgctccccgtcgcctcctcgctccgcacatcgctccccgcgcgcatcctcgctctgcacctcctctcctcgcgacgatccaccgccggaccagcgacctcgcctcctcgctccgccgcaacgtcggacctccctcttcctcgcaacggttcagcgacggcgcaccaccgcaccgccataccagcgccgaggctgccgccgcccacgcctatccgccggcgccggcgccgaggaaggccccttccgccgccgccgccaccaccatcgccaccgtgcactcgaggtcgtccctcttccccatcggctgcagcctgagccgacgtcctccccatccgccaccgccgctgccgccgacggagccgaggtcgtccccagccaccgacgccaacggagccgaggtcgtctccagccgatgccgccgttttcctggtatcccattcctagcatcaacttgataatgcagcggatgccctcactttctcatctcaaataattaacaaagtgcgccattttcagctctgctactggttgaagaaatcattcctggcaagcagttgtggatccctaattctggagttctttctccttcacccatgcttacatgctgccatcctcgattactaccaccatggctgcgttgcaaggttgcaacacggtggtggatgtggacttgacagagcagtagcttcacataagtgctttgttatgttatcctcatgaggaagagattgaatggattgagggggattaatttcaggctcaatagatttggaataagtaccttccaaattcccctcaatccacatggggatggatgaactcaacaaggccgaatgcatctcaaatacaagttgtgatgtgaaggtgataatcaagattggaaaacccaggtaagatatgactttaagtggtgcaagttaatcgtgatagcaaatccgtttagtcttattaggaaatgtcatacatgaaagaatgtgattgacaaaaatatttttttagccttctgatttgcagatgctttattggagttgtgctgctcctcgcgacaaacatgaaatggagaagagaagggtatactcacatgcatatattatatattgatatttggcctattgtagaaactattggttttaagcatacatgccctaaaaagcatatggtttctatagtaagggttgataactccatattgata

SEQ ID NO: 87716 - DNA, 1639 bp, Oryza sativa
aaaatactctcctcaacccctaaacttcacaaaagaacaagaaatcctgaaaccatcacagtttctgcaaactggaaaagcaggccgttgtatgatcttctcatattgtgttttatttcctatgaccaacatagtgtcgcatgccaaaacttgtttctcacctcccatgacctgatgtcaccaatgcagtgcacctcgatgacgaagaagatagatgacagtacagtccgcctgctggttgcactcaagctctcacatggaaggctctgcctctatatgatcagatcaatacctctgcttctgccccttgtccaatctgggaatttgtgtagaagaattcagcccccctctgagtgcaacaatttttgcctggcttatcttcaaaaatcgactaccaacaatgacaaatttgctcatgaagaacattgtgcatacggaatctgcttgcatcaagacgaagatggcaatcacttattcttcaactgctcctttgctgaagttttcagcgaatcgatgtttgcctagaaggcacagaaaagaaaagagaaactttatgatatatatagtagaaatgtgaaataaaaaataactctttgtgggtagtccaaataaaaaactttggtgaaatgaaaaaaggataatatataacacattctgatctttttacacgtcaagtgttattcggaccattttcatgagataaaccagtagctcctaaaaacatatgaacaattatatttagatgaataatagcattcgtggatactttctgaacgctagcaatatacatctagcaggctagaataaatatatgcatacaccgagtaaaagagattagtgtaaattgagataagcatctttcataaacgaaacagagcagagcataatccatgtgaaaaactgaaaaccattcaaaaaatggaacaaaatgataactattaagcctttttctttgcacggattcagcacgaaatgcagcacaaaaattgcacataatggcacaagagggagaggacaccgggagtgcattcggcaaacctgcacagggtcgctttcaaggacgacgtcgaggaagccggtggatgatcgcaaggtgaaccggtttgacattcacaacggtgacgcaccgtgcgctggatctgcacatgacggagttgaggaggaagatccgatgacgaagtgcaccaggtgacagacctccacctttggggccgggtggaacagatcggcgaggcggccacaggttgaaaattatagtcagtacaggttgtggtcatgtatttactgagaaacctaaataatatacatgttacaagcatttctccgggtggaacagatctgcgaggcggccacaggttgaaaaatatagtcagtacaggttgtggtcaggtatttactgagaatcctaaatattatacatgttgttacaagcatttctcttagcaatcagtataccagctgtagttcacatccttgttcatttcattgtatcaaacaaattctgcaggtgcgataacgagatgaactatccactaatgtaaataatctatattataatgtaatcatccatcaatttgccaatgatgctggtaacaagtaaaagatttattgatgcagccaaaattaaactgtgtaaatt

SEQ ID NO: 87717 - DNA, 1205 bp, Oryza sativa
attcaaagttcattcctttaaaatctatatggccatcctcaaatcgctcgggtctaaatgtcttagcgtcctcccaatatttagggtctctaccgattacccacatgttcacaagcacaatagtaccttggggaatcgtagtccatgaccttacatgtctcctgacattccctccctagggagaagtagtggcaccacaggatgtaaccttaaggtctccttgataataagtttcaaatacttcaatttaaccaagtcatattctgacactatttgctttccttggagggcatcacgtaactctgcttgtgccttcagcattgttcttggattcattatgagctcagccatcgctcattgaagcgtatttgccgatgtctcgctgccagcaccaaaaaggtcctatatgcatggtaaaaaatacatgatttcccataaagtgtagaaaatattgtatcaattccttcctatgttcactatgcatacttttttataaaaaggaaattcatgtactcgctccatttatccgtataagttattctttaaaggtaaattttatatattctgacctaaacagtagttaaactagatgtattgttgcggtagtggatttatattttaaagttgtgtcttactccatcataatggatgctatgtttttttagcgagattaaggatgaaaacaagacaatgatatcctctattaaataagcgaagatgatttcatggtggttgggggataagaaaggaacaaaattaagtgataggtgctaggtgcaattaaaacatgtccatagtagttcaaaatccctaatatctattgacaattggagatggccaaaatactttatatttgcgaaagggggagtagctattaagttatatttttgtgaccaaataaatttatagtttggtattaaagattttttaaaaaataaaataaatcctatcgaaattaagggagatatagtattagcatccacaggaaaagaaaaaaaaagggagaacaactagagtacttacaaggacgacagctttgatattgcccatggtgaggggcacttggaggctcccttccttctgaatcctgagaagcacgtcgacgatgtcctcatcgtcttccacagcgccggcggcggcagctgcagcagctgccctcttctcctcatgctgcttgagggtaccgagctcgaattcgccctata

SEQ ID NO: 87718 - DNA, 1585 bp, Oryza sativa
aaaaaaaaagtatgcacactgaacaaaggaaggaagtaattgataacatatttttttacatatatgggaaatcatgttttttttcatgcatataggaactttttggtgctgggagcgagacatcagctatacacttcaatgggcgatgactgagctcataatgaatccaagagtgatgctgaaggcacaagctgagttaagtaacgtcatcaaaggaaagcaaacgatatctgaagatgacttagttgaattgaagtacttaaaacttattatcaaagagaccttaaggttacatcctgtagtgccactacttctccctagggaatgtcgggagacatgtgaggtcatggggtacgatatccccataggtactactgtgcttgttaacgtatgggcaatcggtagagatcctaagtattgggaggatgctgagacattcatacccgagcgatttgaggatggacatatagacttcaaaggaacagattttgaatttataccgtttggagctgggcgaaggatgtgccctggtatggcatttgcagaagcaatcatggagctcgttctagcctcgcttctctatcactttgattgggagcttcctgatgggatctcgccgaccaaggtggacatgatggaggagttgggtgcaactattcgaaaaaagaatgatctttatctcgttccaactgttcgtgtgcctatgtcgactgccctatagctgtttacacttaagagacaaaatatttgtctcatctgtacgcgcctatatgataaactatataacttttgatggattgatgtactcctactttgcatcctactcgttctacattattactttaaatttagttattaaactatttaatttatatatatgatcaagagtttaactcgtgacaataatttgataaataatatgttttaaatgctaaagtcctcctagcttgtcaattttgatggcggtcacctcattacacatatacatgtacttgcacgcacaatatctggtgtagactctgggatgccataaccatgaacaatatggagaaaggaggataatagtcgtgcctcctattgctggcagtagctctgctaacacacaatggcgttgtgtgaagagaagaggataagaggcgggttggagcctgagagttggaagggatgaggtggagaggggtgggacaaacatgagaaaagaggacttataattttgttttaaatttggtcaaatttaagaattttgactaaaaaaagttgaatgccttgtaatataaaacggagggagtaactattattaacagataaaattgtgtatagttgtattagtgccggtacgaaagtagtcgcgctgtccctctcattttgcaataatttctcttgcctatcttttcaaaatagggatagccgcactgtacctgactttttttttcacttacatgaatgaatgaacttctctatggaaactagtattttgatatctcgagcggatgtccacttgtctatttataaaccatccaaacaacaaagaaaaattctcaaatcgtctacactaacagcgtaaattttttaaatcattattcac

SEQ ID NO: 87719 - DNA, 1751 bp, Oryza sativa
atattttgtaagttatagtcatgtcctaagactcatcgaattattgagttcttaatcatatgtaaattattatcgcgaacttgatttcttagggagattactaaaaataatctatagattataatctataggagttcatccaattatattttcattaatcctataattaaatgctagtattttaggtatttaattagtaagaattcatctaactatattttcattaatcctataattaactttcgcaattttacgactataattaacctacgattaaattcttaactattttgaattttctaaacttctaaattttactcaaaccctatttattttctttctcttcctttccttttctttttccccttttttttcttctttcccttctcttttcttttctctctttttcctctcctctctttctttttctctctcttctctcctcccggctcctttctttcttttccttctcttcctctcttctctttcggctccttctccctctctctctcgccctgcctaccgagaccggctgaggaaaaggaaaaaggcggcggcggcacggcttaccggcggcaacggcaatggtggcggcgcacggtggctgcgacggcggtggcgcacggcggctgcgacggcggcggggaacgcggcacggccaaggcgcggcgcggcgcggcggcttcgtggcggcggcgtggcggctctatgcgacgacgcggcggcgtggaggcggcggcgcggcggcgtggaggcggcggcgtggtggagtgggtagagagaggaggtgaggatggagggaaagagtgggaatagtggagtttatataggagaggggaagagataagggggagaggggagaggggagacgcgacggcggcgcggggcgcgaggtgggggcgcgcggcgcgaggcgacgcgacggctgcgtggcgcgagcgacgcgacgggcgagcggcagcggcggcgcgcggcgcggcgcggggcgcatggcgacgcgacagcgacggcgacgtgcgagcgatggcgacggcgcgcggcgatgcgacggcgatggcgacggcgcgcggcgcggggcgcgagacgacgggacggcgcggcaggcgtacggcgcggcggggcgcgagatggcgacgtgacgggcgagcggcgacggcgacggccgacggcgacagcggtagcggcggtgcgcggcgtgaggtgtggggcgcgggcgcggcgtcggcgcggcagcggggcagggttaggctagggaacctcgtcgaacacctggcggccgatgaatagtgccgttttctatttaacccgatttaagcctattcatttatttaaaattgattctataaacctaaattttgtacaaatgaagttcactcaatatttgtgttattccaaccaatgggtccatccttgattaattttacctatattttatttttatataattttcttgaatttaattagagttaattcttattccgacacttttaaatttaattgatacaaatatagtcgtaataatattttactcatttctatcctcaccaaatattattttaaattgcactttaattatttacttagtcaatttactttttagggtttattcctaactaattatccattattcgcgatttataaactctgaaatcaaaatctaataaaataatcgaacaaaatcggcatgatgcaattttatttaaaaagtttttgaaggcccatatttttgaaactttgatttttgttcgtcg

SEQ ID NO: 87720 - DNA, 1193 bp, Oryza sativa
tacattactgtctcacataggttaaatcaaacaagacaatagctcagtacagtagttacagtactggctcacattgtcacattaaccatttacaacctcagaaacacaaaataatgagagtatggtagtaaaggggcgatcgactgccaaataagtcagtatattgtgcaaccaaggccaagattccattctatctagtgcatactactaggatgtaggatccaatcacaccacagtggttcactcattcactgaacatttcatctaatcagcatgtatgacgtatcctggaagtgcatactactcctatactaaaactgattcaatatagggagtcagcaaaattagcatccagtcgaacaagcgcatcatcggtatgtaaaacatccttatcacatcgcaatgctctcatgaacaccaagagttgcagagattaattattggaaccggtttcgctgagacgttctacggcaggataaagtcgagtgatcctccaattcgcaattcgtaactcgtaaatgatattgtgccagcgggatccaaacgcgcgcaccgcatgttccacgcagcacttagaactgagaatctgagagagcaaagttgtggctcacctggcatcccggtggcgagcagcccaatccggtcggtgatcgcgaacaggttcgtgatggtcgtcgggtcgtgcaacttgtcctgatcaggggaacgaagcaaatcaaacggccgcagaatgaatcacaaatgaggggacaaggggattccgctctcgcgacgtgctcacctccttccgatgggtgaggacgtagacggagtcgtcgccgcgcacgccgacggaggtgatcccggccagcttcacggcgttgaacgcgtagtctgcgagagcacacagcacggccgcacggggaggcgggcggcggaattgaagcagcagatcgttagccaaagcgcagacaccagcagcgaatttggtcggcgtggagggggcatgtcgcggcggcgggcactcaccgagttggcagaggcggccctccggggagaagagggtgatgaagcgctcgtagtcggcggggccggcggcgcggctgccgcctccggtgaccaccgccgcggcctcggcttccggcatctcgctagcaaattcaccctctctctctctctccgccgcgtgaggcgtgggaatggtggcgtggtgg

SEQ ID NO: 87721 - DNA, 667 bp, Oryza sativa
ttacatttgaaaaacaggggcccagcatcctcattcattctattgcatattatacatctactgtccagatccatccctctttgttgcaaattaactctcagcgccaaaatgttatgactgaatctccaaatgaaatgcttaaccttccctggtagctgcatcttccatactttcttccagtacatctcccgttcagtgctcccatttgacaaacctgcacttcccctctttcttctctgtaactccccatctcgctgcaccttataggctgatttcactgagaacaaacccttttcatcatagtgccaggccaacatgtcatccatctcgatgtgcaccggaatagtacggatcatattaacatcttccggccagaaagtctgtgtaagcagctcaacatcccaactacctgtacttggatctattagttcctccactcttgtgacaagatttctccctcttggtgtgatcggccgtctcgtatgatcacttgggatccatgggtcagaccagatattaatggccgccccatttccaactctccatatcatgccatctctcagagtcaaaagcccccggcatatactcctccaggtatacgacatgtttgcacatttctttgcactgaaaatattcccactcgggtagtattttgctttcaaaacct

SEQ ID NO: 87722 - DNA, 579 bp, Oryza sativa
atcatcggctgttaatgcaacaatctcaaccttgacatctttgatcatcggcttatatcccgatgccccttgggccaaatcattagcttcaatattttgctctcgagatacatgcttcaaggttaccatccgaaactccttcatcagctctcggcacttctcattataaatcattaacgtataatttttgcactcatactcccctgccaattgactgatcactagcaaagaatcttccataatttcgatagcatcggcttcaacttccttgagtaactgcaaccctttgagaactgcctcatactcagcttgagtgttagttgcataaggtttaatagtataagcaaactcaaaacttgccccccgaggagaaattataaccaagccgataccacaaccatgagtgcatactgatccgtcaaagaacaaagtccatggcacaacctcaaccgagccgattgaatcatccgatgaacacaataaaatcggctatagcttgccccttgactgccttcggtgactcataccgaagatcaaattctgttaaggaaaatatccacttttcaacccttcctttca

SEQ ID NO: 87723 - DNA, 1915 bp, Oryza sativa
cgatatggacatattttgtaattctcgggtataaatagacccgagccccatgtaatcaaactaacacacgttcaatacaatctcggcgcatcgctaccctttttactttcgttttgtttcgacgagttcttactttcgggttgagctgcatcggtttcgatcttcaactattgttatggcgtcttgcgttctcgggattagtgcttccatctttatgatactctaatcttgtttatataattcgtcgagttatcatatatcccatataatctccggcaatatcgttatctaacctccaatcggctaacgtctgttattagaaggcagccgattaggttaaataccgacgttgacttagattatataggatattcaccactctatgaaacatccaacggtttgattgtctagatattgtccttcttttcatacttatagctgcatcagttgggtttgaccttataagtcgtgattagaatctcaatctctagcctgcttttggttgccgattagggtagcatcggagtttcagccgatcttacctgatttaactacatttatcttatatgcttgattgacatgttaaatctgtcctttatgattaagatattgttgcatttatgtatattaggcttttgtttggtatattttacttgctttgatatcttaatatagagtactagtatcggagtattagccgatacatgctagatctatctgatcggctatgctatgaacatatatagtcttgttgttaatatatatttcgatctaagtgatttatactgtctcggcatggcgaccgatatatcccaatcacttgatttaagtatatatcgacatagagactatatattgttaatatctatagccgatcgaatagatttagttctttcttacttattcatgactgccgatcgattcacatatgacatcggctcaaagataaatgatatgtcatcggcaactagccgatcggctatcgtttatgaatttaaccgtggtttctttgtctttatttcttgttgattgcaggatcaaatcaactggcacgctcatacacctaaaagcaagcttttgaacctgcacttgagttaagcagatctcccaggcctcgtgttttcacatcaacatcctttacctcgtgaaattatacgtgaaaattctctagttattatattccaaaattttctgctcgatttggacaatttttctttggaaaatatgtggtttccacttctatattatcaacaatagcaacatgctcgtatagtccagcatgccaaaaaaaaaaaacatgcccatacaacttgtggaatgaattcaaaggccgtgtgcttaaaatcaattgcgttatctgtgattcgctctagcttgaactccttgggcagcctttgtcccaatatttagggtccccaaaaatcacctacacgttgataaatgcggtggtgtcttttgcaaggttttaaatctcctgctatagctatacaactatcccaggagatagttgtttgaggatctagctatttgctcccatgtactataatttaacaactatccggaggatatgcgcggcggcctcacggctacaaagccggcaatgtcgcgactcacgttcatgtacacactgtcgatcggtttttagcatcggttgcacttcgatagttagctgcctcctgttggagtcaatgaactatttttgttgattctcccgtaagtaaatcgcagtgccagaaatcacagcaatgaaacatggaaccttattaagaaagccaaacatagaataagagatttctgtcggtttattaaagccgaaacgagcagcgaggtacaacttgtgcgacctcatgtagaggcatcacaagcacacatactgattgccacatcaaggacggaaggtgctatgcggtaagag

SEQ ID NO: 87724 - DNA, 1549 bp, Oryza sativa
ttacttcatgctgctcgtcgacgacctctcccgcttcatgtgggtaatggttctcggcagcaagggagaggttgcggacgccattaggcgcgcgcaggctgctgcggaggcggactgcggcggcgaattcacgggcggctgaattcgcatcgtactgcgctgatgagtgcattcagcaccactacttcgcgccgtacagcccgcagcagtacggcgtcgtcgagcggcacaaccagacggttgtagggatggctcgagcactcctcaagcagagggggatgccggccgttttctggggagaggcggtggtgacggctgtctacatcctcaaccgctcgactaccaaggcccgtacgaggcttggcatgggcgcaagccggcggtctcccacctgcagtttttcggttgcctcacgttcaccaaggagatcggccacatcggcaagctcgacgacaggagcaccccaggggtgttcatcggctaagcagagggctcgaaggcctaccgtattctcgacccagagacacagcgtatgcacacggcgtgcgacgtagtgttcgacgaaagacgagggtgggcataggacaaggcggtggacgacggctcgactccaacgtacgacttcactgttgagtacgtccacttcgagggagctgggggagtaggtagctcttattcactgagtgtgcctacctagcccccgagcctccaccgactccagcagcgacacgctctcgagctacgacttcggctgcaatgagttcttcgctgacaccatcacaaccggcgaccccacgcactccagcaccaacagccacccctccgggcacatccactccgacgccaggttgtgtcaagcacagcccggtggagttcgctactccgctctctcacgacgaggagcgcatcgacgcataccacgacagtgagccgctgcggtaccgtacgacgggagcctcagtctttcgcagaggccgagagacacgcagcatggcgtgccgtgatgtagtcggagatggacgcggttgaggaaaaccgcacctgggagcttgttaacctccctcgtggtcaccgcgcgatcacccttaagtgggtgttcaagctgaagagggatgaagccggagccatcgtcaagcacaaggctcgcttggtggcacgcggtttcgtgcagcaggaggggatgccttcgcccccgtggtgcgatccccggcaaggagggcaaggtgctcctccttgcgctggctgctcaggaaagctggtgcgttcatcacatgaacgtcaagtcagcgtttctgaacgacgacttgaaggaggaggtctacgtacaccagccgccaggatttgcgatccccgacaaggagggcaaggtgctactcctgcacatggctctctatggcttgtggcaggcaccgagggcgtggaataccaagttggattccacgctcaaggggatgggcttcgagcaaagcccgcacgaggtagccatcaaccggctgggcaatggaggaaatgtcctgctggtgggtgtctacgtcgacaacttggtaat

SEQ ID NO: 87725 - DNA, 1692 bp, Oryza sativa
cgaggagtcagtcaccagttgactagctgttcgattcggccatggccaccgagctcactgagtacttgctgctcctgccgcttctcgtcgtaccgctcctctacctcgcggcgtcgtcgtcgcggaggtcggggaggctgcggctgccgccggggccgtgggcgctgccggtgatcggccacctgcaccacctcgccctcgccggcgcgcccacgcaccgcgccatgcgcgacatggcgcggcgccacggcccgctcatgctgctccgcttctgcgagctccccgtggtggtggcctcctcgccggacgccgcccgcgagatcatgaggacgcacgacgtcgcgttcgcgtcgcggccgatcgggccgatgctgcggctcgtgttccagggcgccgagggcgtgatcttcgcgccctacggcgacgggtggaggcagctccgcaagatctgcaccgtcgagctcctcagccaccgccgcgtccactccttccgccccgtccgcgcggacgagctcggccgcctcctccgcgccgtggcggatcaggccgcgtcgtcgtcgtcctcgccggtgaacctcaccgggatgatctccgccttcgtcgcggactccacggtgcgcgccatcatcggcagccggagcaggcaccgcgacacgttcctgcggctagtggaggacgggctcaagatcatgccggggatgagcttgccggacctgttcccctcgtcgcgcctcgccatgctcctcagccgcgtgcccgacaagatcgagcgccgccgccgcggcatgatgggcttcatcgacaccatcatccaggaacaccaggagagcagagccgccgccgaagacgaggaccttctcgacgtgctcttgaggctccagaaagacatggactcccagtatcccctcaccaccatgaacatcaaatccatcttgatcgtaagctctcctccccgaactccggctacttccccctcgtcaaaaacgaaatcctcttcatgtaattcgctcgaatccaggacatgttcggcgcgggcagcgagacgtcagcgacgacgctgcagtgggcgatggcggagctgatgcgtaacccggcggtgatgcgccgggcgcaggacgaggtgcggcgagagctcgccgtcgccggcaacgacagggtaaccgaggacaccctcccgagcctccactacctccggctggtcatcaaggagacgctccggctccacccgccggcgccgctgctcctgccgcgggagtgcggcggcgcgtgcaaggtgttcggctacgacgtgccggccggcacgatggtgctcgtgaacgcgtgggcgatcggccgggacgcggcggcgtggggcgccgcggcggaggagttctcgccggagaggttcgagcggtgcgagagggacttcaggggggcggacttcgagctcatcccgttcggcgccgggaggaggatctgccccggcatggcgttcgggctggcgcacgtcgagctcgcgctcgccgcgctgctgttccacttcgactggaggctgccgggagggatggccgccggcgagatggacatgacggaggcggccgggatcacggtgcgccgccgttcggaccctactggtgttcgccgtgccccgtgtccccgtgccagcgcagtagacagctggtgtatcttatttaagccaatatgagtaatcgc

SEQ ID NO: 87726 - DNA, 1331 bp, Oryza sativa
aaacataaaattaaaaccgactcaaacatgatgacggaccgcggaaacatcttcaatttttataatagtagagataggtactaaaccagctcaataactgttacaccatcagttataaaatactcttattttttggaaagtttaacattgaatttttttactaataattaaattagtaacataggtttgacgtcatacatgtagcgttattagatccgtatttaaaaaatatttttatatgatgttaattccgcattagttgataatatattatgatataaataaacggtcaaattgtagaccatgtaaaaagctaatacgcctcgtatttgagaacaaagggattactagtctgtcagtttctttcaccacattcctaatatctgctgcatttttacatgaaaaattactttaagtgctttattgaattattactgatcaaacaaacgatatatatacgtttacacttattattgtttttctactgagctggccttggcactctcaaggcctcagccaggatgtagcagcatcagatggcatgatctgcagtgtcgccattatcaggagcagtgatgaagcaatcacttgatcaggatgcacctgattggtgagccctcggatccaaccagcctcagaggtaagcaatgcagcatgtagattccagccttgacatcgtctagcttcaggccttcgactaggatgatattctgaaagaacaaattcagcaaatcaaccaatggttacagccagtaatataatcttgcatgctagattcatcgtgctctaaatcacccattcatgaaggtgtaaacattctttgcagcaacatcaaaacagagtaaagcaagcactgtcccaaaacttgtcagtaagtaatgcagcaatggcatgctttcaaagttactccctccgttttataatgtactttctccgtttcacgatgtaagtcattctaccatttctcatattcatattgatgttaatgaatctaggcatatacatcaatttgaatgtgggaaatgctagaatgacttacattgtgaaatagagggagtaaaactttctagtattacctacattcatgtctatgctaatgaatttaggtatatatgtgtgtctagattcattagcatttatatgaatgtgcacaatgttagaaagtcttacattatgaaacggaggaagtaactatttagtcagtactcagctctgtaatgtttgtcaaggatttgttttgaagtagattaaagaagtgagaatgaccaatttacagatgtactgaaatagaacaaggatagcgtcgtaccgggaatttgaaaaagaccaca

SEQ ID NO: 87727 - DNA, 873 bp, Oryza sativa
ggcgttcgcgccgggggcggtgacggggccggtggtgcggctcagggactccatggcgaacgggacgctctacaacctgtcggagctcaagatggagtgccacatgggcacccacgtcgacgcgccgggccacatgaaccagggccacttcgccgccggcctcgacgtcgacaagctcgacctcgacctcctcaacggtacgccctcgccgccgccgccgccgccgccactttacttgttccccttcctgctcgcgcggcgacatggtcgaggttttgtgtggtgcacgtgatgccaccgatgccggctgcggtatccgtaaaggagattagtacagggggaatttgggataaatttggagatgaactcgaagacgagatggggaactatagataactattttgttctgctacctgcagcgctagatcagatcctctaccttaagtcacatgaatttattactaacatagtgacatgtgtgtccaataggtaattgttagtgacaaaggcacggtgacgactttaaaggtagatgatctcagtccgtacccaatacgtaatttgcacttacatatatatgtttttttttaaaaaagagaggcaaacttgctaaaatatgtttccacaaaaggtgtggagaaatactacgatttgtatagttcacaaataggataaatggtacttatagtacatatatcgctcaaaatatcaaatacttcctccgtttcacaatctaagtcattctagcatttccctgtctagattcattaacatcaatataaatgtgggaaatgctagaatgacttacattgtgaaacagagggagtacttctcaactttagtatgtgctaatacattaacatgttttacgta

SEQ ID NO: 87728 - DNA, 987 bp, Oryza sativa
ccctatggataatgataatagtattatctcccttaattttgataggacttattttattcaattttaacatcttcgacaccaaagctttaactttaattggttgcaaaatagtacaaccttaataactactccatctgttcacaaatacagataattttaagcccttttgacttgtccaaaaatattaatgagtttaaagtactttttgtcttatcaatcatttatttttcaatcgtatcaccaatcactttctggatctataatccctatattcgtgaacggatggaatataagacatattttaccaaaccccttttacctgagtgcacttaaaattttactactgttaatgtaaaaatctataaagttttacctttaataataaaattaaataaccttaactgatgaatgggggagcatatgaaaataaaaaaaaaggtatgcacactgaacaaagaaagtaattgataagatattgttttttacgtatatgggaaatcatgttttttccatgcatataggaactttttggtgctgggagcgagacatcagcaagtacacttcattgggcgatgactgagctcataatgaatccaaaagtgatgctgaaggcacaagatgagttaagtaacgtcatcaaaggaaagcaaacaatatctgaagatgacttagttgaactgaggtacttaaaacttgttatcaaagagaccttaaggttacatcctgtggtgccactacttctccctagggaatgtcgggagacatgtgaggtcatggggtacgatatccccataggtactactatgcttgttaacgtgtgggcaatcggtagagaccctaagtattgggaggacgctgagacatttagacccgagcgatttgaggatggacatatagactgtcaaggaacagattttgaattatacctgctggagctggccgaatgatgtgccctggcatgcattcgcagatgcaatcatggagctc

SEQ ID NO: 87729 - DNA, 605 bp, Oryza sativa
taggtaagatcctaagtattgggaggatgctgagacattcatacctgaacgatttgaggatggccatatagacttcaaaggaacaaactttgaatttataccgtttggagctggacgaaggatgtgccctggcatggcatttgcagaagtaatcatggagctcgctctagcctcattgctttaccactttgattgggagctccctgatggcatctcgccaaccaaggtggacatgatggaggagttgggtgctacaattcgaagaaagaacgatctttaccttattcctactgtccgtgtgcctttgtcaactgtcttatagttgtttacacttataaatagtatgtttgtctcgtatgtacgtgtctaaatgataagctatgtaacttttgatgatgtgtactcctacttcctatcctacctattataaattattatttaagtttaattctcaaattattcaatttatttttataatcaagtagaaaactcatgacaataattccatgaataatctgcttttcaattttgatcgatgactgtcacctcattacacatatatgtacttgcatgcacaatatctggtgtagactctgcgacgccat

SEQ ID NO: 87730 - DNA, 1869 bp, Oryza sativa
cttttttaccataagatactttatattcgttataaataaattttggtccatactaatacctgagatactaagactactaaggctgtgttcggatgtgaagttggaaactcacctcccacgcacgcaaaacggagtaccatattttcttataattaattaaatatttacttttaaaaagatagattaatatgattttttaaagcaactttcgtatataaaccttttgcagcacaccgtttagcattttaaaaagcgtgcacgtgaaacacgaggaaggtgagttgcgaaagttggggaagaacacagcctaaatggctgtcgatgacagcaaaattactctaaccgtatgtaatagtgtgtaaaacagattttgctgctcagatttaatgtatttatcgtggaaaattgtatgcatttctcgaacagcataatccagctagcttccagtttcaaaacacaaatctctatggtagtatggttccatcgaggtcatcacagagctagaatgtcttaagaatgaaacttgtcgatgcaccaacttttttctgactcatttaatactgaagtttctagtcttaaaactttcccctattatatgaaatcatattgtaacccattttatttatctacacgaagtgcctctctctctctctctcaacaaaactacggaagtttgaccttacaacacacggaggatgggggcggaggtgaaggtcattcttcctccggacggtgatgcccatctcctctgtcatatccagctcgctcgctgccattccattagggagttcccagtcaaagtggtagagcagcgcagcaagcagaagttccatgattgcttctgcgaatgccataccaggacatattcttcgtcctgcgccaaacggtatgaactcgaggtctatgcccttgaagtcaacagtactgtgttcaaaccgttctggtctaaactcctcagcgtcatcccagtactttgggtctctgccgatagcccacgcgttaacaaatacagtggtgccttttggaacatcataccccatgactttacatgattcacgacactctcttgcgacaagcagtggtaccacagggtgaagccttagggtctccttaataatgagctttacatactttaagccagacaaatcatcctctgtcacagttggctttctcctaagtttgtcacgtagctcggcttgtgtcttttgcataaccattgggttctttattagctccgacatcgcccattgaagcgtagtcgccgatgtctcgctacctccactaaagagatcctataaaaagttaaaagatcgaatgaaaaatactacaaagatttgagagctgtaccatctaattgagcaaatataatccaccatgatagcacatactctctccgtcctaaaataaatcaatctcatacgagatatgatatattatagtacacttaatctgaacctgttactctgggatgaagagagtagatatattttactttgcttttaatacgacaggtgtcaattttacttacaaggataacagctttgatttgttccatggtgagaggcgtctcgagctccccttgtttctgtatgttcaggagcacgtctatgaggtcttggttcttgtcgtcctcgacgccggcgccgccgtctaccacggcggcctccgcccgctgctgctggtgctgccggatggcgcagtccatgagctcgtagagcttcctgctgttcgcctccgctcgccgcgccctgccgccgatggcgctcgccagccacgacgacgggaacaggtcgtcgaggctgaacccgccgaggagcttcatctgctcggtgagctcctgcaagaactcgtcgcgccgctcgaacctgt

SEQ ID NO: 87731 - DNA, 2051 bp, Oryza sativa
cgacggggtgaagctgccgcctggcccgtggcggctgccggtgatcgggagcatgcaccacctgatgggcgagagcctcgtccaccgcgccatggccgacctcgcgcgccggctcgacgcgccgctcatgtacctcaagctcggggaggtccccgtcgtgttggcctcgtcgccgtgcgccgcccgcgagatcatgcgggcgcacgacgtcgcgttcgcgagccggccgctgagccccaccgtgcggcggatgcgccccccccccccccggcgacggcagctccgcaagatctgcgtcgtcgagctgctcagcgcgcgccgcgtccggacgttccgccgcgtcagggaggaggaggtggcccgcctcgtgggcgcgctcgtgtgtttggcccatgtggcccagaagtggttgtatagtggtggtttagtaccaccttgaaagtttaggtgggttaggatctgcttataagccttggtgctgcgccatgattggggccaggttcgagaggcgcgacgagttcttggagggggctcgccgagcaggtgaagtgttgttggcccaaccgggaaaaagcctgatgaaaattcaaattcaaattaagtacaaattaaaatccatgtgctaccatggtagattatacatgcttagttactctactactccctctgttttatattataagtcgtttgattttttttccagccaaactttgttatgtttgactaaatttatagaaaaatttaacaacatctaaaatactagattagtttcattaaatctaacattgaatatattttgataatatgtttattttgtgttaaaaatactattatatttttctataaacatcatcaaattaagtacaaattaaaatccatgtgctaccatggtagattatacatgcttagctactctactactccctctgttttatattataagtcgtttgattttttttctagccaaactttgttatgtttgactaaatttatagaaaaatttaacaacatctaaaatactagattagtttcattaaatctaacattgaatatattttgataatatgtttattttgtgttaaaaatactattatatttttctataaacttgatcaaagttaaagaagtttggctagaaaaaaaaagtccaacgatttacagtatggaactaagggagtagtagttagtagatggtacatctgatgttaatctcaatttttttcttgtttttttctcctaggatctctttagtggagggagtgagacatctgcaaccgtgatccaatgggccatgtcggagctcatgaagaatccaagggttatgcgaaaggtacaggctgagttgcgtgacaaactagcagggaagccaagggtgacagaggatgatttgtccgacctaaagtacttaaagctcgttattaaggagaccttaaggcttcaccctgcagcgcccttgcttgtcccgagacaatgccgtgagccgtgcaagatcatgggatatgatattccaaaaggtaccaccgtatttgttaatgcgtggctattggcagggatcctaattattgggatgatgctgaggtgtttaggctagagcggttcgcaaatagtaccatagacttcaaaggcatggacatggagttcataccattcggggcgggaaggaggatgtgctctggtctagcctttgcggaagctattatagatctactgttttctaccctgctcttccacttcgactgggagctcccttgcggaatgacagcaagtgagctggacatgatagaggagatggcccttactgttcggaggaagaacgaccttcacctccgccccatcctccgtgtgccgcaaactcaaacttcttctgcacttctattttgtgagagagctcaaacttcttctgtatttctgttttgaaagagagttcaaacttctgtttgttttgagagagtacttttgtttattttgttttgagagagagagagagcgcgcgcgctcaaacttcgtttgcacttttgttttgagagggggaatgcgcactttatttcggt

SEQ ID NO: 87732 - DNA, 668 bp, Oryza sativa
ttttggatcacaaatttatcattttttttctaggatttcagcagatgcaatatatcatgtaaacagtaagaggcatatcaacatcgatgtctcctttcgcacttggagcagagcaatccaacagcaaacagggcgatgagacccaaagcaaaagaaatgaaaacgctaacaatttcagctgaatcttcacagcaactatctaaatgttgcaaaactgcaatatgatatacatttctgggttctgaagctatgcttggtgagcaacatctattccagcctcggtaatgagctgttctgtcaacgaaaagagcccggcaatttccttttcagcatcaagaatcatatccatttccttgtttggtttggtcttggaaacaattctagtactgtttacacttggcgatgcaaccagattgatgccagaatcagttttgccacttctcaggaatcccttagccatatctgcaagtttcttcaatgtagtagtagcagcaagtgcctccacctccgcagcttcagtttgaagattttggagccccatatgaacggaaaaatcagaaggtctcttgatgtcactaggatctttcaggaacccttccaacttgtctacctcctccttcacatcccaccttctcattaccgccttcagctcttgatctttcgcgtca

SEQ ID NO: 87733 - DNA, 662 bp, Oryza sativa
gtgcagccctgttagggagctcccagtcgaagtggtagagcagagtggcgagcatgaactctatgctggcctgggctaatgccaagccagggcagatcctacgtccagccccaaatggtgtgaactcatagtttgtacccttgaggtcgatctcaccatcctcaaaccgctccggtttgaaagtctcggcatcatcccaatgcttggggtccctcattatcgcccacgagtttataaatatgacactaccttggggcacatcataccccatgatctggcaagtttgctggcactcccttgggatgagcaacggcaacaccgggtgtagcctatgagtctccttgacaatcattttcagatactttaggttggctacgtcggcttcggtcaccgatggcttccctttgaggatgctttgaacctcgttttgtgctttctccatcactcttgggtttctcatcagctctgacattgcccattggagcgcatccgaggatgtctcgcttccagcaccaaagagatcctgtacaatgccaaaatgcaacacatgtgaaactttaaccagataaacaactaaggaaaatacatatgctacatcaagttaattgaacactatctgcagaacatatatatatatatatatactctgaactttttctgaa

SEQ ID NO: 87734 - DNA, 533 bp, Oryza sativa
aggaaggagcaaaggcgctggcagatgcaacctcagcgtctctttgataatgagctttaggtaatttaggtcggtcaagtcttcctcggtcacctttggcttcccttggagattgtcgcgtaactcagcttgcgctctcttcatcactcttgggttcctcatgagctccgacatggcccattggattgtagtcgctgatgtctcacttccggcgctaaaaaggtcctatgaaatttcaaaattattaacttaaattgaacatgccagaaattaaatgaattagaacgtacgaaaaggatttggaaagaaaattagaaaaaaacatttggttggaatttggaaatgatgttgtgcttgcttacaaggattactgctttgatgatccccatggtgagaggcacgtcgaggccacctcccttctgaatcctcaagatgacgtccaccagatcgtcgtcttccacgacgtcgccgctcgccgacaatgccgccgcgcgccgttcctggtgctgctcgatggcgcggtccatgagctc

SEQ ID NO: 87735 - DNA, 802 bp, Oryza sativa
cggctgctgcataagggaacacggtccacatgccctggtttcaaagcaaagcataatttgattagaaaaggtaaacaaagattttactctcaatttttcaggagaggggaggagatttaccacagctgccgcaacacttgcgagtgcaacaacaggccgttctctcaggaaaaacccaacagctagctgcaatgagacatcattagtgtcagctgtcgtaaatacagattgaagaattcttattcatgtatttaattcgattgatctgtaagatgtttgaatataacaatggtgtcagcctacagattaacaaggataaacattgtattgtaagacaaaacatttttttagttgccacaactgcattggaggaacatagaaataatttgcagattgattctatctagtaaaggtgaagataaaatcagcaacaatatggccaaagttccctgccagcaattaccacccaggaggccaggacagaattgaacataaaaggtaacaaaaaaaaaacaactacataggagtatatcctaaaattatagccatcacgccaagtagtaagtctctataaagttagatcaaacgtcctgagcaagtgacaactcagtaacttcagaagtaacagaaaattaaaatccaaattacctggataggaagagtaaatagacaaccacagcaaactccagcaaaatacagtctgtggtatgccctgtttgtaatcgtcagttaaaatatcgggtttatcagaaatttctgacagaatcactgtgagtgaagcctgggaaaatgactaaccaat

SEQ ID NO: 87736 - DNA, 646 bp, Oryza sativa
ctcggaagagggagtaaaagtaaacttcctttgttttgttaggccgaggaggaaggctggccaatgggccaagtccacgagccagggagagagggggagggggacggctgaccgactgactgggcaggggcgggcccggtcaacgccacgtgggcagccacgtcggatggggagagaaaagaggggggggcgggaatggcatcggacggctcacggcgcgcggcggaaatccggcgaacagcggcaagccgaagcgagcgacgaacaccggtggctagaggaggtcaaggagaaccgattccatggctcggattggggagacgacgcgtgacgacggccggcggcggcggcgaagctcgccgggatgccgacgtggatgcgcgatgggaagggatgcggctcacgcgctcgggcttagtggacgcggtatggggttgcggcgcacacgcggtgacgcgggacccgatggtcgccgggctgtggctcgcggcggcgccttgcggcggcgggaggggcggcacggcgcgggagcgaggaggaaggtcggcggccagggggaggggttggggaggtcgagggggggcccgaggaaggtggcggcgccgggaatcaaggagaggaaggaggccgacggcaggggaggcac

SEQ ID NO: 87737 - DNA, 648 bp, Oryza sativa
tttagggttttttttttataaaacctttttaactttgtttatttcttaacaattattatttgtgctctgaaaattccactaaaatttatttacacattttaggcttttaggaaatttataaagccttatttgacttttactttgcacattttaatttttggaggctttcacatggattttaattattctaggcataatttaaaggatgtattttagagtcgttttgggacgtgacaaacctacccccccttaaacggaatctcgaccccgagattctgaagaactggcgaagagatcgggatgggctgccttcagctcgtcttcacgttcccaagtagcttcttcctcggcgtgattgctccattgaaccttgcaaaaacggatgacccggttcctagtcctgcgctccatgctgtccagaatcttcattggcttctctacataggtcaagtcttcgcgaacttcaatttgctctgaatcggcctgctcggacggcactcgaagacatttcttgagttgcgacacatggaacacatcatgcacgttgcccaataaggagggcagctccaactggtaagctacttctccgcgtcgagcaatgatgcggaaaggatccacaaacctaggtgcgagcttcccttttgtcct

SEQ ID NO: 87738 - DNA, 766 bp, Oryza sativa
gccggtcggtgaagacgtagacgcccaacaactgcagcataataggccagccgtgcaggcggagacaccagtcggcggcgggcgaggcggccggtcggtgaagacgtagacgcgcaacaacggcggcataataggccagccgtgcaggcggagacaccagtcggcggcgggcgaggcggccggtcggtgaagacgtagacgcccaacaacggcggcataataggccagccgtgcaggcggagacaccagtcggcggcgggcgaggcggccggtcggtgaagacgtagacgcccaacaacggcggcataataggccagccgtgcaggcggaggcaccagtcggcggcgggcgaggcggccggtcggtgaagacgtagacgcccaacaacggcggcataataggccagccgtgcaggcggaaacaccagtcggcggcggcgaaggcaagccggtcggtgaagacgtagacgcccaacaacggcagcataataggccagccgtgcaggcggaagcaccagtcggcggcgggcgaggcggccggtcggtgaagacgtagacgcccaacaacggcggcataataggccagccgtgcaggcggaagcaccagtcggcggcggccgaggcaagccggtcggtgaagacgtatacgcccaacaacggcggcataaaggccagccgtgcaggcggaaacaccaatcggcggcggccaaagcaggccggtcggtgaagacgtagacgcccaacaacggcggcataataggccagcc

SEQ ID NO: 87739 - DNA, 551 bp, Oryza sativa
gcacgtattctgagacggtccaatttcaagttttacacagcatgtcttggaagtacaagaagacctactcttcaaatagggggagaacagattccccagatcaccgacttcttccatcacctccttacgcgtggtactagccgccccctgatccaagatctcgcgcagatcgagttcaggacgcgatagctttacgcacgcaaggacataacacgccccagtgtagatcccgttcgatgtctcctctgcgaccctggccgcatgcttggaggggatctccgtcatcgccgtcaatagtaccgcaagggaggaggtcagcgaaaattcgtcaggattcaccgggatggtagacttgatgccgcactccccggcaagctggtgcaggccagtgtaggtgacccgcaacgagccctgaatttccgacaggttgtgcccgagttccgacatgcggttctcgagcccctaccgttgtcgctcgttgccggccaccagttccctcatcttcgtgaggtcttcatgagcttccgccaactcgcgcaccaaccggtcag

SEQ ID NO: 87740 - DNA, 3511 bp, Oryza sativa
actatagggcgaattcgagctcggtacccccaaaagttggctgaccaatttcattaagattgggaagaaaatacagtgtgaaaggttacaacgacattagtacaatgtcgtggcggctagagaacccggatcatctatcccaccatcttgtgcagttagccagaagatctctaggcgtttctccgtattaattaagctcacatatatcacactaaaaaattgtcaaaaaataaatcagtatatcttgtaaaaattgtaaagctatagatcaatatatgatatatatctttttcacaaatatacaagttaaaattcaatctatataagtagaaacaaaaatatcacatttgtgaactacacattctatttatagttaaatttgtcaattttttctacttgtataagttgaatttgaacatgtatgtttgtgaagtaacatatcacatattaatctatcttactccctccgtcctataatataaaaagttttagggttgtacacggttattaagaaagtaggtagaagaaagtggtggaggattgtgactggataagtagtggagatatgtggaaaaagcgaatggtggagggttgtgattgattgggaataaaagttgttatattttgggacaaatcctgagggctaaaagttgttatatttttggacggagggagtactatattttataaaatatttttgatgacttttaagtgatataaaaaatagtaaatttcacaaaactagagttattttgatcaaactatcgcaaaactacagttttaagacgtatcacaaaacaacagatttagcaccatatttgtcacaaaacaacatatttaaggttaagtatcaaaaaatacatatttaatattgaaattatcacaaaactacagcttttagagtttaaatccctagcaccattattatgttaagcataaacattattgttttgtaactaaattggttctaaacctatagttttgtgatattttagttactaaacatatagttttgtgaaacttcatcttaaatgtgtagttttgtgataaatttggtgttaaatgtgtagttttgtgatacaccgagtaaaatttgtagttttatgatagtttagtcatagtatatgtagttttgtgaaatttactctaaaaataagaggatatgtatagttagctagataggagtacatgtgagtcagtacgtgcatgcttttgcgtggcccatgcgcatcacatgcaaatcaataagctagtttcttagttaagtaagtaatcttgcttgcttagtctatcctataattcaccaactcactgttacatctatattactcattcatcagatctaacggacgaaaatcatccaccgctttagatccaatgaaccatacctccctcacctcccaccgtgcaccgcaccatcccacctcctaccgcacaccgctcccatcccacggaaatcgcatccgccatcatcgccgcaccctcgctctccccgcgtcgcgccgacccccaatcccaaaccccggagcagctccacctgcgccaccgctggatcgatgggaaagaaccgcggaccgccgtgcttgcactagcatccagatcagcgccgcctcatcgatctcctcatgtgccaccgctcacgattcgccgtcgtcgctcacaaattgtcgttgtcacgaaatcgcaaccctaatctccccacaccgcgccaccgcccctcgcctctccaccgcgctggtctcctctgcgtgcgtcgtcgcctctccaccgcgctgatctcctctacgactccctcaccctccgtcgacatcaccgccgccacccacctctccaccgcatcatcgtcctcaccgccaccctacggttcaccgcaccgccatccactacgccaccctccgctcgtcgcgccgcccacatccacgggagactgcccgttaatttgcgtacctcaactttttttaccacttaattcgcatgccctctataatatatcattaggactgctaattagtttatttggtaccactttctctgtttttcatgtattacttatttcttaattccatatgtatatctttatggacatttttgcccttgggcctaggggtgaaaactatcggaaacggtcagaatcggtagcatctctttggaaacgatgctcgatcggccggtaattgaccatatttatcatttaaactactcggtatcgacattaatacgatggagaaagaaattagaaaaaacaaaatttaaaaatagccaaaaaggtacggtcggaaacggtaccccttaaacgaaaatggcgcccggtcgatcgggaatttccttgaccgttttcacccctacttgggcccacctgtcagattcaaagagagaaatctctctctggatcgaatcgatcgatccctcctccagggtgagcgcagagcgccaccagccaccagcgacgccaccaccccgctgccgcgcgccgtcaccaagcgccgacgccgtcccagccgccagggtgccccaccacccccgccgcccgaggtcgacacccccactgcctccaccgccgagcaccacccccaccaccagcatccaccggcatcgttgcccctgagcggcaccatcccaccaccacgccgaggagaaagacgggcgcgccggcactgccggcactggatgagcagtccccaatagcatgtatcaacttttgcatatttcagcttgatgtcatgtagaaaatgcaagccctgtatgagatgggggctgctataaagtttcagacatttttgcaaattgttgtcggctgtggggtggtggcggttggcggcggggtggtggcgcccggcgtcgcggtgctcggcgacggtgggaagcgaacgaatgctgatccaaagagagatatttctctcttctctctttggatctgacaggtggggccaggggcagaaatgtccatgaacaggtaagaaacaaaaataagtaatgaaagcagtgaaagtggtactaaatataacagttaacagtggagacgactacggagggaaaaaaaatcggacgctgatgtcagcatgatgcatacatgcaaaaacactttaaactattttttctcttaaattatttatccaaatcatgatccgattgcaccattaaattcgttgtaattaaatctttaaagcaagaccacacatggatatattccgacggaattttttttagcttattattgaattatttttaaatgttgcacgatgttccactaattatatcggaattgtttcactatttagatcgaaaatatttcaatcgtttgaatcggacattgtttcaccttatataaaaacaatgtttcagcaagtagcgaaagaatgtttcagttcactgcaacatttgatactataagtacactaggtgaaacatttttcgtggaacaaaaaatgaaacgaattcccttaatagaaggtttccaaaatattgttgatgtgaaaacacgaggcctggaagatctgcttaacttcagtgc

SEQ ID NO: 87741 - DNA, 581 bp, Oryza sativa
aatccgagacgaactcgaatccaactctttccaaagcgatttagccaaagattccaaaggagaaaaggtagaggagatcccggagattgtttcccctctattgattcggccggagaaggaaaggaacggccggatttggaagggaaacagcggcggcgcgaaactagggtttcgggcgccggcgcccgaaggtagacgacgactgacaggtgggccccacctgtcagcgacagcgagggcgcgcgcggctgcggcggactgggccggctgggccgaggagagagagaagagaggttttgggccgactttcggcccaaagccaaaagaagactttttaaaacctttttcaattaaaattatttcttaaatgcaattccatttattaaaaatactttcttagctcaaataaatcccagaaaaatctaggaattatagaattaagcaaagtatttaaggaaattttatctgggcccattttatattggaatttattaattaaaaaattagatcttcttttcaagatttttaaaaataaattctagaaattccaattaaacagggtaccgagctcgaattcgccc

SEQ ID NO: 87742 - DNA, 670 bp, Oryza sativa
cacggctggcctattatgccgccgttgttgcgcgtatacgtcttcaccgaccggccgcctcgcccgccgccgactggtgtctccgcctgcacggctggcctattatgccgccgttgttgggcgtctacgtcttcaccgaccggctgcctcgcccgccgccgactggtgtctccgcctgcacggctggcctattatgccgccgttgttgggcgtctacgtcttcaccgaccggccgcctcgcccgccgccgactggtgtctccgcctgcacggctggcctattatgccgccgttgttgcgcgtctacgtcttcaccgaccggccgcctcgcccgccgccgactggtgtctccgcctgcacggctggcctattatgctgccgttgttgggcgtctacgtcttcaccgaccggcttgccttcgccgccgccgactggtgcttccgcctgcacggctggcctattatgccgccgttgttgggcgtctacgtcttcaccgaacggccgcctcgtccgccgccgactggtgcttccgcctgcacggctggcctattatgccgccgttgttgggcgtctacgtcttcacggatccgctagcctcgacctccaggactggtgtctccgcctgcacggctggcctattatgccgccgttgttgggcgtctacgtcttca

SEQ ID NO: 87743 - DNA, 667 bp, Oryza sativa
ccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataatcaaccagccgtgtaggcggagacaccactcggcggcgacggaggcaggccggcggtgaagtcgtagacgcccaacagcggcggcataataggccagccgtgtaggcggaggcaccactcggcggcgacggaggcaggccggcggtgaagtcgtagatgcccatcaacgggggtgtgataagccgaccgtataggcggagacaccaatcggcggcgacggaggcaggccggggtggaagtcgtagacgcccaacagcggcggcataaaagccagccgtgtaggcggaggcaccaatcggcggcgacggatgcagg

SEQ ID NO: 87744 - DNA, 650 bp, Oryza sativa
tggtgtcttcgcctatatggttggtgggtcacaccaccgttgttgggcgtatacgtcttcaccgaccggcccgtctcgtccgccgccgattggtgtttacgcctgcacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgtcttcgcctatatggttggttggtcacaccaccgttgttgggcgtctacatcttcaccgaccggccgtctcgtccgccgccgactggtgtttccgcctgcacggctggcctattatgccgccgctgttgggcgtctacgacttcaccgccggcctgcctccgtcgccgccgactggtgtcttcgcctatatggttggtt

SEQ ID NO: 87745 - DNA, 689 bp, Oryza sativa
aaatccctaaaaaaggacagcatccagacacagtaagatcaagcattaatacttgaggcacttgccatatacagaaccaaagatttggcatatgagcgaatcagaacgtttttttagaaataaaatgatatactacgttcacggaatgtgatattgccaactcctcgtgatgtgtgaggatgaacagcataccttgctgatcatagtcaatgcaacaataatctgttgaagacctatagctcttggagatgattcttcaagtccttgtgctttggcatccataacaagtgactcgatctggattgattttcaccgatgaatgtaagattcttaaacccataggacctaaggccagcataaacagggggagaaagagatcgatgatcacctgttgacagagaggattaagtaaagctgtcaagcactgaacctgcttatctggtgacacctcttcaatgccgatcaacagtcccacagcctaaaatcataacaagcgtcattgatccaagattagtgttcccagtgtaaaacaacagctagacaaaggtgagaacattgtacctcgaatatttggctgccatcctctgagctggagaacttaatatctttgtttgcccagtccgtagcagtgaattgcactagggcatcttgcaagctctgttaactcatagacacacataactcagatc

SEQ ID NO: 87746 - DNA, 4951 bp, Oryza sativa
  unsure (1)..(4951): unsure at all n locations
acacaatagtgagcatcttactttgtcaaggggtatatcctttatatgctgcaccttaagttcaatcgagatctctctcatgtcagccaagtaacctttagctgtaaccatatctgggaacttgccttggtatttcccagatatacataaaggactttttgctgaaatgtctggaatgtattcagaatcgatctgaattggaggaaaggaacagtcagaagacaataaaactactgtttttttctagctactactagttacacctgcaaaaagcatacccacaaaccacccttccatacagcaaataattatttctatatacaggacaggctctttgctaggaagagcagtataagatggtatggcagcaatgaacacagcacacatacactaccagagaaaatgagttgggaaatcacaaatcaaatactgaaaaagagtcaatttcattatgaaacatgatcgcaatgcagccagaaccaccttgatggcattactcgtcttacatatccatctctacataaccaaatttacaatattgagtagttagtgatgaattaactcacttcaaattcatcaagatgtgctgtagcatcaatggagatgtttgcaactattgtactcgatgctttcctgaaccacctaagtacctgactctcaattgatcctgcaaaaacaattcaccaaaaaaaaaaggtttatgaagatgttacatggacttcataaaagtcatatttgtccaattaatgcatataatagaacagtattgcttagatatgaacttcaggaataaatccagatcaataacaataatgtattggtagaatgcccatgaaacttgagcagaggttgcaagatggagtgtcaacttaaacagcatgcagggatcataaagaaacagtgttacgtggaaaattgcaaaccaagagtacaactagctcttagattgcagagcaagaggatcccttcatagaaaacattattgccacctctaacaatatgaactgattgcagtttggtttttctattataatttggttgagataacagtatatatcgtgtgtctcaggaaaagctaagaaatccatggagaaagggtagactgtgtagatcattgttctaaccttcaagtttaaagaccaacataaaggtaagagcatactgtttgctatgatgagaacaaaagggtatangggcttggtacctgtctcaaatgcagcataataatgccccctgcctattgatgccagcatgcgcaagaaatagtggttgcaatacaaacctgttattccagtgataaaatgaaaagagcaaaaagaatatatcaggtaaactgtaagcaatcagtaacgaagtagtacaaaactaaaacagcagagtaattaaaatatggttcgtctcatcacaagctggcagcatatatcaccacactgactggtctgttgacttatggtgtaagcatttttctcttacacaagaaaggatatttggagatagagaaatacatgagcgttggtgcaaaaagtagggaggagaattttcatgtgatccaggagataagtcaagagttttgaataatgagataattgtatatttgacgctctccttaacattacctagtccaaaagtagaaatccgaggagatttagatcctctgctgatgagctccgttttcacagtttggcatatattatgttcatcatcaactgatccatcagtcataagaaagatttgtggaagcacatcatgagcacttgacaatgatgccattgcctttcatgaaaaaaaaaagtgagagtattaacagtaatagaataaaaaataatactacatatgcatctattcacaatcgagatttaatattcaataatacctcattcaaaggatgcataatatctgtaccaccaccagcaacaaagtttaagtttatccagtcaagtgcacttgctattgatttctcatttactttctccaaacacgatgagaatgagtgcagctcatcattaaatgttataatgttgaagtaatctccttctgtgagttctgacagagcagtagacatcgcattcttcacattctcaagcggatgtccttgcatgcttccacttgtatcaatgacaaacacaactgcttttctgaagacctattgaattgctcaggtgagatataggaacaaggagagagattttgtgaaacacagaagaaggaaaaagggaatgtacttctgtgtcaataaaccaaaagtgctatgaacaaggccacctcagtaacatccttatttactataactttaatgatttacaatcgcaaaatatcctgatagtatttgctaaaagaagtccagattgtagtttgcacatagctagtggaatttcactagaaaaagatcaccaaatggcagtttagaatggtgggtttgttgattggttctataaaaaagtagttctacattagcttcatcagaaaggtttctgctagaggccctcttctaaatataaaagttttgtcaactgcagatatctcactcaaggaagatatgcttaaataaataaaaataaaaactatgggacgaaaccccgcaaaagtaagagcaactaacctttctgttgccacctccaggtaaaagaaatatgcagaacctatctctatcatcataatcacgcaatgtcgatggttgaacaagcacaccaccagataagtcaccagaataacctataggaatgaacataaatcagacaaatctgaacatatatttagctattgcagttttgaaacagtaaacagttctcgagccagatttcagttacatctgcaactaacatatgctcacaaaaaaagaaaaatttgagaagtcttggaaagtcagattatcacaggaactagtgagctcataactacttaaagaagtgactaccgattacagctaataaagagatcacaaaagggaaactcacactgtatgaaaaattgaaatctttgcttgaccaattctcaacagttgcttcatgccggaaagacaacttctcaccctgcctacctttttcctgaaatagtaagggaaactcttttgaagattaaatgttgtaaaagcactgatgccaattgcccggaaatcaaaagagttctagcaaaaaaaaatgattaccttcaatgggtggcttgttccctgcagtaaaacctctttactgaaaccactattcacagtcaactgaattttctcccttttcatgaatacttttggcaatgggttaacataatatggaaaacggaacggtatgtccactgagaatcgtccattgtcatagtgtagcttctgagaccatctgattgtggcagaaatatccgccccaccctcaatctttatcggcaagatggcaatgaatcttcaaagtaagactccaattccaaaagttcaaagaagagaacaaaagacagttctgcatttagcatgtacctgtgatattgtcaaataaaataattggggtttcaagagtccgccactatcagcttttggagcattctctgtagtgtgatcttctacttcaattacttgagtattatatgatcttcttccaacggtaacctcggctcctagaattgaaccctattagccaaaccgttcataggttgagaacaagacaaacatggaaattaatgcaactcatataacataattaaacataatatactagtagatgcctaatgttcatttaatggtgatgtttcctacggatggaaagtagaatcagatgtttcaaaatatcaaatattagtgtatgtgagttatttattacaaatttccaagttgttgttaatcaacttcgctaggcaagataacaaccacccaacaccaatgaataatatgctatagtcatccaagacaaataacttcaccaccgaattatctccattctgcaagccattatattctacaaccagacataaaaggagcaatggagcatcatgtgtacttctagatgctgaagtaaagaacaagctatacaatatgtttccaaatgacacgaagcaacatatttcagtacacatcaacatatttcttcttcctagctgcctcatttttgatacacaagccaggttaccactctgctaaaccagcacattccttcttgtgtttgatttccataggacaaagcaaggaattactttcacttgcttatgccactttttactgaaaattgctcttgtaatataaccaaaggcatccatttagtcagctggaattcataaactagttataaagaaagtacagaatttagtgcagagcacgccatgatttgcggtcaaccacctcaagacaactcaatcaaacgaaccatatgaacaaaaaaaaaaaagagaacatattccacttggacaaacactgggttaagcaaacacctgaataatgttgccaccaaccattccaacagcacagtcaacaataaggtacaaaaccaacaaagcatccatgtgaagaaaacaatagaactaacggctcaatggagaatcaaaactgcaaatcgagaggcacatatacatgccgcaaaaacaaatccaacaaattcatggttcccaactatgtaataacactagccaaacagccggaatcatacatagcacagcaccaatcatttcgaacctcaccaaaccaaatctacgaggcaggagaagggaacaacacagctacactagggggtaaaacaaaaaaaatcgccaaaatgtgatccgatcgagatttacctggtcgcccatgggcacgacgatgcggacgtcgcagtcgcggctgcgggtgatgcagtgcagccaccaccgcgcgcggacggtgacagcggcctcgccgagcgcgcagtcgacggacaggtcgacctccttcatctggagcgggatcagcgcgggggggtcgaggcggccgtacacgtatggctggtagctgggcacgtcgggggtgtcg

SEQ ID NO: 87747 - DNA, 534 bp, Oryza sativa
acggtgtcccggatggtgcggaagtgcaaggcaatgatggcggaggcggcggtgctgccggcggaggcggcgcccgaggcgctcgccgcggcggcggagcacgggatattccggaacaccgtggcggcgctgctcaccatggaggacgtgcggcgcggcagctccacccacgggcgccactcgctgccgccgctcaccctgccggactccgactggctccgctccttccagccgccgtcccccatccccatccaatgaccaccgcctcttcgtcctcgtcggccgcggcggaggctttgccgggaaattctgcgctgcgaaatctgtaattaaatttgcttaattatcttcttgatcttttttctttttctttttttttttgctgcttcttaaataggagcggctaaataatgtaaaaatgcgagttaacatacatacagacgaattcatacgtgttttggctttcaaatattcaaatgtaatacgaattttcctcttgttttcgaatgttattgggttaggggcagtttgaca

SEQ ID NO: 87748 - DNA, 2486 bp, Oryza sativa
actaattagactgaagaaaagagcagataacattgcctacagtgctcctacggtgcagtttctactttgctacgactgctgtgcaatggcttacgactagccaggagagatcatatcaaactagaacaactttcatcaattggaaatcgaaaagccaattcgctaattataaagcggcatatatcatgcgaacttatagataaatatatgattgcaggcttccaaattaaacaagatctgatactccttctagtggccatactgaatgaacaacaatacttgcgcagataattagggatagacattgagtaccttcttcacggcctcgcaggcattctcattatggcgaatatcgttaccccgagcaatcatagtgtggacgtgatcgagatacccctcccagtgtgattcatcagccagagtacccagtccgtccaactcttcttggctgtagtccgcgagttcgttaggggctaaaggggcaagtaaagagcttcgcgttccgcgctcggcgttgaacttgtaagggccttgacaaccttcttgaaattctcataccgatgagccttctcctcctcggttctgtatctccggccgtgctcgctcatccccagtcctcaaattttgccttcatggtcacctcatccaccacattgtcctcctcggcggcatcatcgacgaccgcctcctccttgtcggaacacttcttgtcatagagtggtttccccccatggttcatttgggagttgaggtaatccgtgtagtcaagataggcaaatgtgccatctttcctggtgaaccttgccatgacggatggctcgatcacgtccctccaattaacagtcacctcctcctcctccttcctggtctcctccccggctgctacaggtaggaaacaaattgaagctagcaacgacgaggaaccgaatctaatctaatctaatggcgctttctttcaagaacaaggcatagatagatacctgagtcatctctatcttgcttgaaatagaggaatccgagcagcaatccagccaacgaactcgtcaaggcaagaacacctttcactgcgccacggccgacgccgagatccctctgcgcggagatggacgggagcgtgagccgctgcgcgcgagtgaagaaaattttgatctgagatctgggggaaacgggagagcgtggtgctggactactccccgccgtcgccgccgccgccgatcgctgcgcctgcgcgctgcgtgcggagaacctccgggtgaggaggggagcaagggcccggaggaacatggacatggcctcgatcgatcgatggaatcgctcacctccgccgcgcgtcgccgcgatttctagggtttagtgtttgacggacttcgccgcggatgcgcacggtgtcgaacggaattccgacaaaatccgatcaaattttgtcacagtttaaaactcgatcagtttgaactttgaagaggtcgcatgggccttgcgcacgcgcaaaattgggggccgggccaagctctaggggttacaaccatccttatttgatgggccaatatgggcttctaccttttgtctgactgccaactaaatgatattgggccgagatgttctcctactagaggcagcccaacagatttatctcgaccgaacaaattcgatccgacggttgaacagatttatctcgtccgctgttacattgttttttttaatggaaaaacctgtcacattgttcagctcatttggatattacatggaaattttctggcagtgatgagtacaatcatgtaatcaactgcactaattgttcttgagagtcattatctttgattacagcttcttgactttagtatcagtaacttatttatcaaaaagaatgagtaacagtaacaggtaacactgtgttgcagtatctctacaccgacaaaatagaagagaagagctcatcatcaaggggacaacactgggggacaaagacaaattccatctcgctccatttccccaggtattccatagcgattagcagctgatgcatcctcccaagaggggtgtgcttaaggagcttacgtccttctaatggtctttgttgatctgtttctcctttcagccagttcttgtattgtgtgggagagcatgctgatatatttcgcgtgcatcaggcatttagagtatcgagctcggtacctattccttctaatataagtacagtgaagcatactctttccggtgttccatttagttcatgtctatgctccataatgtccttgatccgtcttcaccataaggttctatgctcacagtgagcatgaacagcgatattcgactgtcgattataatactgtggtagtgctggctcccctgcttttcgcgtttcacgcacagtatcacaggaactgtatcgttcatcatatgcgagcatcggctcacgcttctgtccatctccgagtatcatgtaacgtgatcgagcaggcagcaagcttgagtattctatagtgtca

SEQ ID NO: 87749 - DNA, 1065 bp, Oryza sativa
cccgatgtcgccggtcgcgactccacaccgtcgccggcctccatgacgccctcccgctgccgcacgacgctggcctccacgacaaccacacgccgccggcctccacgacgcctgcacagcaggcctcgccacccacgaggccgcacgaccgcctccacgacgcctcaaccaccacggccgttgcctcgccagccaaccgtcgcagtcgatgccgccacagccgtcgccaccgtcaccggctgccgtcggcagccgccgccgccgccagctagatctggctagagacgtcattgcctcctcccgcatcgccgacgtcaccaccggctctcgcggcacctccaccaccacacccgtcgtccggccacgcctccgtgctcggctaccggagctagctccagcagcgtctcccgccaggtcgtcaccgcccaaacccaccgccaaaactcgccgccgagctaccaggacgccgccgtccgtcgttgggggaccggatccgggcaccacagcaccggatctggacgccgccagtcggcgtcgacgccatgccctgagctcctaccgtgccgacgtcccgaccgtcttgaccgtgaacgcgggagagagagcccctccgccgccgtccttgcagccggcggccgcgaggctggggaacgttctcgcttgttaaagcagatttaataatatcgtcaacttgctgactataagacaaccacatcatctatagcctgttagtataggctgctcatatagcaatggtctttattactatcatatcatttgtagtaacagataatatatttttaagcatgaaccaatctccatcaggcttatttctttttctttattgtactgcgtgttgcagccggtgataattctttcgtcgactcgtgttctcgctctaccattccctgctccagcatatcagtgagactgacgtgatcacgctatcgccgatcttggttggcctattagacatgctcttacgctctccggtttatgttgtgacacgatgggggataaacgcgtgacgagacaactatgaggctgtcatatggatgtcatttt

SEQ ID NO: 87750 - DNA, 931 bp, Oryza sativa
tttctaaaaaaacgttctgattcgctcatatgccaaatctttggttctgtatatggcaagtgcctcaagtattaatgcttgatcttactgtgtctggatgctgtccttttttagggatttaatgaacggcttgtgatgggaagcaggccgacacttggcgttatgttcaagaaggtacattctgtcattctccattccacgtatatatatgctttttaattatcatatatgtgcataatttccatttttcgtatgtgatttttttttcgtattgttctcagacccttgatgtagttttgcaagtcctcatctcatttcctaatgtgaagcccctgcgatctaaggtaagtaactgttatcaacatcttttgcaatttactgcttggatgattaaccaatttgtaacttatgcaatgctgaaatacagatcatatcatttctccaccgtatggttgagatattaggcatttcggtgcttccatgtattccaattgcactgcgacagttgctcgttgataatgaggtatttcatgtccctgtttcctggttattggttttgcaagctattgcgatctctaatagtaactgtagcacctgtgttccctttttcggtaactgtcctgttttagctgtatttctctgaggaataataacggcaggactttggaaactatcgtactttgtaatgtttcttttatatacttatacaacaaaaaggtgcctctgttgttaatcataccatcaaaattatttcagccattggatcatagtattaaccattaaattagatcgatgttctgttctacaaggaccgctttagggccatacagtggattggcccagttagactccacatctcacttttccccctctttggcccatccctttgagcggacaatgtccactttatggactctaataataatttagt

SEQ ID NO: 87751 - DNA, 1029 bp, Oryza sativa
actatagggcgaattcgagctcggtaccctgtttttctagtacctgttgaactgcatattactatttgatgcaacatcaaattagtaccttattatttctctaaaaacaatattgtcgtacatataattctattttgcggcccttgctgacatcatctttttacaggcaaaagatatgtcggaatttctgtacttaataaaccaaataatatgcaagtttaaatcttcagcaaatgccttattggaggatgtgtttcctgccatcgcaagtcatttatctgtgatactatcacacgatgccttttcaaatggttttgcaagcaatactgaggtaaattgaattggtaaataagacccactatattactgcattaatttgtgtgttaaccaattagtttaatgttgttttctctaagcattttgttttgttgttagtcactaaatatcatggctgttaaggcgtcgctatggcatcgctatagtgctagggcaccctgagggggtcaaggcatccctccgccttagggcttaatgcagagagggagagggagaggtgaaggcggcagcaactacacccttttcccttttctctgctccatgtcatcaccattttgctcccccttagctctggtttccactctcttctctcccctgcgccagattcatcttgactcaagggagcagccgccagatccatccaagggaaggagcacatacagagagaagcacttgattcattctgaatcagggggaagggagcacagatagaggaatagagctagcatgattaagaagagccggtgcgaggaagaagcgatagagccgtgaggaagaaacgacatcgggggcggcgctgtgagaggagagacacacctggtgcgggtgttagggttatttctttgtctttgggctggtatgaaggatattgggcttttgtgggctggcctgctaggctggttttcttctgatcgctgctaaccacataggttatggcatcgccatgccttagcgttttactgctatagctta

SEQ ID NO: 87752 - DNA, 697 bp, Oryza sativa
tcccctacaattaagaatgaaatgttagtacaaaacactcatccggtcgcaaataagcacgtatgataataacaacttatttacttacagtgaactagagcaaccaagccttgctaggcccgactgtagagtacggaggaagggtgttggtcggtcctaggtgtggagggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcagggtcgtcgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttg

SEQ ID NO: 87753 - DNA, 631 bp, Oryza sativa
catctcacttaccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccaaaaaagtcctcatttgcccaatcagtggccattacattaccttcctcatcggatgatgcgtcgtcgtccacttcctcattatccgaatcttccctctccatttcatcaacaattataccgactctctccccttaatccgccatgcccatagcctgctcctcccttggttgattttcctcattttgcatcgatggtccaacaacatcccctgcattgataggaccctctacatattcggtttgcattgaaacatatatatctttctcttgtaccgacacaaatataacgaggggccat

SEQ ID NO: 87754 - DNA, 530 bp, Oryza sativa
ctcggtatggcataatgacaaccaatttggcagaggtgtacaactgggtaatgctaggagttcgggtacttccattggttgctattgttgaattcatccttcacggcacgcaagcgtactttagggatcgatacaagaaaattagtccgtccatggacgataacaacatagtgtttggcaacgtattgacaaagtacatggaatataaaatcaaaaaggcacggagacatcgagtggttgctaaggcacacaagtgcatcggtatgaaataatgtgtgctgataacgagcaggcgtggtatctatcgcaggcgagccgtgcaggaatgtgtcttgaaggcggatggtggatgtacctgcagttgtatgaagccgaagcttcatcaccttccttgctcacacgttcttgctgctgacggtgattgtggcatatcttcaaatgtgtacgtctcaaattatttcaagaaagaagcaatctttcatacatggagtgaggagatatatgggttcgggatctgaggatcttacaca

SEQ ID NO: 87755 - DNA, 598 bp, Oryza sativa
cctattaaaagagatagaggaaatacctgcaaaatggtatccaagtaaggcactagcttagccttcaacagcctgatagctctcatgagcaagtatcctgcatggcagctcacgtgggcattctgatggtgtatgccacgctcatccaagaacacagtaagcagatgtggcacatattggtcattctcctgcatgaacttgatatagcggctaattgtgtctaggtacactaatgcaactaggcggtgtgtgtggcatgagaatctcgctgaaaggagcattgggacaagctccctaattaacccagctccagtccggatctcttcctcacccactatttccccaagccggtaaaacagagtaagcgcgacctcaacatcctcaacactaacttctgcagatgaaagggccgtcacaagcaaccctcttatgaacagctgagtggcacctggtgccacacgacaaatgctccgaaatagtgcaattaaatccttccgctgctctgccatcaggtcttcctcctccttccctatcttgtcaaggacatcaagatgacccctataaactggatcatatgacatctgcatccgcaccacct

SEQ ID NO: 87756 - DNA, 976 bp, Oryza sativa
atgggtgcccatcacgcgtgtgaaatgtgggtgtcgtccccttcgggcccgtccttggccagcccaaagtccaacagtttccctttgtaatcttgaagggagggacaaaattcacaggcccaaaaaccataagcccatttgatgcgattcttttacttgggcttattactaatgaatgggctttaaagtgggggaaattcaagttgggcctgattttggcccatcttgagtagtaacccattaaaggcccaaacttaacatttgctttttctttcaaaaaaaagaacattgacacggtcatggaaaaaaatgtaaagatttgattatattttttagataataaagatttgattatatgacccgataaaattattttcagtgacgcttttcagtggtgaaactaaaatttgggcctccttttagcccaatcttgagcagaactcacttacggcccaacctatgaaccatagcccacatcactaagctttcctttccttttctttggtagagaagtacaatatgataataaccattaactagtactagttaagtatgaagtgatgcataacactataacagcataagtacagtatgatactaagtttctctgacataatcatgtcataaaatgcttcaaaatccaaactgtgccaagtacaatttcctagtcattactctaccttttcactgatgatgatgaaaaggtcattaggatgatactatatatatagtatatcatatgtgatgtgtgcatcaaaaactcctagctaactgagatgcatgcatatgagaggtgtcaatctacctaggaaaagctacagggcactcaccgaatcgagcaggatgttggaggccttgaagtcacggtagatgaccggcttctctgcgtcgtggaggaacgccaaacccttcgcggcgccaaccgcgatgtttaatcgggtcgaccacggcagcactgcaggaatctctgcagaaa

SEQ ID NO: 87757 - DNA, 1747 bp, Oryza sativa
cgaattcgagctcggtacccctctgacgctgatgattactcggtccgacgctcccttgaggcgtacctgtggtggtcgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtctttttttttcttcacataacatgtctaattccgatcatgtttattgcagcgtcgttacgctcacatccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactactgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctatttcgcacggtactgctcagcccagaggtttcttaagttttgtttctgtttttgtacgaaaacatcaccccgtcgtaacttgatgttccatcctcgcaggacctcgtttgccttcgagcgcccctagcttcggagcagtgcgacctacagcaccggtttcgcacggtacagttcagcccagatattagttcatttttgtttcagcttttgcacgattatgtcaccatgttttaactgcacgtttcctcatcgcaggacctcgtctgccttcgag

SEQ ID NO: 87758 - DNA, 632 bp, Oryza sativa
caatgtgtggcttggtgttgaaccatcacatttcatatgaacatgttactgtaactaaaaaattcaataacattttttccattacagatcaatgcttacctagtttactcactaatctgaatgccattttatacatttctagtcagcattggataagttcaatttcatggtttgctaagaatagtaacacacaccccttttgttgtgccagatgatagagaaggtttgctcttcattctttcctcaagaaagttcataacttccttctctttcggaccagcacttgtggcctgcaatgacataggagattcatgtttctcagatacagaaaatgcttgagcttatggggtggtttctccatctagattgttcagtggctctgtgacctaatcagtttctagttgcacatgataactgaaaaaaaatacagcatgctatttgcatttggggtagtcattcacaaaaaaacacgactaacttgtgttatgatgaaaagagctatttaatgaactgcaaaaaattcctagaataccttgtgtgcaaagaattgtccagttggatcacatgtgaagagctcgggggttccttttttttcatcaattccaaagatcatagaactccaaagaaaatgg

SEQ ID NO: 87759 - DNA, 3436 bp, Oryza sativa
ttgggctaacgataacaggtgtgtgcccactcgtcacgtgtatgccatgcctgacacctccagcttatctacagggcgagtcgagtcgacgccgatagcgtgatcgatcgatcgagctcgtcgtcggctacacattggtgggtcgatcggcggcatggcgcagcagctgggcctcctcgccgccgtcttcgtgtcgctcgccgtgcacgtcgcgctccactgccccatccagccgctcgccccgccgcccgcacgcccacccgccgccgctcgcttccctcccaacaacctcctccaggtacggtacgttgcgttctagctcgccgcgccatgccgcgctcatgtcggccgttggtggattcatggtttgcgatgtggcagaatctggagaagcttggggaagggatgctgagcgcgccggaggacgtgtacgtggacgacgccggcggcgaggtgttcacggcgacgagggacgggtgggtgcggaggatgcaggcgaacgggtcgtgggagcggtgggggctcgtcggcggcacggggctcctcggcgtcgccccgtccgccgacggcgccatgctcgtctgcgacgccgacaaggtaaatcaaaacaagaaacatttctacgatgatacgcttcactgcttcagatgaagataaccgaatgagagacagtgcaaaagttgtttactgttggtgtaaaatactccctcgttccctaaataagaaagtatttttaaacatgtttgaccattcgttttattcaaaaacttttataaaatatataaaactatatgtatacataaaaatatatttaataataaattaaatgatagaaaaagaattaataattacttaatttttttaataagataaacggttaaatatgtttaaaaaatgtcaacggcgtcaacatttagggacggagggagtactaattaaaatctgcagggattgttgaaagtggatgagaatggacgcgtgacgcttcttgcttcgactgtcgaaggctccacgatcaggttatcttcctgcaaattacttgtttcactgcaaactactatgcaatttgcacagtgcaaatctgtaactgcgactgcgaattctctactgttcttctccgttcgtcgtcttcaggttcgcggacgcggcgatcgaggcctccgatggcacggtgtacttcagcgacgccagcaccaggttcagcttcgacaactggttcctcgacttcttcgagtaccgcttcaccggccgcctgctcaagtacgacccccgcaccggcgaggcctccgtcgtgctcgacggcctcggcttcgccaacggcgtcgccctgccgcccgacgaggccttcgtcgtcgtctgcgagacgatgaggtagtaacaagctcaacttctcatctgtgaaatgacacgtgcagtgacctgagtaacattttaaggttacgagtgcaaatcttcttaggaacgaatttcagattggattgtttgtggggctaagttcctaatttaaatggctgcatatatctgattggatgtagaatctggatagaaaatacccttatctaaaataataataaaaaacgagtaattttacggttcataaggatgtaccatgaggtaaaaaaaattagtataaaatttggtatcttatagtatctagatataaagagatatcaaattaaaatagaaaaaaaatagtatctcatgtatctccttaagaacggtaaaattgctcataaaaaaaagagtctgttcactctatcgtcaagtgaccatgaagtgatattgtcaagtgcaggttcagatgcttgagagtgtggctgaaaggggagaaggctggggaggcagagatcttcgtggacaacctgccggggaatccagacaacattcggctgggttcagatggtcacttctggattgcccttctccaggtctctgctctctaacctttctgctgccataagcatctacacaacattttcagtgctcaaacttacaattttctgtgctcaaactgcaggtgaggtctccatggctggacctgatctctcgctggagcttgacgaggagggtcatcgcgtcgttcccggcgctcgtcgagaggaccaaggcgacgctcaagggagcagtggtggctcaggtgtcgttgaacggcgagatcgtgagggttcttggtgactctgaagggaatgtgatcaacatggtcacttcggtgacagagttcaacggagatctcttcctcggcagccttgcgaccaacttcataggaaaattatccctggctaaggttacacgggagcaggaggatgcagttccttcgtagacagttacagtttgaagtgttgatgtgtgatcatcagttggtatcgtaaatccgggggcaactcataattgacacttgacacagcttgagcgcagtcatacatatagctatagcgtacagtaatcagttagcggtaatggttttgcataacttccatgctgtaaaagatttgaaagactggtgatcgtcctatatcgagcactttgttctgctctcgtccttcacctccgcgtgcgcttgaatttcactgggtgcagagttacagttggatcccctttcttgataaatccaagctgacaagaaagtttgacttgcgtcgttcagtataatggcagtgcaaatatttcttaacgttttatttagagaagttttacattctttaagaattccaaaatttttagtacattttttttaccttacactgggatgtactaaattttacactagaaaatatggtatctttcggtatctcctcaagaaccgtaaaatcactcttttatttaacaatagtgagtgcaaacagaacatatctacaatagggctaagaatgagcactacctcaaattctcgggcatagaaatccccctccaggacatgtttcaacgcagattttgccaactggaaacaaaatcagtaaaaattaatcacaaaggggatcaaaatattggatcaccgtattgccaactggaaacaaagtcagtaaaaattaatcacaaaggggatcaaaatattggatcaccgtattggatagggcttgtgactacaaaagtgctaatgtacaaataaatacgcaacagcatgagggaaaaaagaacttgcaggcatgcattattgacagtagtctgtcgaagatgctgcacagatagacatcccaaaacgcactctgttgttaaagaaacagctaaaacttcatgtggtaagcatccaaagagaactaacagagtggtgcccttaataatgatgttctcaaattcagcttcagagaaaagggaacttttgttgtgttaaatactagttactagtatttaagcatgtatgagatttggatatcttgtactgtctgcaatgtgtggcttggtgttgaaccatcacatttcatatgaacatgctactgta

SEQ ID NO: 87760 - DNA, 939 bp, Oryza sativa
tttggaggcgatcttttcgagcatgcggttgtgccgcacaccccccctgaacgcgtagatcaccgcgtgtgcagggatgcatggtatggtgttgcggacttgacagaaccgctgaatgtacgagcgaagtgactcatcatcccttcgctgtactgcgtgcaggtccgcttcttcacctgggcgcggatatgtgccttgaaagttcatggtgaactgttggcacaaatcctcccaagagtggaaggacgcgggtggcaagttcattatccaaccccgtgcctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggttgatccccgcgtctgtgttgatgtgacactccggacgaggaggcgccctccgttgcgtgggcagcacgtcggccattacgccggcgctcgatactgatgcgggcatccggccccccacgcagatcttcctgggtcggaggcgctgacgaaggagtggcggccgaatggcgagctacagccgccgctcgccgcgccctccgccgaaccgagaccgcgcaggcccccctttgccggttcggccgggggccctgggccgcttggacaaagagcgccccagggatgtggcccctagcgaagaggatcggccccaccgaaaggtgcagcggcccgtctactttgttagtgaggccctccgggacgccaagacccgataccctcaggcccagaagatgctttacgctattctgatggcttcaaggaaactgcgccattatttccag

SEQ ID NO: 87761 - DNA, 1922 bp, Oryza sativa
caagaaacgagttcttgcagtatattgttcttcagcgaatctttgcagaaattgtcattatgtgtaacataaattggttttggcattgtcattcaggaacaatgttcacaatacacatgtgatggaacagttaatagtgacaaaaagcctgcactgaagcagagtacagggcattggagagcatgcttcttcattttaggtacttctgagaagttcacaaaattattctgtttgtgctcctcaatttccttgattaaacatacgtaattcacctaccgagtcctgaacatgtcataggtgctcaattcgctgaaaccttgtgcttcttcatggtttcgaagaacttagtcatgtacctcacgagtgcgctgcacgaaagcaacatcgacgctgcacaaagtgtgtctatttggatcggcacttccttcttcacaccactcattggagccttcttggctgatacatattggggaagatactggacgacagttatttccctctttattatcatcatcgtaagtgcaacaaaacagatcagtagcaactgaatgatataagctgcagtctcctctgtaatttgctgctctgaagagttgtgttttgtcagggaatgctcattgtgacggtttcatcatcaccattgttcctgaattcttcttactacaattggaacatttgccgtgccacggtctacacagggctctaccttactgccgttggaagtggatgtatgaagccctgcattccagcctttggagccgatcaatttgacagtgctgacccggtggaacggctggcgaagggctcattcttcaactggtattactttctcaatgaacgtcggctcactgctgtcgacaactcttgctggtctgggggggggccaacataggggggaccgtcggttttgcaatcccaatgctactctcggggttcggccttccccctgtttttcgttggaggaaaggttaacggtacaaaaaaacaggaaggaagcccctgccaggggggcccaaggggggggtgcagctggaaagaatcataagctgaaattgcctgacgatagctcactcctgcatgaaggttcaaaagtgactgaagatgattacaggactcaactcaccactcaattcaagtattgctcattgcatcaaccatcaagggttatgtctaattacagcttaaagtttgtggacacaatactcaacttatactttccccgtctgaaaatatagcaacctatatctatgtatctgaatagctaaaagttgttatatttaatgtagtattatttagtacagtacaaaataatgtatttcccgggaacaattctcactgtcaataaggctcccacgttattctagaccatacgttttaaaaaatcatctgtagttgatttgactcttacctcgtaggaggtaatttgtcatcacttaccatatcatttcatttataaaaacatatacattgatcctctactaatattcctgaatgtcaaatacaaaatacaaacatcaaacacttttgaaaatatactgacaaatattattaaaaggttgaacatatactccctccgtccacaattataggggattttggtccctgggtttgtccaaaattataaaggattttgtttatcccgaaaggatcattacaacagccatcaataatcccactcccatccattcacatatgaaaagacacacagagaaaatcatgtgtactactagtactaatccccagtccccacccttgtaaggaaaaataaaatataccccgttcccaccatccctaatccccatatgtccttagatgcactttttccctcttccttaagccatgtttccttcgtgggactaattcatttaagccctatttgtttcagtttaagattattgtaatctagattattaaatcagatt

SEQ ID NO: 87762 - DNA, 802 bp, Oryza sativa
ggccatggcgtactcggcggtggtcgaggcacggcggctggggacggcgccagcgccggtgagcatcatgtggcaggcgccgtcgtacctggtgctgggcgtggcggaggcgttcagcgtgatcggcatgatggagttcttctacgagcagtcgccggagtcgatgaagagcctgtgcacggcgctcgggcagctcgccatcgcggtcgccaactacctcaactccggcgtgctcgtcgtggtggcggcggccaccacgcgcggcggcggggccggctggatcccggacaacctcgacgaggggcacctggactacttcttctggatgatggctgttgttagcgtcctcaacctgctgcacttcttgcattgctcaatcagatatagagccaataacaacacgctgtcgtcttgacatttatacctacactcttcttgggtgcacattcgtcatggttcatgccaaattaagtatactagccgttaacccgtgcgttgcatgggatatttattaacacgctgtaaatattaaattataactatatattgggtatcttatgaattataacgacttggttaaaaaaacacttaacatcaattgctaattgctattattaatctctaaaaaaaatactgagttgagagtatgagataggaacataattcttaattatgaaatcataaagtattaagttctgaaaaaaaatgaagagtttgtatagtactttgtaagtataaacagttggttagattagtagatctaattatgttattcttatgttttaaattatcgcattcagaa

SEQ ID NO: 87763 - DNA, 3106 bp, Oryza sativa
tgctactttgaccaatgatatttataaaagtaagatgttttaaataaaaagaattacatattgtgatagtttgtttaatgataaatctaataacatcaatgttacataactgatcttttttatatttttgctattaatagtcaaagttacaaatatttgacttgacactatgctaaaaatgcttatattttgggacggagggagtaatgtttttctctccttccatttttctctatttcctcttctcctttattctcttgctttatcccccatgtaggggattcaataaataaagacttgagagcacataacaattttgtctagcaagtttcataactaatttcattgtaaagtgaagtgcatgggcaatccctaaacttgtgcaggtgtgtcatctagttctttaactcttaaaatgtatttttcaggtccccgaacttgtcttggtagtcatatatatccaaacggaatccaatccacaatgtacattgacgtgacatgccatggcggcacctacatgttagtgagacccacatgccagacacattgaaaaaagtaaaaataaaaagaacatattttctcctctctaccttagaattttttatttactttatcttttctcctctctacccaagaggaaaaactgtgattttaattttttttatatgtgactgacatatggttccaagctactaacatgtaggtgccactatggcattccacattggcgcatggagtgtgtcggagcctatttggataagtatgacaccccacccaagacaagttcgacaacgtgaaaatatattttgagagttcaaggacctgatgacccacccacacaagtttacggaccacccatatactttactttcattgtaactaggtgatccccgcgctttgctgtgggaattactaagtaattctcaatatatttttttttgacaatcaagctaggagtgaaaaggaaaaaaataatgaaacatgtaccatgaaataaacaaatgatacccacgctttaatgtgaaacatattgataagtatatgttaaatattataaaaatgatagatagatttgttaaaatataatgcaaatgatgtgaggggtgatgattggatatgcttgcatattgatttgtagaattaaataaattgtaaattgatgttgtatgcttgcatgatgttaaatatgtaattattgctagtgagttatgatgtggcatggttgcatcttgagctttagatttagtgggctataactttatagaaagtataggtatgcccattgcattgaatctcttgaggcacttgtaaacatttcaaattaaataaaaaaattaatggaaagtagttgggtgaattccgtgttacactaggtcgagttttccttgtttcactttacaccaaatttaatacatgtctacacttacaacatggtatattgggataaattttactttgtactaggtttatgtcactgaatgtgtgggacatcttgtaaagcataagcggaatccatgatactccatgaagttagatcattttttcatgaaatttctgtatgttgattaatggtgtatgatgacgtacgtgttaactgaaaattatttcaatacacgtaatcgtgaatgaaaagcctatcatcacgaaggtattagtgaaataaggtactacctttatattttaatgtataatgtcgctaactttttgtctaacgtttgaccattcgtcttattcaaaaaatttatgtaattatcatttattttaatgtgacttgattcatcatcaaatattctttaagcatgatataaacatttttatatttgcataaaaattttgaataaaacgaatggtcaacgttggtcgaaaaatcaacggcgtcatacattaaaattaaaataaaaatacggagggagtataattttgtgatacgaatgcaatttatacttaaaaagtatgttgaaggcaaataccaacagcaagccgtgctggaaaaggaaattttgaactgcactcctgtttctttggaccatcaccacttggctggtaacccgtgtggcagcggcactcgtaatctcctggagtgttcctacagacaccgtggcaaggatacttgttggggtgtgcgcactcatcgatgtctgcagatttattcgaatataagagttaattttggcctctagaggcagtacgagattccatatatggttaaaccattgctgttttttatatatgatatgtagttgtctttaataatttgtttgactatttgcagttcataaaaaaattgtgcaaatggagaaaattaatactaggtatgtatgcttaaagtattttagttgatatatatctcaatatatatataatattccaaatcttctaaccttaattaaccaagtaattaaataaatattgttgtcctaagtttaaactatatatgtcacatattaaagaattaaggtagtagttacctttgcatcctttattgggatcgtcgtcgtaagggttaccctcgtagccactgctgcagttgcagtagtatccgaggccgttggtggagttgacgcacgtgctgttgacgctcacgcaggcgtatccagctggcatattcttcttcgacgtctccacctccggcgccgggcaggacgccacgtcgcggatggcccagtccagccacaccggcatcctctgtttccggtccatgttgagatcagacctctggaattggtactcttccttgtcgacgaggaaggcgtagtcgcaggggctgaagtccacctgttcgccgcgcggccattgctggaaggtgacgacgttgtcggtgagctccggcgggatgtcgacgtggcagcagccgacgccggcgcacttgccgttcttggcgctcagcgagtcgctgcagtaggtgacgcagccggcgtagtagaggcttgtgtagaggccttttccctcgctgtccccgtgcttgttccatgccacggtgttgcatcccaggacgacgaacttgttgcgctcgtcggagatgcggtacacgccggtcttgttcagctccacgtcgccgtaaaactgctcggtgacgttgccgctggagttgtagcacctgtacgcc

SEQ ID NO: 87764 - DNA, 904 bp, Oryza sativa
ggtgcttcatgtcttatgtataaatctggtcatgaagctgtgttctctctgtgcctcgtggaagaatacacaaacatggcaagattaagtaagctaagggtggccatcatccagaagaaatagtccagatggccctcattcagattatccggaatccacccaggtgctccactgctcgtcgtgatcactgcgacagcgccaagcacgaacgtgttgaagtaagctcctgaagcgattgcgagctgcccaagcgctgcgcaaacgctcttcatgctgtctggcgcctggtcatagaagaactgtgacataccgatgcagctgaaaatctctgaaaccccttgcagaaagtatgctggtgtctgccacaggatactcattggagcagctacattgtggtctgctaagccacttgattgcacgattgccagccgcttcatctcgagcaatgctgcgtacaccatcatgatcatggacagtgaaaggccgattccgatgcgctgcgcatgtgagaagcctttgtcctgtccggtgaaatgcttcaccagtggcactgatatgatctcatacacaggaaccaagacaaggacgctgagcacggcgatgatggtgagggatgcacgtgggattgcaaatgaaccaacatggttgtccatggccattccctgctcaatgaacgttgaggacatctgcccattgaccgcgaaaaagatcacgaaagatgcccagtggggaacatccgcagcagcatcttcagctcctcaacttgtgtcactgtgcagagcgaccatgagctcatgggcttgatgcacgtttcgtttgatgggggcaatacaatggctgccttgtcaaggaacctgaagaacacaagaacatggttataacttataaggaggatggattctaa

SEQ ID NO: 87765 - DNA, 1227 bp, Oryza sativa
gaacggacatccggatatgctgtaagttaggcacgtgagtcatgctggccacatgagatacacttgcaataaaccaactctagcaccttccatcggtgttcgagagataattccgctcgctcactggttctcgcaccagtacgcagcaatctctcgcaccgcaccttccatcggtgttcgagagataattccgcttgctcactggttcccgcaccagtacgcatcaatctctcgcaccgcaccttccatcggtgttcgagagataattctgctcgctcactggttctcgcaccagtacgcaccaatctctcgcaccgcaactcccatcgttgttcgagagataattctgctcactcactggttctcgcaccagtacgcagcaatctctcgcaccgcaacttcagatggtcgaggtacgactacagcaataacgtagtggtcctcgtaccacgactcaaaatgatcgagagacacctactcaccggttctcaaccagttaatcgtagtgatctctcgtacatttgcttctagtggtcgagttacgactactgcctggtcctcgaccagcgatgtagcgtttctcccactttccactttaagtggtcgagttacgactactgcctggtccacgaccatttctcccactttccactttaagtggtggagttacgactactgcctggtcctcgaccagcgatgtagcatttctcccactttccattttaagtggtcgagttacgactactgcttggttctcgaccagcgatgtagcgtctctcccactacttccactttaagtggtcgagttacgactactgcctggtcctcgaccagcgatgtaacgtctctcccactatttccactttacgtggtcgagttacgactactgcctagtcctcgactagcagtgtagcgactctcctactacctctatttcaacaaagttgatagcaggtacacaatatcgccaagtgttttacccagagatcccttaccacgacgacctagcgttgaaacctatcctactgtccctttacgccgtcttgacaaggcctccgaggaacctaagggatcttccgttggggatgcccagagccgataaggccttgtcggatccttcagagacgaaagaccatgtaagatctggtcgtgtaagagttctcgccgtgcgtattaaccaagccgtgtaatcggaagttgacttttccaacttcacggctgggggct

SEQ ID NO: 87766 - DNA, 1600 bp, Oryza sativa
agaaaagaccatctaaaacacatgacgagatagattaagcgacatacctataaaggagtagagtggtggcggttgataagacatataaaaactgttaatagaacaccaaatagaatcgtaatgacgattaaaaggagggacgataagcaggccgtgaagcaaatgaacaaggcggttgccgggacttctagaaagtaaaaaaataaaccccattgataatcatatttgatttttaaaatctcaatgacaataaaaaggagaagcagcgggcgggtgttaacaaccaaatttggttatatcagtatcggagatgaggataagaacaaagcagaatcaaaggtggagattgatttgagaacagagcaagaatcagctggagtccggatcggctacgatcaggatcggctgggtccgagtcagactgggtaagccgatacaaccgattctgacaatacgacttggtgtgcaacatcaggttgagttgatgtgcttcaagatgattgtcgcgcatggatagagtcttgagaaggcaattgtatctattaattaggatattttatgtaaattccttagagatatgtttgggcaaaaatctgccgcaaagacttatggtatcttagagtttgttagagataagagtcgtgtccgatacggacatagtttgtaattttcgggtataaatagatcccgaaccctatgtaatcaattaacacacacgttcaatacaatttcggcgcatcgccaccctttcactttagttttatttcgacgagttcttgctttcgggttgagctgcatcggttttgatctttaacaagaggtaaaacttgttatgacggcttgcgttcttgggattagtgcttccatctttatgacactctaatcttgtttatgtaattcgtcgagttatcatatatcttatataatctttggcaatctcgctatctaacctacaatcggctaacatctatcgatagagggcaaccaattaggttagacatcgatgttgacttagattatatgagatatctaccactctatgaaacttccagcggcttgattgtctagatattgttcttcttttcatacttaatgttgcatcagttgagtttgatctattaagtcgtgcttagaatatcaatctctagcctgccttcttgacggagcgtggggctcctcaccgggagaccgcgcaggcccccctttgccggttcggccgggggccctgggtgaggttctaagctcttggtttgtggaaagttcgcgagagtggaaacacacaagacacgggcgatgtatacaggttcgggccgctgagaagcgtaataccctactcctgtgttttggtggatctgtgtatgaagaagctacaaagtgccagccagcccccgatcgttctgggatcgttcttctctccaaaaatcatccatcccttctaagtgggcaaggtcctccttttatacctcaaggggataccacatgcaccatctctttcttttttggggggactcatcctctcttccctccaacttgacttctcttcattaatggacggagatttgtatggctgccgtccgaatgaccttctgatgggaaggcc

SEQ ID NO: 87767 - DNA, 1462 bp, Oryza sativa
aaagcttacaaatgtcaagaaaaaaatacatccaggaacatggagggctgctattatttgagaagatgaaatcagaccagggacttgcatttaaggtgttcactcaagcagaactagagcaagcaacaaacaagtttgagaaaagccagattcttggacatggaggacatggcacagtgtacaagggaataactaaggataacattacagtggcaattaaaaaatgtgcactaattgatgatagacataagaaggaattcggtaaagaaatgttaatactttcacagattaaccacaagaacattgttaagctactgggttgctgtcttgaggtggatgtcccgatgctagtgtatgagttcattccaaatggaacattatttgatcttattcatggcaagaaccgtactcttcatatccctttcagttctctcctaagaattgttaatgaggcagctgaagggcttgcatttttacattcctacgcaaatccaccaattttgcatggtgacgtgaaaacatccaatatccttcttgatgagaattacatggcaaaggtatcagattttggcgcctccatattagcaccaaatgatgaagcgcagttcgtgacaatggttcaaggaacatgtggatatctggatcctgaatatctacaaacatgccagttgacagagaagagtgatgtgtatagctttggtgtggtcatcttggagatccttactgggcagatgccattgaaacttgaaggttctgagctacagaaaagcttgtcatcaagcttcctattggcaatgaaggagaataatcttgaggccatgctagatagccaaattaaaggtcatgagagcatggaactgctcagtggacttgctgagctagcgaagcaatgcttggacatgtgcagtgagaataggccatcaatgaaagacgtagctgaggagattagcagactaagaaaactttcgaaacatccttggatacagcgtgatagtgagacagagggctatctcagtggaccatcaaccagtaactttgaaattgagcaaagcactgagtacacaaggaaggacgaacaaatgcccataaacccaagcacttcgtattttatccggtgataacaatctgttacaagagctttcctgttttccttattgattcttaacattattctttccaattcactggtggttctatattgcaactgcacaatactttctgttggtataataatttgtcgttgtatatgcccacaacatttttatcatttaccattattaaacgtattctattatagtggccaaaccatatctcctcaggtaatgttgtttaaatattcaacggaagtcttataaagctctcaaaacattgcagaacttggtgtctgctgaagtttatgtttccctttatttcacaaatgcgacatgaatttaatcacaaaaatgacaaggaacttacttgg

SEQ ID NO: 87768 - DNA, 623 bp, Oryza sativa
gtgattttccaaagaattaatcttcgagtgggctaagacccattcattaattccaacacccactgcctatcaaaccaaatatacactacacgagagctcgatgtacgtatacataaaccattcaaaatttcattgcgtatcgatttgttaagttgtttattaatttcatatattgatatgtcattatttttcgaatgatagcgtattcacatgagggaaaaactcccacataaggattttatcacgactgttcaagaacaactgatggggttcatcaacgaagaagtccttaatcccgatggtgaattctactacgacggatcgacaattcgtaacgtcggtccttcctcttctgacgtaacgcaggcgtcgaagtcatagctatagctagcgagcaaatgaattgtactatacatgcatgtatatatatatatatatttatatatgtacgtacatttactttagagttaatatatattttggtaacatatatgtacataaaatgttaagtgctttaaattataaatatgtgtgtaatatatgtatttatacatatatacatacgcatatatatatatatatatatatatatatatatatatatatatatatatatatatata

SEQ ID NO: 87769 - DNA, 729 bp, Oryza sativa
tactgagcaaagtctggaatattgtcgtcttccacttcatcttcttccatttcaaccccttgctctccgtgggatgtccaacaattatagcttggcatgaaccccgactcaaacaagtggaaatgaatagtcctggatgcagaatactccttctgattcttacacttattacatggacaacaaataaaacccttctgcttgttagcttcggccactctcaaaaaataatgcacaccatcaataaactctttggaccgccggtcagcgtacatccattgccgatccatctacatgaaatgaaaaaaaaatcgtacacaaataatcattcgtataataatgacagtcatacaataatgataaaataatcacaaactctttcaacagtcatacaataatgacatatcattattcatacaaaaattataaaatattccaccaaataattcttatttattattttttaagttttaaattcttttaattttcaatttagtttgttttcttttatttaagattaactttcactatattttcctactcaactattttataaaaccttatttagcaaataaacaaaatttctatatattctttcttttcccacacaaattttctctctcatcaacttacaacaaaatttttgagacaaaaaagtctgcaaaacatagctccaaatgtaatatggccaaaaaaacattggagaatgaagttgctaaccttttaggcatc

SEQ ID NO: 87770 - DNA, 635 bp, Oryza sativa
agtacccacatctgcgcatccagggacacatcgtgacccgagccagctgcgaaatcttccagaccctgctggcgccgcacagtgccgaatcctcgaccaagagcagcggtttggcgtgggtctacttgaacaccgatggatctctggcctacaacatcgaaacggagcacgtgaacacccgggataggcccaacatcagtttgattgaggagcagggcaagcggaaggccaagctggaggatctgacgccgagcttcaacttcaaccaggccattggtagtgtggagaagttgggtcccaaggtcctcgagtcgctgtatgccggcgaactgggcgttaatgtggccaccgagcatgagacgagcctgatccgtggccgcctagtgccccgtccagtggccgatgctcgggactcggcggaacccattctgctgaagcgacaggagcacacggatgcacagaatccacatgccgtcggcatggcctggatgtccattgacaacgagtgcaatctgcactacgaggtgacgctcaacggtgtgcccgcccaggatctgcagctgtatctggaggagaagcccatcgaggcgattggagcgccagtgacgaggaaattgctcgaggaattccgctgc

SEQ ID NO: 87771 - DNA, 2500 bp, Oryza sativa
tcaacaagcgcaagcatgcatccgacgaagaagacgacttggtcgacgtgctcctccgcctccacggcgatccggctcaccggagcacgttcggcagccgcagccacatcaaaggcattctcacggtacatattacgtacatgaacaagaagagcatagcacgctgtgatatacgttttcctggacatgttttggaagacgcatatgcgcgcaccacactcacaccccacacgaatacgtctcccaacacatacactaagagatagaaattagcggcacatttcttatctcactaaatttcggtcggtcgaaagctctgtgtgcgtgtaaaatttgagcatcagaatttaaactttagtggatagactggagtcatgtactcacgactcaaccaccacaccgctggtgcttccccgttttcctggacattttgatcgatcgaaaccgaaatgtgtggtcttgcaggacatgttcatcgccgggagcgacacgtcggcggtgacggtgcagtgggcgatgacggagctcgtcaggaacccggacgtgctcgccaaggcgcagcacgaggtgcgccgcgtcgtcgccgccggcgacaaggtgcgggaagccgacctcccggagctccactaccttcgcctggtcatcaaggagacactgcggctccacccggcggcgccgctgctggttccacgggagacgacgcaaccgttccgcacggcgcacggcgtcgagataccggccaggacgcgcgtcgtcgtcaacgcgatggcgatacacacggaccccggcgtctggggcccgaacgcggaacggttcgtgcccgagcgccaccgcgacgacgccgacggctgcgcgcagcagcacgacgggttcgcgctggtcccgttcgggatcggccgaagaagatgccccggcgtgcacttcgcggcggcggcggtggagctgctgctggccaacctcctattatgcttcgactggcgcgcgccgccggggcgcgaggtgaacgtgaagaagaagaacgggctggcgggtgcacaagaagaaccctctcgtgctcatcgccaccaagagcaagaggaacacaggtggccattgacgacgcagacatgtaaccttgctggtagggtaattttatcagaaggtacatacaacatgtgtaaaaggtacatacaacatgtgcaaaaggtattattatcttgagatactttctcaagggttataaaattttcttgatagtattataaggatatgttcactttgttaccgcattctaacaaactaaacaaattattgcattgctgttctaccaaaatttagcatttcaaaagtttcttcttatataaacactaccaaattttgatagggctacaaactaaatgcaactaatgctatgaaaatttgacaacattaaaatgtgccaaaatttggtaacgctaaatatcggttaggttgatttcagcaaaaactgaagaagctctaagcactaaatcatcagtaagaaagtttattaatgctgctcccatcaagacggagctcagacgtatccgtactgagataccacaagttcacataaggcagaagccacggactctggattctggaacggtctcggtcgttccggatcggatgggtacgtatgtcgccctcagaaagatgatgacactgactgttgcatttgccaagagccaatgggttgcgtttgcgtccccaaactttcacaaaaacggcagtcctcatccatccctagagtttaattcttttttgggactgagggtgtagccttcctggtgagaaatgaaagtactactggtacaagcaactagaacggggagcatatggaagccgtcgtgaagttgccccggttcctactagctctctctctctctctctctcctgtttccggtgcaggattgggtaaagacagtacaggaagcggcggcgagcgtcgtgcgcacgggtcgccttcaaggtacagataaacggatggtcgtcccggtcgccgatcgccattggttttcccgtcgcgatcaggtaggaaacgcaggcgcaaccggcccgtacccgtatctggatggcttgggtcagtgctggtgttggaccgccagaggccaacatcaacgtgcagaatacggccggagtttgtggaggattgcgagacgcgtgtgcacgcacgatcgacgcgcgggttcggcaaaggaataagttcactttaagtccctctattcgtcgcccagtccgattttcatccctaaactccaaaaccggatactacccgtctccaaacttacaaaaaccggcacatagcggttttggctgacgtggtgtctacgtggctaagttaactaggtctccatgctacgtggcactgatgtggcgcttaagtgacaactcgatttgagaaaaaaacaatacccgtgggacccataggtcagttacataaaaacaataattaataaaggtgggccatgtgggccccacatgtcaatctcactgccctctt

SEQ ID NO: 87772 - DNA, 620 bp, Oryza sativa
ttgaaactgcttctattgaaatgctgaaaggaatatatgtgcatgtgtggtagcccccggctaaccctgcacacccgaggggggggtgcggggttagcccgagccaaaacctgacacccgacccccccttcaggggtagaagcgacgaaggtgttcaatgttccacgggtttggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccaaagcaccgctggcaactcctcgatccatgaatcgccgtgct

SEQ ID NO: 87773 - DNA, 693 bp, Oryza sativa
ctggcggcgtgtgttggcttgtgtgtatgttgtgttggtcttgtggcttgtcccctctcctcataggggggcttgtatttatacccatagatgtccctttgtccaagtagaactagggagaccaacatggatacaatccaggtagtccttgtcgttttcatatagaactctgttcgtccttccttatctggaactccttttatatacaatgtatgattccgtataagacatgttatgtggtaggccctaccgagcttagtcaactactattaggtatgtggtatccataaccatgataggggtctccacgcgtcctagccttatgtgatcatggctactatagatacaatcgttgctcatatcatggatgaacaaggagatatcaagatcaagttctccatgtgctggaatccgatttagccacatgctacactgctgacttcaaacggctgccaaatctgcatacgacctccattttcagcccatgagtacttgatggaaagctctcggagtcctctttccaatggatccagtctcaccaccaaattccatctaagtcatccgcagatgaagaaacaaggtgatgcgtcacctgttatgggcctttgggcttataacttcgtttgggaccccggtccaagtgggacccaagtggggtgcgccccaaccaggtggagcacgaccctagagtcc

SEQ ID NO: 87774 - DNA, 639 bp, Oryza sativa
ggggctcctggcgtcatcggacaagcgggcaaagggccaactccggtcgtcaggggccttaggccaccgttcggctcgggggcctcttctccctgctctctcccgggtcgaatcggtacagggttagcctcagggtcagagggtgataggtgcggcctccccgcagtggcctcggggccttcctgtgggtcgggggcacccggcaccgtctgacaagcgggcagagggccgactccggtcgtcaggggccttaggccaccgttcggctcgggggcctctcctccctgcctgctctcgggcctagtcggcacagagtgggggtgcgcagaatgaggattgtcctcatcgcgctccacaaccaacgctgcactaactacttggggggtcgctgctaaataaagagcaggggctcatttggctccggggcgactagaaccgggggagagccgagatatgcctttaactgagtaagggcatgttcagcttcctccgtccaagtgaacggccccgagcgcttgaggagcttaaacaagggaagcgccttctctcccagccttgatacgaaacgacttagggcggccatgcaaccagtgacgcactgcacgtccctaagtttgctgggggggcggggctgcagga

SEQ ID NO: 87775 - DNA, 503 bp, Oryza sativa
atctaaaaagctaattactttatgtccagaagcatcattaactaacatgtcggctataggcataggatattcatcttttggagtagctttatttaaatttctaaaatcgacacacactctaatcttacccgtatttttcttttcaacaggcactatattagagatccactccgcatatcgacaaggccgaataaacccagctttcaataaccgatcaatttcttgtttgatacggtcatacatatcagaattaaaacgtctagggggttgtttatacggccgaaaaccagatttaataggcaacctatgctcaactaaatccctactcaaaccaggcatctcattataactccaagcaaagcaatcaacaaattctctaagtaatttacataccttgctcttctggtcagcccccatgtttgcattaataaatgtaggtctaggaatactcccatcaccaatatcaacctcctcaagtggatcagctgacgaaaacccctgac

SEQ ID NO: 87776 - DNA, 635 bp, Oryza sativa
cctgctttcagtgtcaagcaaacgacggctcaaataagccacaacatactccttcccatcgtcttcttgcgtcaagaccgcaccgatcaccctttgttgtgcaacaacatataatctgaacggcacaccggacttgggcgcccgaagcaccggaggactcaacaaatatcgtttaatgttattaaaagcctcccactgttctgcccccagctaaattcgttttcatgtttcaaccgaagcaaaggaacaaacgattcaatctttccagcaaggttagagatgaatcgtctcaagtaactaattttccctagcaacttctgcacatctctcttgcatgtcggctcttttaactttttaattgactctacctttttaggatctatctctatgccctgctcatgaattataaagcctaaaaacttaccagccgacacgccaaaagcacatttgagaggattcatttttaatctataccggcgcattctttgaaaagccagtcgtaaatcggccaaatgactatcaaacccgtccgatttaacaaccacatcatctatatatacttctacaacaatgcctaacaaatcatgaaaaattaaattcatagcacgttgatatgtagcgccggcattctttaa

SEQ ID NO: 87777 - DNA, 685 bp, Oryza sativa
ggtaccctgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctggggatcctctagagtcgacctgcagg

SEQ ID NO: 87778 - DNA, 1154 bp, Oryza sativa
acatatatccatggactttgtagaagggttaccaaagtccaaggggaaggatgtgattttggtagtggtggataggttaaccaaatatgcacatttcatagctttatcccacccatacacagtggaggaagtggtgcaggtgtttatggataatattcacaaactgcatgggatgccgatagctattgtgacagatagggacagagtttttactagcacattctttcaagaagtgttcaaatctcaaaaggtccaattgaggtttagcacagcttaccatccccagacagatgggcaaactgagagggtgaaccagtgtttagaatcttacttaaggtgcatgacatttcaagaaccacaaaattggtgctcttggatagctttagcagaatggtggtataacacaacatatcacacagcaatacaaatgactccattcaaggccctttatggatacagtccacctcaaatcagtgaattttctgtcccatgtgatgtatctcaagaagcaagggtaaccctggaagagaaagagactatagttcagaaactcaaagcaagcatggaagatgcacaaagaaggatgaagtattatgctgataggaatcgaacagagagaaagctggaggtgggagatatggtatatctgaaactacaaccctatagacaaaatgcttttgggatcagaggatcattaaagttaagaggcaaatactatgggccattcaaggtgctagagaaggtaggtgctgtagcttatagattgcagttacctgaagaagctgctatacatccggtcttccatgtgagccaacttaaaaagcacctgggtactcatgctgtaccaatgccaaatttaccggcagtgggaccagatggtcaaatcaaaacagagccagtagcagtgctgcaaaggagaatgattccaaggaacaatgttgctgtcactcaatggctaattctgtggagcaatttaactccggctgaagcaacctgggaggatgcttcttatattcagaaagtgttttcaaattttcaaccttgaggacaaggttgggcttaaggggggagtaatgtcagactcgtaagaagaatggaggaaaatttagaaagttcagagtttcgggtaactgaagatgcaaaggagggagaaa

SEQ ID NO: 87779 - DNA, 561 bp, Oryza sativa
ggcgtcgacggccgccgcgatcggctggccgcttcccgcgcacgccacgtcggtgcatcccggctggtgcgcggcccgcgcggcgtaccgggcgacgccctgcagcggcgttgtgtacctgcacggcttcccggcgtagttcccgatcatcgccaccgttgcctcggcgtgcgggcccacgacggcgacggcgcggcgcgccgtcgccggcgacagcggcagcgcccgcccgtcgttcttgaggaggacgatcccctgccgcgccgcctccaccgcgagctcctggtgcgccgccgtgcacacgtgctgcgggcccaggtgcccgaacggctgcgccgccgggtcgccgtcgaacatcccgagccgcatctgcaccgtgacggtgttcgtcaccgcggcatcaatgtcgccatcgccgaccttcccctgcgcgacggcgccctcggtgtactgcgccaagaacgggccgcagtcgaggtcgagccccgcccggagcgtcgccgcgacggcgtcctccctggtccgcgtgtagtgctggtcgctgtagaacacatcaaccga

SEQ ID NO: 87780 - DNA, 576 bp, Oryza sativa
tagctggtaaagataagccaactcttccaagttccatccatcttgcattttagtattactactgccaccatagactggaaacccttctacatcattgagaaattccaatttgccaatcccttttggaacttgatatatcggtgaataattgaggccaaggcgccttaaattgcacagttgggtgatcgctgaaggaagactgtgcaaagcaacactcctctccaagttcaatatttgaagatttttcaggttgccaatggactctggaagacaagatacattggtaccatcaagatcaagcaaacgtagatggatcaaattcccgatgcaacctgggatgcttggtacaaatgaatcagtcaaatctaaaacacgaagataaggaaatctcttgaaaaatgaattatcaactctgagtgttttctcataagaagttttccatgtccttactttatattgcacctcgtccatgctaggtaacattaccatgttcttatctgtgacgactgaaacacgtcgaagtttagacacagtgttacctaccaatgattctgggtttccaacaaaacattcttc

SEQ ID NO: 87781 - DNA, 7202 bp, Oryza sativa
ccttctcgtcgcgcgtcgcctcctcgtctcgtgcagctgcctcgcctcgcaccgccagtcgccacccagccgcacctgcccctgcgccgccgctcacctcgccgccgtgcttgcctctccaccgccccgcctctccgccgccgcctcgccgctgcctcctccgccgcgctcgcagcctccgtcgtcgcctggagaagagagagagccccgccgctcgcctcttcgccgccccacctcgtccaccgccacctcgcctcgccgcggcctcctccgccgcgctcgctgtctctgcagtcgtccggagaagagagagagagagtgtgtgtgtgtgtgtgtgtgtgtgtgtgtgtgagagagagatagaagagatagaagagagagagaatgatacgtgggttccatattttttttataaaatagaatgctgactggactgccacgtgtacgtcacgtagaccaaaaccatcgcggattgggtcgaggggggtaattcgtccggtttacatagttggagttgaagaatgtccggttttgtagttcaggggagtaattcgaacgaccgcgatagttcggggagggtaattcgtattttttccttttaaaaaagtttacttttgagagtttcataaaaataaagacgcgtatattatggaaggatatattatcaaataattagaatgggtgagacttcaaacacaaatcgtctaacctagaaacgctcagggctcttccggctagctcacaagcgtttctcttcagcagaaataaagattaacgagaaaatataagttgggattgagatgagaaaatgagtgagaaattaaataagaactatcctagtcagatttgtatatatgatttatatagaaaagtgaactctcagaaggacggaggtaatacatatttttgaaagtttagtagaaaaccaaagttaacggaaaaataattgtaattgattgagatgagccaatgaggaaggaagtaaacagaaatgctcgatagggtaatagcaagtttatgagtctgatcttagaatttggatcagattagaacatgtccgttccttctatcaagcagtgatttttcttcagaagattttaacaacttgagtttgatccagtaaagatatactattaacaaaatctgcaccatttattgcatttacagttaccaacaacatgaacacacgcacaatgcatccagctacacgtcggtggcgtaaacgatctctctctttacacttcgcaagcaacaaactaaaataaaataattgaaacagatttacaaattaattaaatcatcaacacttcacgggacaatgagctaagcaatccgataggtagcacgacgacggcacgagccacgccttgacgacacgattcctctccccctcaccaaactcccaagcttggcaatggcaggtcgtcgtcttcctcctcagatcgtgctccaccaccttccatggcgaccacgtgtacaccacgtcctcctcctccgggtgcatcgccaagaacctcacctcgcctcctccatgcgcgaggtgttccaccttgacggcatgcttcggccgccattggtcgtcgtcgtcgagctcccagaccttgagaagctcgccgtcgcggaagatgtagtgcagccggccgccggagtgcgcgacgtgggcgtcgccgccgtccaccggctcggggaggtcgatcaccgccgccgtggatgagaagtcggcgaggtttagggagacgaggcagtcgggttcggaggcgaggatgtagaggatgccgtcgtggtagtgcatcgagccggagagcgagctcgccgggacgccgccgaactccgtgtcgcgcgccgtccacgcccacgtcgccgatgagaacacctccaccgccgcgccgcggtcgcgccacccggtgaagttgaccacgcggtagtccggcgaggtggacgggtcgaacgccagcacggacagcgtcgccgccttcgccggcgccgggagcgccgcccaccgcctcgtcaccgggtcgacgacgaagaactccggcgtgccgggcgatcgacagagcagcaagccattgcagccgtcgcataccacaacgccgccgcgttccggcaagaacccgaggtggcagtcctcgaggcggtgaccatcgttgccgtcggacgccgcgcacgcgaaccgcgggccacctccacctccgccgccggcggcgacagcgtcgtcgtcggggaagtacacggtggtcatgagcagcggcagcctgcggcggaggtagtcgtcggagacggcggcgcgccaatccttggagacgcaggcggagcgcgccacggatttgaacgggagcctgacgattatctccgaagaagatcgtcgccgatgagggcgatctcactgtcaattgaacaactcttcagaattgccatctcttactatctctctgttcgatctgtgtgtgttctgtaacgaattgaaaggattacttgatcagcagcaagtctctccgagtaaaatgcaactgggcgtgccaattttatactactacttcgtacttggttttctagattggggtataccggtgacgtgtccaggtcgaagcgctgcgtgtcctgccagcaagctgccacgtgtccctcagtagtagcccagctaaaaatgagacttgccgggtggaggagcatacctgtaaggcggtaaccgtcagatctcacgtcgcgccacgcgtatagcacacatgcatgcccaaatttggccggtttccaccagtcaaaagttataaaaagaattccgagaaaagaggggatagcgcccgcaatccagtccctgccgtcggttgttataggtcgtagcggtttattagtaataaaaaaagtttatgataagttaaaaaaaaagtttatgattatttttataccccctccgtttctaaatatttgacaccgttgactttttaacacatgtttgaccgttcgtcttatttaaaatcttttgtgaaaactatatgtatatatataagtatatttaataataaatcaaataatataaaaataattaataattacttaatttctttaataatatgaacggtcaaacatatttaaaaaagtcaactacgtcaaatatttagaaacagagggagtatatttttagccgcttagaaatctatatccatatttctatctctactattataaaaattgaagatgcttttactaaaatttggtccctcaagtttattagctaataaaccgttttcaattcctactcacctcgttgttcgtttcaaattcatgtgcgtgttcatcatcgcctgcgtgggagtcccgttcaaattttcggcgtcgttcgtgtatgacggggtcctctagggagtagggacgcggcatgcaggcacatgcaagccttcaactgcatgccatccagagatcaagccactcacacgttcaactgattttgcatgttcacaagttcgacttgcatgcatgcggctttgcacctattcaaaggtaaaaaaaaagttcaaaattgaaacaggccaaaagctaaaaatatatggatatttcatagtgtgtgtgaatatttcaggatggatccaaaattaaaaataactaaattactataaaatcataaaaaaacaactatatgaaaaagaaatatgcaacctaacaaacacaaataattttgattacaaatttagtactcgcagtacgtacaagatattataattttgttttaaattcgttcatttttgaaaatatagtagcagtcgtataagaaatttcttttaaaaaagttaacttacatgctaactttagatgatcgggctcctaattatagcttatgatttcatgggaaaaaaatatatatccaagcgaattcttataatgaatttcaccttaactaaaccatataacaataataaaattaaaataaccttcacctgttacagcgcacgggtattttttttctaagtcaatgtaaaagtttcttaaaagcaaatttaaaatttgagattttcttttcagcaaacgatggggcccggagagggtgtcgtggatgagcatgcaccgccgttgtgatcggcaatccaaaagctagtattggaatttggggagagagagacggcgcccctccaaaaattcattttagaaaaaaaaaaattgtaaacgtgttaaggattaaacacgaaaccttagaattatgggtggcggccggtgcaaacgtgggtttggatgaaggcagcaagggatcgaagcacgggaatcgtgggaagccatgtgcgttccggtgccgtgacatgacatgggtagtgcttgctacagcgagcagagcacgagctgccgctgacttggaacgcgaatgcgtccccaaatattcaacgggaaaaccctgcaattaagggagagggtaatgatcattacgtgcaccgatcctaacccactttaattaattaatttcttcccgctcctgacactggataatactactccctccaggctgataatacttgtcgttttggacaagggtgaaatctgtcttttaaatatggtgactacatgtgtagattagtcttaaaaagtattttaataagatcatatatttgttaacaattttatatatattataataaaaaataatggtcaaagttttttttttgataccgtgcccttgtccaaaacaccgatggtatggatggagtaagcatgactcctgtgatccctatccggtcagctatacttaattagcgcgttaatcgcatcgtgcaagcgacatactcccccctccctccggtttcattttaattgacgctttggacaataacatactctacaagatattcctttgaccttatttttctattataatatatacaataaataaatacatgtttatctttattatagtgttttgaaagacaaatctatatatgttttttctagtttttttaaacgaaatatttttaaagttattgatggttaaagttataaaagtttaacctcaaccttatccaaaacgtcaattaatatagaaccagagggagtatatagctcttgcctacaggttgattatatcattagggcatccacaatgtactccaaagtggtccataagcaatataatatttgattcagccacctagcaacattgtggaactagtccataggaaagaaataacaaaaactacccataagcatatgggatgcccatagagaataaaatatattatttgtctctatctcttctctcctgctaatactatttgttatccatatacattgagaatgttataatagttaaaattcatatatgtgggtctcatctctatggactacttttgccatatacattgttgttgcccttataagcgtaacaacttattaacgatgaaaaatgatttataaagtaagttttttttggtatattttgcagaataaactgaatactgtcatgggcttagattcttgggccgcttgtcaccatagaaatctcggggaaatctcggtttatgactagtgagggtgttcggagaataaaattccgaacctccagggatcggtgcattgcttaaaatctatagcaaagagtagtactagtcctactcaatgacgacgtgattatacgcaccgaatgtctgaattccattttgtggagctcccttatgaatgtatttgctctcattgaatctagtcacattctgaatctcttttcctttttccagtgtctgatcagtctttagtgcaaggatctgaagcattctgcaacaaagttgagaaaatgcatttgttctgatcaatcgtagagagatctttgttcttgtttgctttcttcatctgacgagtgtttctgaacatcttatgccgaccatatattagagctctttaatttgtttcatgttcagtacgttctttgttctgaattttttttcccccggtgtctgatcaatagcaggagactagatagctctttgttcttgtttgttttcttctcctgaccagtgttttctgcacattatggcacagtatggtgctgtatgttgattatatacaggttgagtgcaacctgcatatagccgtatgcagttatgccgattgggcgatatccaagaacgagctaatcaccaatatcttcaggagtcaggactagcaaatggtaaagcagcaattttagccattagccaaacggagcctcaagccgtcaccaaccgttggattaaaaacgtgcagctgttgtacatacaggccgcggcccaccgatcagcccagcttactaaagcccatccaggactgacagcccaaaaaagcctcacggcctttgcttggtctgacttcgtcagacacgagattggcaaaaacgagaggtcgccatcgcgtcgaacgtagaatggcccacatcgtcttcctccgcgcctccgccgccgacctcaccgccggcaagccgccgctggcgggcgtcccggcgtccgcgccgctctccgcggcggccgcggccatcccggcgtcgtccgaggccgccgtggccgtctggcgcgtcgacggcgcctcccaccaccaccaccaccgggcgcccaccgcggcggccaccgtcgtcggcctgctcagctccatcgacgtcgtcgccttcctcgccaaccaccccggcggcgccgccgccgcgttcatgacccccgccggcgacgtcgtgccccacgaacacgccctcgtgcgccaggtccagcccgacacgaggtcaccatcaattcatgatctagatatcctgcattgcaatgcatccatgagataattgcgactatggccttgtttagttacacggttcaaaagttttagcgtgtcatatcaaatatacggacatatatttggagtattaaatatagactaataacaaaacaatagatttcgtctgtaaactacgagacaaatttattgagtctaattaatccatcattagcaaatattccctctgtttctaaatatttgacgccgttgactttttaaaacatgtttgaccgttcgtcttattcaaaaattttaagtaattgttaatactttttctatcatttaattcattattaaatatacttttatatatacatataattttacatatttcacaaaagtttttgaataagatgaatggtcaaacatatgctaaaaagtcaacattgtcaaatatttagaaatggagggagggggatggattctaatagctcgagtgg

SEQ ID NO: 87782 - DNA, 705 bp, Oryza sativa
tcctgcagcccattaattagctacttaatcactactagtgaatatatgccagctatattttgttttgatttattcaggtcttgccctttttttagtgaaatcgacggaagaaggagatgacgtcgttgtagacaaggtccttggcgcagacgccgatgacgaagtcggcgtgggcgagctggggaaggtactgcacggtgagccggtcgccggcgtggccgccgcggcggaggtcgtcgaggaggagggcgacgtcggcggggtcggacagcgagtcccggccgccgtagctgaggaagatggggaaccacgccgggatcgccgccatgtcgtacgccggcgggtcggcccccttgggaccccccgtacctggccacgttcgcgtcggcatcacgtagtcgtacttggtcagaaccccgtctctcaccgctgcatccagataattaatatcaaattatcatcaaattaacatgattggggttttgttaattagagggtataagatgactgatgagactagaatttgattggtttactttgagcgagatggatcaaggtttttgtggacgttggctggggctcgtacttgatgaagatgtcggctgctgaattgttcagacaatagttttttttttcccctttggaaaccccaaatttttttgcatgggagttagcatggagtgaaatgtaatgtagagcaaatta

SEQ ID NO: 87783 - DNA, 768 bp, Oryza sativa
gacattgccccacttcattcggaagggcttctaatctatccggatcgatgaccttctgcgaaattccattcatgaatgcacatatctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttctttcgtaccgggtggtttgctgcaaggaatcgacgatgacccatgtatacaaccttcctacagtggt

SEQ ID NO: 87784 - DNA, 1355 bp, Oryza sativa
ctcgcggcaacgtacgttgacgtgttcgttctcgctctcgttcgttcgatcgttctcgttctcgttcacgttgtcgcggcaacgtacgttgacgtgttcgttctcgctctcgtttgttcgatcgttctcgttcgttaacggcggtgtggcggcatcggggcggcggttggcgcggcggcgtggcggcggcggcggcggcgtggcgacggcggtggtggcgtggcgttgcggggccgtggcggcggcggcgtggcgtggcgtggcggcggcggcgtggcgttggcatgcggcggcggcgttgcgcagcggcgaaggcggcggcgtggcgcgtcgtcgtcgtggcgtggcgtctcgtggcgggcggcgcgacggagagagatcgagatcggagagatcgagatgcatgaagggagatctggcggcggcggctctcaccccagagatgcggcggcagcggaggaggtggaggcggcggcgaggacgacgagctcgagacgacggcgagatacggcggcatcggcgcggggatttgccctaggcagtggcggcgaaggagagaggccgagagagatcgatcggccgaaaacgtctaagtgttggtgaagaagacgagggcgcaccgggaatatatatacccccggatctttacgcccggttgttctcaacaaccgggactaaagatatctttagtcccggttgttctcaacaaccgggagtaaatatcttttcccgctatttcgaaattctttttaaacccggttagggttaagaaccgggactaaagattatagcactgcatatgattttcgcttacatatctgtttataaaatagaagttaatgcattaacattatttaaagtacaaagattaatgacaattacttcgaaaaattatttttgtctgtaataaattaagtggataaatcgtaataagcaaatataattaataaaaattcaaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattg

SEQ ID NO: 87785 - DNA, 501 bp, Oryza sativa
actatagggcgaattcgagctcggtacccagcaccagatcagggcacatggttgcttacgtgagaccgaatcaagagcaacctcacggtggcccttctccatggtattgtgcaagtgatacaaacatcagacaagtatctctagaagaagttctcaagtgcgaggcctcccttttcttctacgagaggattggaggctaacgtccaaggaagtaaattggttagattagcaaacattctttggatggacaaagatccattcagtagacgtcatgatcaagtccaattttgttgctttggctgagtcattgtaggactgcaaatagatcgcattcataatctcctttttgttcatgaggaacgtacttcttttcctggaataagaatgaaggaataggacatgtgccatttgtaaatgagcaggactgtactaatgattgataatgctttacaataggtctaaaatacagaacgatattacttgatatatcttgagctttag

SEQ ID NO: 87786 - DNA, 601 bp, Oryza sativa
aagctgcaccatcgcagctgccacagtgtgcatagaggcccaacacaggttggcctttgaacggctgtacggaaaaggttctttcccatgcaaagctaaagtgcctaaagaactgaagaaggcctgctaccgtcaagggatttggagcagcgaggaaggggcctggactcccgacgttcttttaatgataatggagaaaggcggtatcctcacgcaacgagtaccgaataacatccagcttgcaattgatggatttttttggctagagagaaatgtagcttttggaaaacttgagtttatgcgcctgctgtatgcctatggtcctcttctcagcaccctttggacagatgatggttatgcacaaacgtttggagaccgtgtctacagagggctacaaaaggatccagattcgggggaccatcattgcgttgtctgttttgcataccgggttgacagcaggacaaatgagctctacgttagaattatggacaattgtgcagatgatggacctatcagatgggtattatttgatgtgttcgatagcttctacgttccactgataaaaaaatcctatagagcctcatgaactacggagaaagaa

SEQ ID NO: 87787 - DNA, 604 bp, Oryza sativa
cagtgcaaaaccatcggtgaacacggccttcctgaaattctcctcgacggcaaagaaatcgatgcacttgttcttcagctccgggcagttgtacatctcggcgcaaaccaagatcgcggcgaccgaatccggcgtcatgttgtccagcaacctctgtccgcacatgatctttagcctgtccagcgcgtacctgtcggccatggcgagcaggtgcttgaagaacacgttcgtcgacgaggagccctgatggagtttgccggcgtctgcaggcaactcgtccgtgtagatgaatcggagcagagctctgaatatcgccggctcgattccctgcagcgtaatgcacgacgacgacggcgaggtggattcggacttgcagccaaagagctccgtcctgaacaccggcgaccgggcggcgagcacggcacggtgagcggcgaacctctcgccgccgccgccgacgacgacgaaggtgacatccgcaccatcctcgctgtccagcaggccgccgagatggaccccgatgttcggcggcggcagcggcaataagccgccgtcgagatggccgccggtgacccccggcgacggcagcggcacacggttgccg

SEQ ID NO: 87788 - DNA, 575 bp, Oryza sativa
ccgtgcgtattgggtaaaaccattttgcaatatataagtgtgttcacagaattcctttggataaaatttggagcaccttccttcagacatgcatggtgaataggaaattccaggaccgcaaggcccatggatcataaaagaagtaacagcttcaaatcctattggatcaagtgtaggatttggtagttgagctgaaatacgtaggtcaaccttttcagcatctagaggttcttcttttgaaagccaaatgattatatggacatgtggtagtccacgcttttgaaattctacagtgtagacaactgtacaaaagggttaactattatatggatttgatgaacaatatatgtatctaagaattttgattgaaagttgttttggaaattacctgcatgtatgggaccaaaaaaaatatttttttaatgtcatccattaacatattcagcttcattttgaacacacggtcaacgatatctggacgatcttgaagttggtgtccaggtgctagagcttgtagaatttttggccaagatgcatttgatgtgaatgtgacaaaaagatctgggcaaccatac

SEQ ID NO: 87789 - DNA, 555 bp, Oryza sativa
atattgaatttgtaatccacctccagaacccatattgaatttgttaacttctgcgagctccctttcaaatcatttcttgcagcatattcatcgatacaattccatgtttgctatgacttcaatgggggctaaaatcattgaatccatcaacgacggccatggaccatatgtcttcaaaattagtggatagatctgccacagagtaggctctttaataccttcacaaggtcgtcggccagaatatgctcagctatacatcttcgatacagaaaatgaaatctctaacataatcaacattgcttcttcttctcgcgactccttccatgccaatgaagaaattgttcgctctctaatagaaatgttcgatacacacaatcccattgtgaagttattccgaacagcaagagaaagattaagtgaaaatgaatctgatcattacaagatccgactatttggctcgacagatgcacatggagatatatacagtgcaccagttgcagcagaggttgtaggattagttgttggggatattggggtgactgatattggtcggga

SEQ ID NO: 87790 - DNA, 609 bp, Oryza sativa
ccacatgttcgacgtcgaggcgcgcgccgccgccgccgagatcttcgccgagcaccgccgcatccgcacgcagcttctcgccaccagccaccgctacagggcattcatcctctcctgcctcgtcaccatcaccgtcagccagctcggcgccctcgtcgtcgccctctcctccaaggacggcaagagcttcgccaactccggcgacctcctggtaacaccacacagccactccgccgccgccgcaggcgtagcaatcacgacacgatgcttataccctcgccgtctcgcaggtcggctcgtcggtgcagctcagcggcttcttcatgtgcctcttcggcgcggcgaggatcacgcacagagcgcaaaggatcgtgtccatcgcgagccagtggcacatgagcatggaggccgtggcgcaccacgccaagtcggcgccattgccggcggcgcccagctcgtcggccagcgacgtggacgcgccgcaccaacccgagctcgggacgacgacgacggcggcgtgcgcctacagaagcagacacgccctcggtaacaccagatgaaccccactcgcgccattttttttctgagaataaattcactcggtcgcgc

SEQ ID NO: 87791 - DNA, 547 bp, Oryza sativa
aaaacccaaggcgtatatgattctatatgggtagtagtggatcgactaaccaaggtagcacggttcattcccgtaaagaccacctatgaagggaccaaactagccgagctctacttcgctaggatcgtgagtctccatggcgttcccaagaaaatcgtatctgataggggaagccaattcacctctcacttttggaagaagctccaagaagagctgggtacccgattaaacttcagcaccgcgtatcacccgcagacagatggacagaccgagcgtctaaatcagatcctggaagatatgcttcgcgcatgtgtcctagatttcgggaagacctgggataagagtctcccctatgctgagttctcctacaataacagctatcaagccagcatacaaatggcaccttatgaagcgttgtatgggcgcaaatgccggacaccgcttttgtgggaccaagttggggaaagccaagtgttcgggactgacatcctgagagaagctgaagctaaagtcagaaccattcgggataatctaaaggtggcacagt

SEQ ID NO: 87792 - DNA, 783 bp, Oryza sativa
aggccggcggtgtagatgacgatgcccatcaacggtggtgtgaccaaccgaccgtataggcgaggacaccagtcggcggcgacggaggcaggccggtggtgaagtcgtagacgcccaacagcggcggcataataggccagccgtgtaggcggaggcaccagtcggcggcgacggaggcaggccggcggtgaagtcgtggacgcccatgaacggtggtgtgaccaaccaaccgtataggcgaggacaccagtcggcggcgacggaggaaggccggcggtgaagtcgtagacgcccaacagcggcggcataataggccagccgtgtaggcggaggcatcaatcggcggcgacggagtcaggccggcggtgaagacgtagacgcccaacagcagcggcataataggccagccgtgtaggcggaggcaccaatcggcggcgacggatacaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcatagacgcccaatagcggcggcataataggccagccgtgtaggcgaaggcaccaatcggcggcgacggatgcaggccggtggtgaagacgtagacgcccaacagcagcggcataatatgccagccgtgtaggcggaggcacca

SEQ ID NO: 87793 - DNA, 627 bp, Oryza sativa
caacgttcacttcttaagccgtggctttatctcttcgataactgacggaaaactctgcccaagatgaaagtagtccttggttaccgctacctccatgaagttgtctttcgtcaccacgagatctatgcacctgttcttcagctccgggcagctgtgcatctcggcgcagcacagagtcgctatcaccgtctccactgacacgctctcccacagcttctgggcgcacatcagcttcagcctctccagcgcgaacctgtccgccgtcgcgagcaaacgctgaagcagatcagttgtactcgtcgacgaagagccttcgatctgcagaacgtccgtgtacacgaagtgtagcagagctctgaacgtcgacggctcgatgtcacgcagcgtgacgcacggcatggtggcctacggcatggacccgaggagcttcgccctgaacaccggcgagcgcgcggcgagcacgggccggtgcgcgtggaacgtctcggcggcgacggcgcttgccaccatggcggcgagctggcttgccaggttggacgggggcacggcgacatggtcgtcgccgtcgtcgtcggtgcgcagaactacgagcccacatatgaatgtgaacataccggcgagtgattc

SEQ ID NO: 87794 - DNA, 569 bp, Oryza sativa
tgtttaagggtacctaccgaagaagctaatctcgaacagatagaagtccaagaggatctgacctatgttgagaaaccaatccgtattttggaaacagatgagagaagaaccaggaatcgagttatccgcttttgcaaagtccaatggagtaatcactcggaagaagaatcaacttgggaacgagaagatgaattgaagtcagctcatccgcatctgttcgccagttcttccgaatctcgaggacgagattctgtttaaggggggtaggtttgtcacaccctgaaaattcaaaatatataaattgttgtttaaatggaatttttagaatttattgtaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaagggttttaaaaagtcttttttggctttgggccgaaagtcggccaaaaccct

SEQ ID NO: 87795 - DNA, 907 bp, Oryza sativa
ttgcaagatgtttgcaagcacatgttaaaagttacacctttcgaaaccatcctgcagagacctgtggacgttctccaccgcaaaaagatgtcagcggcctggttcccatacactgccatcgagaggttgtggtgtcagctagaagagatgcaaaatgctggccacagcgtggatcagtgcgacaggctcaagaagttgctacatggatctctgattagtcacctgcagcaagttagtactacatctaatggcttcccctttcaattctggatttgttttctagatgtctcctgttgaccacaatctgtttgtttatgggcttccaggttgtggttgattcagatgatgtgctttcatcgcttggaggagggaaaggaatggggagccaaagcaattgagttttttttttcttttgttccttagtgagcgagcaactgagatcttgtgagccgtggattagtgtcagcttactgttgtactgtcatgtgtatgtaatagttgtatggctaatgcctgtgagccatgttcatcacctgtttctgtagacaagggcaattttccatttgtaagtccttttaacacttatgtgaaaaatgcctcgctcctttgaagagtaccaggctaccagcagacacataaagtttcctcgtgcccttttgggtttgtttgatatcgccgttctcggagctcagcgtctggagttatgagggattattttgtacggtaaattatttgataggatgttttctgaaaatttccgtcacagcgttcttatccctcgtccaatccagacagccaaaggcggtcggagactcggtgtcgtcttctcctatcaccctgggaatgactcaattacactcaaaagaatggtcctttttgcaaatctgatgtatgaaaaaaattgtga

SEQ ID NO: 87796 - DNA, 705 bp, Oryza sativa
tgcgttcttaaaacttaattcatttgacaaccaaagatgtagcatatatttagttggatgcttcacagctcatttggacgactgggatcttcttactaaatatgtctgtacaggtatcatttggttctgaattgagtaatcgtgcaccaacctttgatatggacctgtctgattttatggatggtgacaaaccaatatcctatgataaggccaaagaatatttctctcaggacccatcccaaaagtaagaaagatcgtttgttttactctataaaaatcataacttgtcatgcatattcattcttggttctggttcagatgggctgcatatgttgctggaacaatccttgtgttgatgaccgagctaggtgtggtcttcacagacagcatgagcattctggtaagctttgatcctttctgttttcaatcagaatgcagtaatatatgtaaaattccacctctttgtccagtttgtcacctttctcatattggggagataaagagatattcagaactcaaaaggaatattgtttattagtcacaaaaagaaaacagcatctttcacactttctccttccacattctaatcaatcaagtgtttccttccacattctaatcaatcaagtgttctaactcgaatgtttgtattggtcattcatgataattttatttgaatcctcaggtttcttcatcagttcctgaagg

SEQ ID NO: 87797 - DNA, 514 bp, Oryza sativa
ccgagaacgaatatggttgattgcaaaccggtaaatacacctctgtcaactacagaaaaattgtctttgcatgaaggtgatcaattaggacctaatgatgctactcagtatagaagtatagcaggagctttgcagtatttgactttgactagaccagatatatcctttgctgttaataaggtttgtcaatttcttcagacacctaaaattgttcactgggcagcagtcaaaagaattttgagatatttgaaatacacagcaagtctgggtataaattttgatagatcagtatctcacttgttagtgcctttacagatgcaaattgggctaggtgtcttgatgaccggcggtccactggagggtttgctgtttatcttggctccaatcttgtgtcatggagtgcaaggaaacaagctacagtctccaggtccagtacagaagcagaatataaggctttagcaaatgctacaactgaggtaatgtggattcagacattgttggatgaactcgatgt

SEQ ID NO: 87798 - DNA, 1319 bp, Oryza sativa
tggtccttcatagtgtatgccaggttttatgactttggcaaaatttcagatatgaagctgtttacgcgagagatattccagagatcataaccggggatgcatttttggagaagtatggagatcataatgatgcagtaacaactgttgacccaaaacgatcttactgtgtgaaggctcctactagacatcctatatacgagaacttccgagttgaggtttgatatcataaaaccagaatatctacacctctcgattcataatggctgttgatgagatccctgcatgttgttgtctgatgttctactgcttttgctgctttatcctcgttgtttgtatttttaaactttaaaataattctttgagatgtttgcaaatcagaaaactatcttgagagcgcatggttttcagaaccagctttattttttctccataaagaatagcttattcctttcactgatatttttgacacttgttatgcttctcacgtgtaggccttcaaagcattgctaacagcagccaaaacagttgagcaactttcggcccttggagaattgatgtatcaggtatctgtattacaaatgaaagccagcactgtacatgttgattcacaaaattagcagtcagtggcactgcattgacccttttgttttctggcagtgccactacagctacaatgcttgtgggcttggttctgatggaaccgacaggctttgtaatatggtacaagaagtcagcacaggaagacctcacaggatggtggtcctagttatttgggtgcaaagataactggtggaggatctgggggctcggtttgtgtcattgggaaaaattgcttgaaaagcagtgaagagatttttgaggtattttcgacatcgttttttattgtcagttgtacacaatggatgaccataactacaaagatccaagataaaccctccaagagagttgtgattcaccataatgtttgcattttcatggtattgcatgctaacaaaatatcatttgttttcagattcagaagagatacaaagctgctaccgggtacctaccaattgttttcgagggctcatctccaggtgcaggcaagtttggatacctgaagattcgacggcgatccacatagccatcaatcagcctaactgaagatttggctgtattttaggtccacacaaacatttgtcaggaacctgaatattacctgttcatatggaacacatatcacatcatcccattatgtagtagtaataagctctctagttcatgcaataattctagtgattagtgcacctctggtgcagacttccattgtgtaagtgcag

SEQ ID NO: 87799 - DNA, 881 bp, Oryza sativa
caatatttaaagattcttcaattctgcatttgactatcattttagtttgtttctgtaactttgcttgcatctcctcttgataccattgaaggtaggggttcctcctgcatgtattgtggaatgatatattgacatatacctggaaaactctgaatacatgcatgttctatagaccttcctacaattatttttagatagatgaataaatattatgtctccttgtaagttactaagttattgattgatttgatatatttaaaacataaagaaagtttcttttggcatatgcgattgacattgagatggtccaaattaccagatgcccattcgagaggcttgtcatgttgctattcagagaagtaatcctatgaagcagaagctatggaagcatacacaagctaggcaactagcaaatggcagagcagtgccgttgttacaaattgtatgttatttatcactaactctctaagcatcttcgcttaccttttcttatccttattatgcgttcttaaaacttaattcatttgacaaccaaagatgtagcatatatttagttggatgcttcacagctcatttggacgactgggatcttcttactaaatatgtctgtacaggtatcatttggttctgaattgagtaatcgtgcaccaacctttgatatggacctgtctgattttatggatggtgacaaaccaatatcctatgataaggccaaagaatatttctctcaggacccatcccaaaagtaagaaagatcgtttgttttactctataaaaatcataacttgtcatgcatattcattcttggttctggttcagatgggctgcatatgttgctggaaccaatccttgtgttgatgaccgagctaggtgtggtcttc

SEQ ID NO: 87800 - DNA, 10319 bp, Oryza sativa
tacatacttaaaagaaaggatgtatttaagttgttgcttgcactaattgctgtatcttttcttgttcttgaatagtgcattttccattaaagtatttttctatctttaggtcaaccatctaggatatgggttggtgatgctgatgatgatcaagagttgatttttttggctgttctgcgtcaaggcactgtggtatgtcaagaaaaatgtctcaccactaaatttacttggtcatctggaatgcactgatttttcatgctatgccttttcacttgtcagttgactgacttataaaacacgataacagaacctataaaattatgtctgttaaaaatggatacatgctttttgtgggataacatgggggtgaaccatttcacttgtcagctgactgacttataaaacacaatgacagagcctataaaactatgtctgttaaaaatggatacatgctttttgtggagtaacatgggggcgaagttggtacatattatatgcctaatatgggtcatctagagtccaaaataaggaaaacattgcttcatgagtgatgtgttacaccttgtgtggcaaaacattggatcttaagagcaaagggaagtttgatttattaatgtcactggtagagcaagtggagttggacaaataggcgatggtgattgtggcctgaattttgcagtttgtcctggctcatgggtgatttttggaacggaaacaagaaaatggggtggatggaatacagagttgtagagttaacgatctgctaacagattattatttgtgaactcagacattgtatcaatgatgaaacatggtttttctgttgataagacagggatttcctggtcactgattatgtcatcacaatatgctaggtgctaataataatttattgttgtctttgcaataaggtttatttcctgtttccttattaaaattttccttttggtaatcccaccaatccatcccaacagtttccatttgtagatagtagatagcccgttcatcttagtcttctgtttctagatgcagcctcatataggaaactggggcattgaccttaggcttaaaccttagatatcagattttttccgatgttcatgctcatgttaaccattgtgttaattctttttacctattgttgattactccctccgtcccaaaatagatgccgctgttggattcaaaatttgtcccaaaaagcttgtcattttggagtaccttttgtcacatcaatcacctccaattcaaaattttctccatcatacccccaactacctaccatacattacttaatagagggcacctatattaatttttcctaaaccataatctttgccaaataacctagaacgacaactatattgggacggaggtagtatttgttacatgacatggtatgattgaagctgttattctttcagcattgtttttctaagtagctgattaatttacctttttacactgtgcagactggagcttgtgattgcgtttctgtatatggttttagttttggtgctggtgaaaggttcttgttttctcctgaaccttcatttttttctatacctttggtggaggtaaacaaagtcattaccgtattgcattatgatcccttatatttatatatatatggcctttttgggtttctgttctcagaagagacaattttgagtgcctgtagcaacttggtccagtgactatgctacccgctcgtagaggagcaaatatattcaacctactgatgtagagtattttgttttttctcagggaaagcttatcgacttgaaaataagcatggacaagctttggatacttaaggaagttggatcaatgctatatgaaatagtgcagtatgattgtgatacgtaagtatgctgcactgcactgttcccttatgaattgtgaaatgccgctgaccaaatagttttctgctctgactttatgactttttcatcagtgaaccagcacacagtttgtaaaactcaagcctgtatttttttttgcacttataaagattcccattaagtcgtagaaactaaaagttaggtttataattctatattgccaaaaccttgatttcttttataggtcaaacctgcttttgtttcttagccaattttaagtgcccacccttctctctctctctctctctctcaatatgtataaatcctaaacccagaagctaaactgtattaggtcactttatgagtgttcaaatatttacctaaatgtaaataactgcagtgagataatgcattcatatgtgctacaagaagtttctgtcagtgaccagttgtttcaaagctctgagaatacattggatgatttggtctggacagctgattcaatattctcatccaagaaggtaactgtaatttccttgaggttccattgttctaaattgacatgtcatgtacaccttgatgttattattcatagttctagaatgatatgtcaaatattgttatgtacagataaggtcacctattgatctatatgacttctggttcaacttgaattataaggttattgcttcacattgctgttaggtttcttgtcctctgaatggattaaactcctgacgtgtgtttgattcttaaaaatgattactatttagactacaatattcgtaaaccctataattgtcattgatacgactttttagagttagtttatcatttttgctcaattgctgcgggatatatcctttagctatatagatctcatataattattttagttctttgttggctgtgtgaagcttctcaatgttcttcagctatgtagacttcttttgtatctgtaggagcagacattcggttttatttcatctatgtttttgcggaggctacttcaaccaggagtgaatcacagttctgctctacgtgaaaccttgttggagcacaagagatttctatccgattcttatttccaatcacttacaactagtggactacggaaagaaatattatccaccatagaacaagaggtggtttcccttttctttttactcatttctttgtttctatcaggcttcatgatttctagttctagcatgtggcttgactgaattttcatatatctcattcttttagggaagttcacagactgcaagttcgactgcttatcattggaaaaagttttctgcacggtatctccacaattggtgctggaacaataggccatatgggttacttcttgatactaacagagaagtttttggtttaataagaaagggttcattttctctcttccgttgtttggagggcatggagcagtttatttatggtttgttacctttttctagtatttaataattatattaaaattattttcaactatcattatgagctattcggtaacgcctatgagcattatacatcaggttcctctgatgacctgcgcaatcttgatatccttggggtgaacccatcggataatatatctcagtctgaaatcctcattgaagttctaaggtgcatggatcatataagccatctgctggggagatctgctgctgcaatatatcatgaatccctcatcagttctgttatatcacctgatgaaattgtttctcagatcttaaagattctgggcactggtttcagtcctcagtctccctcagccctcattacattatttggaacagatgcttatgcagaaagaaggcagaccgctcacaagagtcagaggaagttttctgttgaaatgttactatcttttcgtaaattgcaatcaaagtcgacatcctggtcagcagtatttgatgtgattgagaacttcatgaagtatttgaacacaaacgtgaccatccaagagtatgagctgaagagagtttgcaatgtgaatactgcgttattggttcaagctacttcacaggtagcaagaacaatgttcgagtccacttttgatctatatctgttcctcaattatctggtctccattggtgggcaggtatgccatatttttgtattttgatatttctgtctgatgtgcatgtgtttacttaactcggccactgtgctacctctgatacgtactgctatatagttcaatattatatttcttttagggaagttcacagactgctagttcgactgccatgctattactcaaacttgctccggttggtcagaactggctaggacatctgcaaatactgattaagatgttaaagtgttcttgacttgcatcaattggaagatagtagacatataaccataagatccttgtcagacctttgtgttgtttgtggtgttaaactgtaattcaatgcttcttcatagatacacactattcttgactggtaaacgtctttcttttatctgtttcattaataagaacaatgtccaaatcaggtctccttgtcacaaaatgatattgccagaataaaactgaagttgttcccagtgattcaagatatactgggacagtggattgtcctccactttgtaggaatttcacctactacaccaccaactattgaggatttcagctatcagctttcttctctccagctaggtcagaacttacagtacattttgttgctctcttacttttacttttgttctttgatatgtattctcttgaatggggacccttcctctacagtatgtttcccgctgtattatgacaaggcaacgagtccatacagataaaaactgatatgccaatgttgggaataattaactatttgccactcttacgagtggttctaaaggatttgccactggacccacatgttggtatgctgtattcaataatggcttaaatggaaagtgggtgcacatgatacttgtctcattagagactaaaatcactagatcaattcatcttcaattgcttaattgctaatgtatcatgttacccatttcatgggaatggcttgacttgacccctaagaaacaatctgtatctctaagttagtttgtttctaatatatggaatgtatctacatggaggaactcaactaaacaatgaaactaattattatttttatctcttattgccaagtaatagcatggcaggaggcccatgggaacagtgcactgcggccacagggtactgttcacacgaaaattttctgcacttgccatgggtctgggtgcaccacaaatgattctaaaatctaaatgcaatgcacacctagcctcttatgatatatgggatcttatattcacacttggcttaatatttataatgccactttcttgtgcttttcttgataaagaaagaacacgtcctcattacttcattctcacaggaaaagctgatgacctgtctttgcacagaaagtttggctgctcttattttacattggcttgtttacttgattttccaaaatctgctgacggggatgttctctcaccctggtttcctaatccaactgagttggtcaacttggtaaggaggtttagtggctcaattatgagtgaaaatattgctggaaatgctgactgtttcttgagttccacaattaatctggcagcagttcttgttcgccatggtcaatatgaagctgctcaggtatctttcttgttggtgccccttaaattcattaaacgtttattgtttgatgtggttctaccattctatttacaataaatatgacaaccattatccttatttcttctgaaagagtcttctgggcattctcgacacacacatgaactatgtgaaagcatctcaagctgaccaggatacagatcttgcacgctcatcatgccttcatctcaatggattttgccttctggtgcttgcacgtgatgaagcaaacattgtcctgaaagaatccaaggttcatgaagctatccgatgcttcttcaggtaccaccttccacactatgcggagttgtgcactgtgatttactgcttaccagaggatattgagtctcatgaagtggtcttagtgttatagattatgtaacattgatatgttacagcaatctgaattacttgtgatgtttctagctgtattattgtataatgtgcaattcagcacttagtgagccatttctcagttttctgttaactaattattgaaaatatttgttattcgataatgctcactgccttactggttctcatagaaaagcctaagtgaccaggcattgagctgatctccagtttattttgctgcttgaattcagaaaaaaaaatgtttgatttatcttgcatcaaagtcagaaaatgtatatctgcatccttaatcgcaaattataaaaaatggctgcttcacacttctactttatgtgttatccaaggttgaacagtggacatatgattatttgcagttatggaagtttctgaaaatcctatttccctaattaatattcagtgcgtaaaggaaaggtcagtttcatttggctgcataagttatcagtatacaaatgcaatatgttagtagtaaattcggcatcacagaactagttttaccagtaaatccaatacatggtttgcaacatatgtactgatgtgagaaagaaatgaatgcggaattaggctgcatatctggtcctttagcaaacaatcaactacttgtgctatcagcttatcagcacagcagtatctttccacataaaatttcaatgatttcacctgatatgtgatattggggttcactgttctccaagcatttcaatgggatgagttcacattctctgcattataaattattccgaacttaggcaacagcaaagttttaagcatcacatcaaagcatatccgatggtcaggaactcaggaccaccttagattaataaaaaacataatcttttcttttggttgtgtggggtgtggtgggagtacaaagttcaaatagaaaattatggggaaaaggctaaaagccttgacaatccactaaaacaaaatgcttggatttgtgtacttgcctaaatttattctcttttatcaatctctttttctatattggtgattggctggctcattaatggtgttaatatgctaattactttgtaaaacagagctgcatctgggcaagaagctccaaaggctcttcagaagttctctgtggaaacagggtttcaaatctccggtgacatcattttcctagttctgcttgtattataattcacctctaccatttcctaattcttttttatttttccaggggaatgcagatcttttacagcatggaggcttcgttactatgagtgggcaatgcaaatttttgagcagcactccatgagtgaaggggcatgcgagtttgctcttggtgctcttgaacaaatagatagcatcgtcgatttagataatggaagtgaagctgaggatatccctgaaactacaactatgattaaagggcgactatgggctaatgtattcaagtacaaattggatttgaaaaattttcaagaggcgtattgcgcaataatctcaaatccagataatgatagcaagtatgtctgtttaagacgtttcatcatagttctttgtgagcttggcgagacaaaggtttgctctgtttatttactgtcttcactaaatgcattgaataatttactaatttaccagttgttttaccagatgtccatagacactcttaggctgtgttcttaactcaaagttcccaacctccactccctcgtttcccgcgcacacgcttcccaaactactaatggtgtgttttttgtaaagttttctatatgaaagttgcgtaaaaaatcatagtaatccatttttcaaggttttttttctaactaatacttaattaatcatgtgctaataagcaaccttgttttccatgcacggggggagagattcccaacctctcctcccgaacacagccttagtggtcatgacacctgtttacctaattaatctgtgggtcgttgcttggtaattgtcatgttcaagttcaaccacaattgattccgtttgcctaatgtttttacgctcttcacaaaaatagcatactatgtgtgatgttggtcggcaggctttgcactaatcattgccagttaaaaatcatataagtatgctattttgtgtattttgagttactcagttcacttcttttactgtgtgcgaaccatgttcactggatgattagagtttaaaggaccttgctatctgttgaattaggtaatttgcaatggcgagataccattcactggcttggtggaaaaagtggagcaagagctcttctggaaggttctctctctccccatcttttgaattacaaaaacttttatttgtgcaacctgtaatgcaatatattttatttaacaggctgagcgctcggatcttttgtctagaccaaatctttacaaggtcctttattcatttgaggcttataggaacaattggaggaaggctgctgcacatatgtataggtatttcgttagattgagtagagagggtaatgctggtggaacccggcaactttctcatacattgcaagagaggctgcatgctttgtctgctgctatcaatgcattgcagcttgttgatccctcattcgcttggcttgattctgtttgtgaagcggatgatcaaatctcaccaagtaaaaagccctgtaatcttttgatgaagaactgtatgttctgttactcaagcactgtttagctggacctttgtacatctcatttcgttattgactacttgtttgctgtttacagctgcttttggcacagattcagagctgtctaggttgaagttttgtgttgacattgaaattctcgaaaaggaatatacactaacagaagcactctatatgctcagcactgtaaattctagattcaacttttcaggtatatgtccccaaagtatcgtgcaaataatttaatattacttgagacttgaatatatatccaagctttggcaatcaatatctcgtgggactgcagataaccaatctattgaagcactgacggatattcttataaatgagaatatgtacgacatggtgttcaccattgtgctgaaatttcggaaggagtcaggaatgaaaaggtgaccagtttccctgtattgatagattcttgcttcttcgtgtcggcgcttctttgcattatctaacttttaatgtttcattttctcatggtagggagttggaacgtgtatttgcagcaattgcgcagcaatgctgccctaatagagtgggcaactcagggtgtgttaaactgtgtttttttggtccattctggttctctggaattgattttagtctaattggcatccactattctattgtagcaactattatatattaataataatggtgccctgccaaaaaaaataacaatgttgtattttatgaccttcttacaggaagaatttactgctgccatcttccgatgatgatgcctgtgatggcaatggtaacagtattgccatggctcatcaatcccaggggagttgccattgggagactcttgaaatatatttggtctgtgctctttgctttttcctatatttaatgtttctctgaaatgagcttcttttttacttaactttgttagagaatcttaaagtattgcatgatactccgactgttctgaaggagcttctctgtcaatttcataaactacaatttttaactctgttctgcaggagaaatacaaagatttgcatcctaggttgcctgtcattgttgcggaaacacttctttacacagaccctgagattgagctaccactttggctagtccagatgtttaaggtgatctcctgatgtatatattctaatagttacaccaactattatctgattgaccactgaccttccatttgtacctttagaccaccaaggctggtaacaggatgatttcatggggtatgtctggcacagaggcagaccctgctacattatttagattgtacataaattatggacggcacacagaagcggccaatttgctggtcgagtacttggaatcattcacatcatcggtaatagatcaacaaactcaaatatccaattgcaagatgtttgcaagcacatgttgacagttacacccttcgaaaccatcctgcagagacctgtggacgttctccaccgcaaaaagatgtcagcggcctggttcccatacactgccatcgagaggttgtggtgtcagctagaagagatgcaaaatgctggccacagcgtggatcagtgcgacaggctcaagaagttgctacatggatctctgattagtcacctgcagcaagttagtactacatctaatggcttcccctttcaattctggatttgttttctagatgtctcctgttgaccacaatctgtttgtttatgggcttccaggttgtggttgattcagatgatgtgctttcatcgcttggaggagggaaagg

SEQ ID NO: 87801 - DNA, 1143 bp, Oryza sativa
acgcaacggcccatggataaagctgaattacgaccgctagattgggtccaacaggcccatctaaaaaaggagcccaccaaatcaccaccgccccttcccttccggctcgatggccgccgcttcgccgccggcggcggcggcggaggtcgttgtatccctccactctgtcccagccaactaatagcgtaagagacaggagaatcgcggcgcggagcggcctctataggagcaggcagcgggcgcctcatcgtcctccgattccattccgccatggtcgacgacccccatcttcctcctcgcctgcggcaagcaaggaggtaagggatccgtcgttcaaatcaccccatgcaccgtggcagatctcgtgcaggagggacgaaccagcggcggtgctattgctgccagtttatctatttctgaatccgtccattaatttgactgatccccccactgcaggatgcatattggggattccaactcaaactacaagagcagggatttgaactgttctatgtgaaatttatgcaaaaattcgtatggaactctactgttccagacagtttggcattagctccggattgggattattcatcaattcgttattcctttcttgttcaattcctaaccaatcaatcagtcatacttgctgcttattttagcaagaagatcacagagctcccttggtttggagcacatgatgttgtggtcggctccagcaatctcctcgacttccgtgcccgggctcaacgtgatcaaataacgatgcagctccttgatgtcatcccccatgcctatcaggcacaccctcttcaccgaaccatagttggcactggtaagcagcttgtcatccttcatcatcggatcatcctggaactggctgccaggtgtcatcaataattttgccagggtcaaatcctacccaaaaaaaaaatcaaatgctagtctaatgagatttgagataccagttaccagctattaggacaatagcaatcttaattccaaattaaatgctaaactggaacttgcaagaaaccagagttcatgatgctagttgattgcctcagctggacttagtggataacacctctctgccaagaaatttgggcctagggttactgctgttcctggacctcgtttgttgtt

SEQ ID NO: 87802 - DNA, 550 bp, Oryza sativa
ccattgattttattgcactcatgcttgtacttgctatgatctccagaacacaagctttttattggaatgcttccaaaaaatgtaacggacaccgaattgactgatttattttccaaatatggaaatatcaaggatttacagattttaaggggttcacaacaaacaagtaaaggtgagatctggtgaataacctattttcctaaccatttagagctagaagcactggttgactctggaactttacaatacctaatgtttttgttaaattaactgtgttattgcagctggctgtgcattccttaaatatgaaacaaaggagcaagcagtggcagctattgaggctctaaatgggaagcacaaaatagaggtttgccagaaattagttagaatagcagaaaaattcttagtggttattgaaatgtactgcaattcacacatgaacatgatccatagctctacttagtcatgagtctgatacacataaacagtcaaagctaaagacactctctgctattgcatttatttgataccttgtgtctgcattatatta

SEQ ID NO: 87803 - DNA, 572 bp, Oryza sativa
caggtcctccaggagctaatctatttatctatcatatcccacaagattatggggaccaagacctttccaatgcattccagaggttcggtagagtactaagtgctaaggtttttgtagacaaagcaacgggttccagcaaatgctttggtaatctctctctctctctctctctctcacacacacacacacacacacacattttgcttatagtctgctaattgttttctaacgggtgcaggttttgtaagctacgattctcctgcttccgcacaggcagccattggtgtgatgaacggtttccaattaggcagtaaaaaactcaaagtacaactcaagagagacaactccaagcacagtaaacccttttgacgaaaactatgatgaccacgcgatcaggttcctggtacatatttgtcagataattgatcgttgaattgtttgctctggccgcagcattgggagcttcgtgtatcttctttgttcaattcacattcttgaacactgttacgtcgtgtaatttactgcagcctagtggtagaatttgtttcatcagacccttgtacatcagaagt

SEQ ID NO: 87804 - DNA, 520 bp, Oryza sativa
ttacaagggtatacgaagggtaagcactagactaactttacttgcagcatgctagacagcatttttaatttaagagttacttagttaggcagtcaccttattgaacacacatcataaatagaggacataggactgttcaagacaagacaataagttaattctctgcttaccctatttcatttcagttcgtatatagtgcaccaaatccaggtcaggctgcagctgctgctgcaccaattgcagtttttactggtgttactgcaatatcatttgccgcttttcctctcagcaagactttttcaatcgctatcctgcaagcattagcatgtggcgcaataggagccgtaatcgttaacagagtgatccaaaaacagcttggtgacctactgtcctcagaagcagaaaagatagcatctgctgataaggcaaatgctcagcaagttggatttctttcggacatagctggaccaacaggagctcaattgcagattgtatatggtgtatttggatacatgcaggt

SEQ ID NO: 87805 - DNA, 536 bp, Oryza sativa
actatagggcgaattcgagctcggtaccccttctccagcctcgccatctcctgcccgatccccgtcgggaggtacgacagcacgttgtagctcacgtccagctccaccagcgacctgtacgtttggatcattttgtgatgatcaccattagcgagaattgaagtttctttaactggatctggatgccattggggagaagaagaagatgatgatgatgcgtgctttggccttggctggttgattctacctgcattttgagatgctgtcggggagagacctcagcttgttgcccgagacgtcgaggatcttgaggctggtgaggaggcctatggagtccgggagggagaccaacgcgttggaagcgaggcgaagctcttccaggtgttcgagcccgcctatggcatctgggacattctgcaaattcaatgaaaatagctagtactaacagatggaaagaaaataaaactgaactttacagtgttttctagctttgtgggactgtagcctgtaaaccagaaattcttgaatggaccaca

SEQ ID NO: 87806 - DNA, 1314 bp, Oryza sativa
accaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacaaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatggatgtgtacacattttctataatgtaaatatattttgttcatatatatatctatatacatatgcatttgcataacatatatatgtataaatacatatatatatatatgtatgcatatatatgtattgaaacatatatatgcatggtttatatatatatatatatatatatatatatatataaaccatgcagcaacaggggcatgcaaaaaaaaaaggtcagctctatctttagtcccggttggtgttaccaaccgggactaaagatcgatctttactcccggttatttcacccgggactaaagatagcgatctttagtcccggattggtactcccggtttggaaaccgggactaaagggggttatgaaccgggactacaaagggtttcttcaccagtaagacttgggacgcctggccagggatcgtagcagagtaacggagatcgcaaggaaccccgtacatgttgtctccgtcacggtatcccatctcctccagtgcccctataagcttcgcaaggcaccattctctgcagatcaagcacacacaaaaaaaaaaacagcagcagcagcagctatgtatagtgtccactaggaattaatatagtgagaacaacattagtgtacgtaggcaggattgttttaataataagtactctctccgtttcagattataagacgaagtcaaactgtttttagtttgactatgtttgtagacaaatatattaatatttataatactaaattagtttcatcaaatcaataattgaatatattttcataataaatttgtcttgactatttttttcaagtcaaaacgtcttataacctgaaacggagagagtaataattgctacagacaaatagtacatcgcctgtagtttggtggtcttctattccttgtcttatatttgtaatcctttgataaatttgatcgtaaatattttgtcttgtgatagtttcgtca

SEQ ID NO: 87807 - DNA, 1970 bp, Oryza sativa
catcgagctctcttgtggtgatgatttggtctgcaaggtagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaaatgaaatttggtatgtaggaagacagtaaaattaaactaactctgtgttgtatggcaacagtatgaacgtcttgtaatgctgcgccttcaggagatggacgagattgtcttctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcactccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgatcttggcggcatcaactttcgccttctttgttgcccttgtgtgggcaagcggtggagctggggggccccttgactttgaaggtgccggaagaggagcttgcgggggagtaggtgtaggagcacgaggaggagtcggtgcaggatcctgaggagtcgatgctggagcctgaggtggagacggtgctggcggagcatgagaaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtctgttgggatggccatgcccgacgccaccttcatgttgtgagagattatttattagtaa

SEQ ID NO: 87808 - DNA, 529 bp, Oryza sativa
tcgtagacgcccaacagcggcggcataataggccagccgtgtaggcggaggatccactcggcggcgacggaggcaggccggcggtgaagtcgtagacgcccaacagcggcggcataataggccagccgtgtaggcggaggcaccactcggcggcgacggaggcaagccggcggtgaaatcgtagacgcccaacagcggcggcataataggccagccgtgtagacggaggcaccaatcggcggcgacggaggcaggccggcggtgaagacgtagacgcccaacagcagcggcataataggccagccgtgtaggcggaggcaccactcggcggcgacggaggcaggccggcggtgaagtcgtagacgcccaacagcagcggcataataggccagccgtgtaggcggaggcaccagtcggcggtgacggaggcaggccggtggtgaagacgtatacgcccaacaacggtggtgtgaccaaccaaacatataggcggagacaccagtcggcggcgacggaggcaggccggcgg

SEQ ID NO: 87809 - DNA, 533 bp, Oryza sativa
agaatcaagacatacttccttctctgtctcaaaaagttcaccctcggtcttcttggcctttgccttcttgtcccgggcaaagtacttgtcatcaaacttatccaccttaacaccagagatgtcaaccttcgtggatgtggcaatgacgtaggcctggttcacacggcggatgggcactccattgatcttaaaaggtcctgaaggagaacaataagaatttaggccaaaatccagtgctttgattgtaaaaatctgaacccaaccaattcattgattgtaatcagagcttaaccaatttcctggcttaggtcagatcccatcaaaatgaaattaacttgattaaaacaaagtgagactattacattctactaaaaacatcaaaatatgccagagggtgagtggcaaaaatatacaattccctttttgcattcagtgtgcatgttatatggaatttccattacaaaaaacagcacaatccattttacatctttgtattacagatgcaaatttcagctcaatctatatcaatgagg

SEQ ID NO: 87810 - DNA, 987 bp, Oryza sativa
gctcaaattgcatacacctaattccaataggcaattaagcaacctcattataaatggcacataaagaacaatcacttggacgcaccaatttgttaaccaacagataattaatattagttccccaaagaaaaagaagataatgaaattgatatatatgtaagcatcagaactagcatcaagataggtttgtcaagcaagcaaaccacatcacagatgatgctaggctgatagcttatataatctgaagcaagaaatgtactacatccgtacatgtgtaactctacaattccatgtggcatcaagctcaatagatgaacaattgaacacatgacagtagatggcactgcatagccaaattagttgcaaacagatgtatctttgtcgtgaatatcacaaagtatgcaaattcacttgaagagaaaagtgccatactacaatttcacatgagcaacccctaaaactcaacgcgtaataacaactacagagcatttcgcaaagagtaaacaaggaaaattctcacggtggatatgctccatccagtttacttcaagatcgtattgatgacgccggcaccgacggtctttccaccctcacggatggcaaacctcattccctgctcacaagcgacgggctggatgagctccacaaccatcttgacacggtcaccaggcatgcacatcttcgcctcctcgtccttgtcgttcataatctttgtgacattccccgtcacatcggtagtccgcatgtagaactgagggcggtaaccagggaaaaacggtgagtgccgtccaccctcgtccttcttcaggacatacacaaccgcatcaaacttggtgtgtggcgtgatggaagcaggcttcgcaagcaccatgcctctctcgatatcatccttctgcatacctcggagaagcaggccgacattgtccccagccatcgcatcatccatggtcttctggaacatctcaacaccagtcaccgtgcagttgc

SEQ ID NO: 87811 - DNA, 1738 bp, Oryza sativa
tcccttatattaggggacgaagggagtagcatatatgaaataattatttcttttcccaattcctacctcctcttcagctgcttccagtcctccttgtacccagaataaattttggaaaccagcaccatagagttgctcacaagcggccaatgatctgaccgaattacgggcaaaagtgaacacaactaataaaattacacatccatgaagggcaacacaagaatgcattactgaattgactttctcaaaaggtaaacaacgcgataaagtattgatatgcaattatgcatatcaaattcagcattgataagatagtgaattacctcagtcccttctggcaaactactatgatatctgtatctttagaaaacttctcctcaacttgttgtacaaagttcctagcaatttgatctacgatcagtcaatcttactgttctgaaaatagcagatgaaagttctaaattcagtagatgttgagcgtacttgttaactgtcattgttgagctgccactccaccagccacctagggaagtcatgggagttcgatcatttggatgtcccgaattgtaggaggggtgatgtaagagttgaaaaataaattcacaggctcacagaggatagaacactaacataaaacagaaagctacacatgccttggttcaagtaattgtgtttcatgaactactactgtggttagtatgatggtaatctaaaagacgtatgtaaactggtcaaacagcccagagaaaatcatcattgcattatccattctagagtgtacacatggaaaacattccatgttacaatctcctgtgcttagtttaatgatgaacaatgagaacaaggtttgtaaagaaagcattcaagaacaagagattgacagtcaggtttgcatatggtgaccctgtttagcatacccatcacatagttggtgaatttcttgccggcgccacccaaatcaaacgatgtatccacatcaaatacaggaatccaggtagagcctttcacccaggcctaaaatgcgccaattcaaatacaatcaaggacaacgaataacagtcccatttcgcaataatctaacacccctttactttaagagtcttgacaggcagcgagacacaaccttttgacgctcaatcgaggggcctaacatcaaggaggacctagtcagtgagcttgaatgtatagccagcttccctgggtgtaagagtacttgatcttgtgctccataatcttcaggcagagcatcattcccacacacacatgaacagcagaagatcagcatttcaatagccatagatcacgcaagatgatactgaattgaaaccccaatgtgggggaaatcgtaagaagaatttgcaggcagggagggttagggtaaggtgaagggacacaccagagtctcccatcgcctccgggcggcggccatctccttggccagcttcacctcctcgtcctcgccctcctgctcccctcccacggccgctcccatcctcaccactccactccacctctgcacccaagaaaccactcacacagttgcagtcaccgctcagtggaaatgagagcaaaggagaaggggaggaaagccaagaaaggaaaatggccgcacctttgaaggaaggagacgagggcggaggcgcctggagcggcaggaagaggaccacgccgcggccggggtggcggcgccggcgccggatacgcggcgcgcgaggccgagaggtgacggtggcggggc

SEQ ID NO: 87812 - DNA, 708 bp, Oryza sativa
gaaaatggcagaacaatttcagagcttcaagggagatctgtaccagaagtatatactgaaggggcagacaccgaacttcgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaaatggccggaacgatcgaagttctggtactatgctcacggtggaacgctcaacccagctgatggctcactggtcttcggctatcagatacaagaggctgcgcgacgactaacagatgcagtggaagcctcctctcagggcacgttccgaccagacagagatagggacgagctgacactcgccctgcagactccagagcatccaggacgaacttgagggaaaggggtgattccttggaagattggtttcaaggaggacatccacacgtacaggagtcggatgaggagcaagagagataccgaggcgaagattgcagacctagagttccgggtatcgagctatgaactcaacatgcaagaagaggtggcaaggaaggttgatgaacgcatggccgcacatcggtcccatgatcccca

SEQ ID NO: 87813 - DNA, 602 bp, Oryza sativa
tgacttgcattttcaaaattcgagctgtgacggtttcgacgttcggtgagctatgcttcgaccgattcgtttcgcccccctggcgcgttagctgatcaggagtttgccttgggatttttccacaaagacatcattcacagaaaaagaaaagcggaaaaacacaaagattttatactgtttcgggcctccaaggtggataataaccctacgcccaacttttttttcttttttcattttcctcttttttttttgctttttgtgccgaacggcttacataatacgaacatatttacaattggcgaatcgggtgccacccatattacacatagaagcgtctaagtgaagcgacgttctaggagtggtcgaactcttcgccctccaatgttgccagccgaaaagaacctgttcgagatctctgctttatcagatatggtccttcccacttagattccagcttcccgactgccatagggttcgccttctttgttagtacgagatggccgggccgaagctctgtcggtcgaacctttctgttataggttgccgaagtgccttccgcgtacttgcgcatgtgttctagtgcttcgactctcaccactttc

SEQ ID NO: 87814 - DNA, 737 bp, Oryza sativa
cctgtcgtcgcccatttccatacagaatcttcgactgatgtcgcgtggcaaactcctgctgaccgtggagtccaagaagtacccacatctgcgcatccagggacacatcgtgacccgagccagctgcgaaatcttccagaccctgctggcgccgcacagtgccgaatcctcgaccaagagcagcggtttggcgtgggtctacttgaacaccgatggatctctggcctacaacatcgaaacggagcacgtgaacacccgggataggcccaacatcagtttgattgaggagcagggcaagcggaaggccaagctggaggatctgacgccgagcttcaacttcaaccaggccattggtagtgtggagaagttgggtcccaaggtcctcgagtcgctgtatgccggcgaactgggcgttaatgtggccaccgagcatgagacgagcctgatccgtggccgcctagtgccccgtccagtggccgatgctcgggactcggcggaacccattctgctgaagcgacaggagcacacggatgcacagaatccacatgccgtcggcatggcctggatgtccattgacaacgagtgcaatctgcactacgaggtgacgctcaacggtgtgcccgcccaggatctgcagctgtatctggaggagaagcccatcgaggcgattggagcgccagtgacgaggaaattgctcgaggaattccactgcagtcgagcgcgagtcactcacgcgg

SEQ ID NO: 87815 - DNA, 1046 bp, Oryza sativa
cgggtgaaacatagcagactgtgccacgcatgcttggtgtgctgctcactgctccaccactcttgggcacgaattccccactagcccaatccttgctgctccttctcacaccgtcaatccaccaatcaatgctgccattgccattgctgctcctacgactccagcttttcatcattctccaccttgatcgtcccttctcctttaagtcacagtccctctcccaccactgcatgctagccattggaccaatctcactccttgacttagcaagtgctcgccttttttgcttcttggttagctcatcagcatactcctcacgccaccattctctcgccctgcgctttgttttctttctctctgttgaggtggcaggggtggttgcagatgctcctgcaatccaatcattcttcggccgctccttcttgatctccgacctaatccattccatcacatagtccttgacaccaccagaaccaccaccattgtcctgacgccaccaccagtcattcccagctcctgatgctgcagcacctccaccattgcagcttcggccattcaatccgctactgacactagtcttatcacatcctgaagtggatgctgcctctgcaggagaagccatggtaaacccctcatcatcttccggtgacttggcagcattgtcttccccattgacagcaacagcagtagcattttcatcagcaacagacatgtcatcatcacattcgccacaaggattgctactctcatttccattgccctcaattgcagcactctctaattcatccctctcctccgactttatctgcgcgaggccaaaatctgagaggcgagcacggagctcaccatccagcaacacattgctgggcttcacgtctccatggatcactggtggttgcgcgacggaatggaggtaatggagcgcggcggccacgtcacgcgccaccgcgagccgccgtgggcactcggacaccagcttggggcacctttttccgagcagcgcgtcctgcagcgacccgttcggaatgagctcgtacacgagcata

SEQ ID NO: 87816 - DNA, 750 bp, Oryza sativa
  unsure (1)..(750): unsure at all n locations
cgggtantttagttgttcactggtacagnnacncatcagaaagaggttagcagcgcagtcagcccgaacacccccgacattagctcggacatgaccgaggcagaacgcgccgttgccgacatcgaaaccatagacgactggcgcatcccactaatcaaattcatcagcagcgaggagttgcccgaggacgacacagaggccgagaaaataacccgtaaagcaaagatctactggatggtcggcaacgatctatacaagaaagcgccaaacggggtacttctcaaatgcgtctcgaccgacgacggtagacaccttctcctcgacatacatgaaggcatatgtgggtcacacgccgccggtcggacattggtcggcaaagcttttcgacaaggctttttctggccaaccgcccttaaagatgcatgcgacatggtccagcgatgtgaatcctgtcaattccacagtaaacacacaaagctacccacgcaagcgctccaaactatccctctgacttggccattctcgtgctgggggctagatatacttgggccattcccacgaggacagggcgactacagattcctattcgtggcgatcgataaattcaccaaatggatcgaagcagtacccacgggggaaatcaaggccgacaacgccatcaaatttatcaaagggatatttgcggataccgactaccataccgcatcataacttgatacggctcccagttatcaacgccgatttcaagat

SEQ ID NO: 87817 - DNA, 758 bp, Oryza sativa
  unsure (1)..(758): unsure at all n locations
cgtgttgagagcttgnttcacgngttcttagaagttatgctatgattgccccatatgacgtagatggtaaccgtattacgtacccttctcttgggggacgaaactacaactctactacccctgttaaatttacaaaactagcaaaaccacttaaagtcggggatacagaggtttttgtagaagatgttagtctatggaacggacaggcaccgcaagactaccaacgtagtattatcatgtggggttataaaaactcgttcggctatacttatcccgatggaacgtatagtcagctaatgcagatgaggacatatgatattggtgcagttgacaccacagctaacaagattacgttaaacaagccatgggcagttgcaaacccaaatagttcagatgggattttcccagtagggcatacacttagcccaacttctgacggctccacatatttgtatttgaatggtcacgtaaatatacaagtacctactacgtacaccaagtacagccatttgattagtggctcttctgagtttgctaatacaacgattatcccagtagaaacaggttttattcaacttggattcttgttgaaccgtgatacaacaggtgaaaaatcttggctaaatggtttacgtctacgtgactatacagatacgtataaactaaacgatgacgttagagaaacacaagaaaacgtagacaaagctcaacaagatgctaataaagctaaccagtcaattgctgacctatctaatgat

SEQ ID NO: 87818 - DNA, 23139 bp, Oryza sativa
  unsure (1)..(23139): unsure at all n locations
gttgtgcncgggtgattctgctcgtctgcaagcagctcatcatcctacctcatgcccgcgacccaaaaaaaaaaaaaacccatttcttcccgaacccgaacccgcacccgcctcgctcgcacgctgcctcctcctcgtcgtcctcctcctcctcgctgctccgcaagtccgcatcgcctcccccctcgatcccatctcggatcgccgccgccgcagcagcagccgggtggggctgcgcttggcgggagggaggggagggtataggataggggagatgggcggnnccnnnntnggnngcggcgcgggggcggcgggggccgtggcggcggcggcgggtgacggggctgtcccggtggtgctgaatgtgtacgacctcacgccgctcaacaactacctccactggtgcggcctcgggatcttccactccgccgtcgagggtgagcctctgcctgatcctgacccagaccaagctccaaccgtaaatctccccccagtttatttttattattttaccatttcgcatgatttctgatgggattccagctttagtttatgatgtaaaggtgagttccttttagcgttaagggtatctactactagatcttggtttgttttctaggcagtttgctacgcgaatctgatagtggcgggatgatttggccgagctgacagatttatcgcgctagtaggttagatgccgtgctggaaacatggtggaacgggattcataaaaaaatgtttgggggtgaaaggcaacaaacagtttgaattgcggaacgcataccggtaattttgttcatcatttctgatttgtgtaccagttatgtgagcccagctgcaaagtaaagccattggtttaacattgggaccaagcattgctatggttgcttgtgaagatggcatcaaatatctttccggttttctttctgacgaggcttttcttaattcatttgggaaagattagattccttatcagtgcgttttcactttcctttagaactggttttgtttctggtactgatcaaattatacggttatatgacacatttgaaaagtatctgtgggggttgtatagtggaacaaaacatttgcttaaacttttgttttaacgggctctactgagttttcaaaacataggtttgtaatttgtgaattattatgataaatcaaatcgaaatgagtacttttagagaaatgaaattgagttggatgtgttgcacattgatatacttgataaacaatgttacagtattaccttctcttgatacaatgacatgtgcgttctgattctaaatgtaaggttctcccagaaagagctttagcaatttagtttttggattgtttcgtgctattgaatttctctcgcaactatgggacactaaagaactagtagaagaaaagtatcacattgggtgtgtatgtatttattgttggtacagccgcacacattacctttgccattgtgaagccgttgcactagaatcctgtcctgtgatgtatatctcatattcgtctcatagtgtattagtgtttatgttttggttggttcaagtattagaaggctctataggatatacatgttgttttagcaaggttagatgttctcatattcgtctcatagtgtattcgtgtttatgttttggttgcaagtattagaaggctctataggatatacatgctgttttagcaaggttagatgttcaacttcctgtcaattttctttctgtaggaagcttttacacaaaatgagtactatgtgtctgtgacttggcttctcttccttattcatcgtgttcaaaactagaagtgtagatttagtagtattattactgtgatgtgtgatcacctttccaccccaatgtatgttctgtacactttagctaattgttttcatgcttctatgatgatgatgtaaacttctctaagtgttttaatgtattgtgtggacttaaaaacaatttaattctctatgtgaatgatggttttccatgtcctgcattttttaatgatttatctccttgactaattctatgttgaacagtccatggatcggagtacagttttggagctcatgatcacccaacgagtggggtttttgaggtggaaccaaagtgctgcccagggttcatgtacagatgttcaattttcataggccgtacgagtttgaatcccttagaatttcgagatttcattcagagaatggcttcagaataccatggagatacttatcacctcatttccaaaaactgtaaccactttacggatgatctcagtaccagattgacaggaaaaccgattcctggctgggttaaccgacctgcgaagctaggtaataaaacttgtgctccttttacatcattatattttgatttttctaatactttattactaagcagtacatcacactggcactttggcatattaccttgtcaaaaaagataagattgcaacaaactatgtccattatgtgggacagtttttcaaagcaagatgaaacaaatattcgacttgtagtatctggagttttgaacttccagcctattttcctgactagtcaggattctggacaagttataataaaaggtagcgaacattaaggcttgggggaaaggtcatagagtggtggattatgcagtattgttttacacaattcagaaatctggatccaaatccttaggatttttttaattaaatatgtcccgaaaagttataaagcaatcccctctcccacacacctttgttcagacatgggcgaaaacaatatcaattgagaatgagatgttgatttatgtccagggagtatcatctgctgacatgaacaagaagggaaatgtctgaacagactacagagtattgagtattcacagaaatgatgatgagatcatagatgataaaatcatagagatagtaatatgtggcaatataaatgaggattactgaatgatccaaattaggagtatgttggatctcctcataggtgtcaactaaaatgttaatgacataatttaatattaataattttatatcaaacttgatatacatgagtacatggaagtttaataaagttaattatttctctgttagttgtttaatatattgggcccatcattttgaaatccgtcatagaattagaaaatgccatctaccgttctccaccagatggagaaaatagcttagcttctgctggcaataagctctgtatcagcaggtcaggttccaacaaacaacataggtctttcaaaaataggaaagtctgtttggatgaggaggattagattgcagtttagcttctcattgtctgcttgttagcttatcagccacagccaaagtttgaaattttgaaacataaatttagtagctttttaatcgtagtctattttccagtattatcctttaaatcgcaaacaactcaaatatacaagtgttacccataaattagtttcggttgttttgttcatttttctacggcttgttagacatagctcaaacaatcggagcatcatgacatatgtttctatattggaattatgtgagagtaatatggtgtttcagtttaaatatatcaatcaataaattttaagtagtccggtaagttggcagggcagaatttgttccaactgtttcttgcccctgtattgcatgtgagcctgagagagaaattgatccaagatgcacgttactgtgtttgccttgagctgtccactcttgacccaacttcaagccatttactcagaaagaaactcatatatcaacatccaattattcaaagctgctaaaatgccaaaatatgtacatttcctgctcccaattctgttctgaattgttctgttgcaaagatgacaattcatagtcaccctttctttagcatgtatgataatccaaattatttcaggtgccttttgcaactgccttctgccagaaagcatgcggttggagtcaactgggacaaagcacctcgcggactgtcatttctcaggtagatactgttgtttgtcctgtcataagctcactagctgctacgttagctgatcatgctatttcaatctcatgtttgtgtgtggtttgtggtaatgttgcatttttttcctttagatgattcccgcacatccagcaatgagcattttgaagatgaagatcttgaagacaagcacctgctttcacaatcttctgtttctgaagatgcaattgtaaaggaagttcacaggtgacaaactgctgaggctatacagaataatttggtgtgtagtttgtcattcattttgtacattgtaattctgtattccaaaatttagtgcgctctttgtattctaagttgatattcatattattgtggccggtttattgtcatgattaattttgttcattccatttgtacaaacactgtaataccctacctactgaggctccttataggtagtctggaagtcactctgcatgtgtactcttaagtcttaaattcgtttcttgtaaaaatgtgagttcaaagagcgagttgatcccgatgactgcgacgtattgtcagtgaactgtgcatagaatttgttcatgtccattgatttttatggttgctgttttgaattaattaattaagtcgactattgacccattgtaatagaaattttccagttgccacctgaaaatgatacaaaggagcagtaacaggggtagttggcctaccatatccatggctgtttgttttggatatactctcataatttatccattgtgaatgatgacagtaatagcagattagcaagtcatcctttaaactcttagttgcaaagttgggtaactttggtcagatgtatgtgttgaaagacgccagtgattcagtgtctaccagtttctggtcggtttcgtttatcgttaagaatgttaacccttcatttcaagttaatgttctgatcgttctgaatctaggaaggctccaacatcaaccctgaagattgtactaccaaacttttaccttttacctggtcaattcagtttaacctctcagctgaacagagtataagatctagaagtagttgagagttgctccatgtggtggccaaattgctaactgaatggtctcaggagggttgcatctgctcacctataacaagcagattgctctgcacttaatatatgtcaactctgtcagacccatataactaaatactatatcgttttaggttataagactttctagcattgctcatattcatatagactagaaagtcttataacctgaaacggagatagtacatggtatgcatgtcagactgtcaaatactcaaatgcattatctggacatttcggatgtaataacgacgtttgcccatttacttaattttatgtatgcttttcatgtgtgaaacaatttggagaaatcctcaccagggcatccaaatcgtttcagtttagctgaaacatcagataaggcaagttgttgcccagtactaggaacttatgggcagacaggttttagtggatccacgttttgcatggatatgttatgttccaacaatgttcaggttcgattgccttttttcattgctagggttcaaaagcaaaatcatcatgctttcaaaaggaagacttcaactattttcatacttactggaaagaaatagataaaatgcctgcaaatcaaattgcggtagatgaactcagcacacagtaagatgttttttttttctgttcgtcctgtttgttcgatttttcttttgtgatgtatttattctttagaactttggcagggagccttgctttggtgctcgtctatgtgtcgtgttttattatttctatgagatgaaacatttttttttttgctttctagttctagaaaaaaggttatatatcattgcaaacatgctgtaaaacttacccacttacaatttaaatatatactttatatatggtcaatgcaaacgattaattaattgtcaaatttcacattaatttacacaaataatgggagatgcaccggtcagcaaaccattcaatgtatgaaaaaaaaatggtggcagaatagtttgaagtacctgttctcccaaaatataagagattgatatgtgatataattctttgttgggggcatttcatcgcccttcaattaggttcacattgctgttcatccgtaactaattctcatgctcaagtggtgccttactgccgtttgaaaatgagcttgtcgaagatggggtactacaacaaaaacctcatgttcattgtagaggtgattttcattaggagctttatagtctacactctacaaagacgcttgaagaataatctaaatctagatggtttttgggcactctaattcacctaaggcatccacaatgtatgaaaaaggtgatcaacagagcatacggtctacctcaacactgtgaaagtggttcatatgtcagtccttataacgagctacctatgtacccctccgttccaaaaaaaaaaagaccaatcctacctacgaacaagacacatgtgtccaggaattcgttttttttttgaacggagtagtatataagaactagctttaaggaaaaaataacaataatttctctctcttctcccctctcctcacttgcaaagctactaattgagtgggaccagtgggactcaggctatatatattggggtaactacatcatctaatggtaaggcccaccttatgacctaagggtatacattaaagatgaccttaatgtgtatatgtatttttcttaggatagtcttaccaatttggaagcatctgcaggagggaggttaatttgtttttaagtagctaaacaactagtacaaataatgttagatttatacaaataattagtggaacgaagttgaggttattagcacatttaagataagttaaacttccatgattgctctagaattcaatgattgactatagcaaaggcatacatttttcagtacgatttgtggtagtagcacaatttatgctgctataataatgtctctagctactatgtaggaagtaaaaacaatacctctaaaaatgctgtaaaaatgtatatacatatatatataatcgggtcactttgatttggtgcatacttactattgtgttatacactttcttttcttatgagaggtgatgtttgtaaagcttttgtgcatttttcaaaaaggttaatataccccatgatggacatgcatgcttataaaactattttaaatgcccctgccctccaatgagtcaaagatatgtttttaaatgcattggcaccactaataggtgtcccaatgagaaagagagatataacacacatttatacaataaatggagagatgcactagttgtgaaaacattcaatgaatgtcacaattaattaatgtttgagaaataatttagtgagaaggtacctacagcataccctccattccaaaaagagtctaaaaagaatcaactggattcatctccggaagttgatcttttctatgatggagagagtatatattatcacgaaatattgcgtattgatcttggatttaaaagtcgtattccaaccatattgtaaacctggtcctcccaattccaaaactctggtgctgattccccctattaatcatttctggtgtgtgggacatttcccacacctttttcattgctacatctcaatcgctgttcgtccttctccttcttcagtggtgccttacctccactttcaaatgagctcaccgttaattgaggatatctctactctaccatctctatttctcgatcgatggaataacatcttaggtatatatggtctaaccgccttcacatgacccaaccaggatgattaattagtttttgagttctaaatttcaatgtcttttgtagatgatctatcaaagtaatttgtttggtgatacagagcatcgatttgaggtggccatatagcataacaatccaaatcattattttgtcaagaaacaaaatcaaaacataattcttgtaggtatattttgatttttgagggcctagtttcaattctttggtaacttatatgcactaaattcccaatgcacagctttatttgccttttgtacattttgctttcttctttcctagcttatccctagaacacgccacgagaagtcgaataattgttcgacatggctatttctttgcctgctgctatatgtgaattaatgcatgaccatcccacatattcctttaaatatagaaaaaaattattactccatattggtattattagatataaatcatttttttactaaagttaggaccatcataatttttagtaattaatatttatactgttctatacaatgctacttgtaaatataacaaagaaaatttacatccacatgccaaatatggtttagaaaaccatttggtgaccctatttttggttttctctatggccctaataagaaatatccaaaattgagttatctcgttttgattattttaccatgcttttaagaataattatgtatgatttaaaataaaaatagctcatgcaccaccccatggtccatgacgcttagaggtgagtcgggacatggttcgttgtgtgaagaggcagccgcctcttgcactctctattgtgcttgtgcttgagcctgcgcaatgcttgtgactaatgttgctccccatgtgtgtcacagagtccactggttggagcacgtgtttagtatttataacttaatagaaaggaaaccttggtatttcatatagacatatttcctttcaaaaattttaatttttttaagagaatgtgacacaacaataaaatataaaatattatggattcatattgtactgaagtgtactggtgaaacttttataatttgtagaaaagtaaactaaaactggtatatcttttaatgatataaaattgatctccatatttcttgtagttatgtgctgatagtagatagaagaaataaaaagttctttttagaggcttgtcgtttactatgtaaactttatttcaatccctagaataacactaaactttgtttcacgttcattgatgaaactaggaggccgcctggagtcaacagtggtggatctgccattgtgcgctactagtggaatcgttgcatatctttgaattaaattaatacatcaaaattgatgctaatttttgtcgttgcttgtagtatacaagtaaaagagaatgaggaaccagaacatatgacgatcttttttgcttcttctattcatcagagtaatactagtatgaagtgcccaaataatgcacgagtttttaaattatgttttctacgcttttcaatacacatcatcaaactttaccatgattgggcaaatgtaattttatttcttggttttaaaactactaaaatttaacggaactactatatagcacggagtgtttagcgcaagtagcgcttctcacagcggcccacccatcctgctcgctttccctcctaatgtaaaatatttactcttccccttacccacccgagcattggttctattgctagtctctccatccatccctgtccttacccactctatctcaaaataatacatagaaaatatcttgcaaatccggaactggggaaggggacatgatgggtccctctcctcccgatgtaagaaaattaccctcattccttatttcgtaaaaagaattatctggtaactttggaaagggcatttacctttcatctttctagtgtaaaaagttcatcttgtaacttttggaaggggtgagagtaatttctttacattgagacggagtagagggaaggtgagtccaaggatatatggaggggtgtttccaaccaactagtgggggagagaacaggaacagagaggatgaaggggaggatagggaagcaatcaatgttagcataaaggtgagaatatttttttttttacataaggggaagagttggacaggacaaagaacggggaggggagaaggacagttgggcgtctgtgaggcacgctagttgttaagtagtgcgtgttacgctgtttagcgctaccgagttcaataccttttttctatttttctttttggacaatatactagtaagaatgcgtgaatagtgcatgggtttttaaattatgtttccaacgcttttcaatacttatattattctattttactaaaattttgataaatgtaatttttttcttgttttcaaaactccagtacgaaattgggttgttttttaggagttaagctttgcatatgtcaattgataataaataaccagaactaagtaaggagttacagtagtagttactacgttgtgtggcggttttataatatgtgacgcgtaaataatagatacaacggctaaatttttcaatgcaatttttgtgtgttttttttaaattctagagtcgagtaaataaaaacctgagtatgtggaaaattaaagcagaaaatttcggttgaaacactacgctagttctacgatatgtgttgaacacacatcctaaaatagcaaacatttttttaggagttaagctttgcatatgccaattgataatgaataaccaaaactaaataagaagttaatagttactacgttgtgtggcggttttataatatgtggtgcgtaaataatagatacaacggctgattttttcgatgcaatttttgtgttttttttttggaaacactacgctagttctacaatatgtgttgaacacacatcctaaaaatagcaaacaaaatacaacacatatttcaacagtactagagtatcaactggattaattttgcctttactagagagtcaacaagcgagagagagagagaccgagcagtatgcagcagcatggtttgcaattccggttcaaaatatccgatcatccctgggcacacaactattttttttccaaacaaatgtccttttcttttcaatttttgttagtttagtataacatctattcaaactaaatttgctcaaattatccattttacccaaaatagtaaaaaattcaaacccaggagcagcagctagcataggtgtagacatgtctgtgtgtccctttctctctcaagggataggtggagctaagctagctagatagatagatagagagagagagaggggggaaggctagattggatttggtgaaccttttctcgtagcaacgcacgggtactttgctagttatagatataaatacttttttttactaaatttaggaccattatatttttttattaattataatatttatagtgttctatacaatattacttgtaaatataaccaagcaaatttacatccacatgccaattagctagggtttagaaaaccatttggtcaactatttttggtgatctctatggtcctaataagaaaaaaaatatcaaaaagtgagttatctcgttttgattattttaccatgcttttaaaaacaattatgtatgatttcaaataaaaatggctcatgcaccaccccatggtccatcgcgcttagaggtgagtcgggacagggttcgttatgtgtaagcactgccttgcctcttgcatttgcttgtgcttgagcctgcgcaatgcttgtgactaatgttgctccccatgtgtgtcacggagtatacaggttgggcacgtgtttagtacttacgacttaatagaagggaaaccttggtatttcatatagacatatttcctttgaaaaataaaaaaaattgttaagagaatgtgacacaacagtaaaatacaaaatattgtggattcaattgtattgaagtgtactggtgaaacttttataatttgtataaaagtaaactaaagttggtatatattttaatgatattaaattgattttcatatttcttctagttatgtgttgatagtagatagtagaaataaaaagtttttttagagattttcgtttactatgtaaactttatttttaatccctaaaataacactaaactttgttgcacgttcattgatgagcctaggaggccgcctggagttgacagtggtggatccgccactgtgcgctactagtggaatcattgcatatatttgatttaaattagtacatcaaaattgatgctattttttttgtcattgcttatagtgtacaagtaaaagagaatgaggaaccggaacattgcttcttctattcattagagtaatactaatatgaagtgcccaaatagtgcacgactttttaaattatattttctacgcttttcaatacacatcttcaaattttaccatgattgggcaaatataatttttttcgtggttttaaaactattaaaatttaacagaactactatatagcaccgagtgtttagcgcaagtagtgctcctcacagcacccacccatcctgctcaccttccctcctaatgtaaaatatttactctttcctttacccacccgaacattggttctattgctaggctctccatccgtcccctctccttacccactctatctcctaatgtaaaataatacagaaaatatcttgcattctagaactggggaaggggacatgccggatccctctcctcccgatgtaagaaaattaccctcattccttattgtgtaaaaaatatttagtaactttggaaggggttttacctttcatctttctggtgtaaaaaatttatctggtaactttggaagggctgagagtaatttgtttacattgagacgaaatagggaagggacggggaggccaaggatatatatggaggggagtttccaaccaacgagtgggggagagaacaggagcaaagaggatggaggggaggatagggacgaaatgaacgtttgcgtaaaggtgactgagagtaattcttttatataaggggagagtcggagaggacgaagaacagggagagaaggactgttgggcgactgtgaggcacgctagttgttaagtagtgcgtgtcatgctgtttagcggtactgagtttaatacttttttttgtttttctttttggacaatatactagtaagaacgcgtgaattgtgcaggggtttttaaattatgtttccaacgcttttcaatacttatattattctgttttactgtgatttacaaatgtaatttttttcttggtttcaaaactcgtccaaaattgggttgttttttggagttatgcattgcatatgccaattaataatgaataaccagaaagtaaggagttagaagttactacactatgtggcggttttttaatatgtgacgcaaaaataatagatacaatggctgaatttttcgattcaatttttgtgtttttttctgtaaattctaagtctagcaaataaaaacctgaatttgtggtaaattaaagcaggaaattttgattgaaacactatgctagttctacaatatgtgttgaatacacatcctaaaaatagcaaacaaaatgcaacacatatttcaacattactatagtatcaactggattaattttgcatttactagagagtcagcaagagatagagagagatagagagagagagaccgagcaatatgtagcagtagggtttgcaattcctgttcaaaatttccgatctaccccctaggcacacaactatttcttccaaaaaaatgtcttttttcttttcaattttggttagtttagtaaaataaattcaaactcggtcaaaatttgttcaaatttatcccttcttttcccaaaatagtaaaaaattaaaacccaggagcagcagcagctagcataggtgtagacatgtctgtgtgtccctttctctctcaagggataggtggagctaagctagagagagagagagaggggaaggctagatagagggacagctcggtctggcgtatgtccaaaggtgtttcgtgtgtgcctggagaaccttttcctttctatctcttcccttccttcagttaaagccatatcaaacacatggaattccggtctccaaatctttattaattgcttcctcaaaaccccctcttgccccctctctctcttccctttcctctctcctcttcctcttcttcttctacctccctctccctccccatgtgagtgatcctgctacatgttacatgtgatcatgcacaggtaggtgagctctagcccctgatcaaggaggtgcaagcttctactgccatcttttcggcgagaaggagatcgaggaagaagatcagaagctcaggtagccgccatggatggtgtggtagcagaagatcaagcaggcggcagcggcagcggtcaccgccgcctcatcggatcgaggatcgaggagcaccgcaagtacatgtcggaggagagctgctgcccgaggtgcggccacaagatcgaccggaagctggtacgcgtgtgtgtatcacactttgttaattaaccatgtttaattaatagtttgctatatatgtgtgttgtttgtgtgtctgaattctgaattttgttggagttgttgatgcctgaatttttcgtgtgtctgtgaaggactgggtggggctaccggccggtgtgaagttcgatccgacggatcaggagctgattgagcatctcgaggcgaaagtccggcccggcggcgaggcggcggcacacccgctcatcgacgagttcatacccaccattgaaggggaggatggaatctgctacacccaccctgagaaattgccaggttaatatgtgcaattgattaatcaagttcagttcttcaaaaggatgtttaattgttgttgttgttttttttttgtgttttggaggtttgcactttctgtttcttttacttgcttcagttttttccaccatttctttcttcggtttctttttccctttctgtttcggttcatatcttctcctctccttgtatctcgcatttctagaattgttttaaatgatacttgatagctaagcatgcatactccccacacacaccaaaaaaaagagagagaataaatggcatcaatggtagatttaatttgcaagtgtgtaatgcactgtaggaatctagcttgtgcaagaagggaaacagtggtacaccaaatcttccagtacatgtactgcatgtatagctagtcaatcaatgtgttgttgttgtggcagcacatctcacacaccctctaaaaatttgaaaaacaccatctctctctctctctctatctatctctagaagagagaatgaaatgtgacatgagatctttcccagcccctgcacatcttccaaagttaggttttgtcctcctcccaaggttgttatatcctccaaacagccaatggcttaattgaccattgcatcatcactcaaatccttttttcccttttcttttcttttctttttctttttttttcaaaagagaaacagacagtagctagctagctagctaaccagacatggaaaaaaatggcgggcacttgctgacgtgtgcttccatccatgcaggtgtcagcaaggacggcctgagcaggcacttcttccaccgcccatccaaggcctacaccaccggcacccgcaagcgccgcaagatccagccgccggcggccgccgcctcgtcgggcggcggcggtggcaacgcgtcgtcgtcgtcgtcggcgtcggcggctgcggcggtggcgcgccatggccatcagcagcagcagcagcagcagaggagcgagacgcggtggcacaagaccgggaagacgcgggcggtggtgggcggcgggcgtcagcgcgggtgcaagaagatcctggtgctctacaccaacttcgggaagcaccgcaagccggagaagaccaactgggtgatgcaccagtaccacctcggcgaggccgaggaggagcgcgacggcgagctcgtcgtctccaagatcttctaccagacgcagcccaggcagtgcgccgccgctgacgccgccgccaccgcctccgcctcggctgtagataggaggacaacgtcgttgagggaccgtgcggcggcggctgccgccgcagctgcagcggcggcgccaatggcttccgctaacgtcagcgtggccgcgttccacggcggcgccgccggcattgatgaattcagcttcgcgcagttcaggagtagcttcgaggaggtgagtgatcgatcattcccttgttaattagagatttagagtttagcagttgctaatttggggattttgatgattccttacacagtaaaagtaatactccctctgtcctctcggaataaaatttatttcttaggatgaatctagacaaatgcagtgctggttcagattcatctccaaaagttatttctttttaggactgcctacttaccttttgacgcttgcatactatagggtttaaaatatcgatcgaacagcttaaaagacgaaggggggatttcggtaaatatcttgaaggagtaattaagatagaacttatgaaaatgaaatgaaatttgtaagagataaactaaagtgaaattaaattaattcatcaaaacacatgaaattataatgaaacatgtagaaaatactgaattcgcttatgattgcatttaaattcagcattttataccaaatcagttcaagccattagtgaatgggacaagatttatagtaaccgccgagatctttcccctttatttctagaccattggatgttcaacctctaactacagtcgagattaagttgatgaagaaacataaatatgaaagtatctaagaggaaaataacatacatgaacacacgaacctctgtatatatatctcgcaataaatttttcgatatatgtaccatgaaatataataatttcacatatatttgtcctagactgtgaatattggtcagatggtgggactattttgtcgttttgtatatattgactttttacatatggggacaattgagaaatcgaattcgcatatatttctattagttattggaccactataaataatgcaattaatgttttctttcattgtatgtaggttgcttgtagaagaaggtttcctttttcttggtcagtgaaatgtaggtaggaataggatgagatgtttttgtttgggagggtacagtcattgggatgacaaggctaattttctgtgcgcgtccggatcaatctgaccttacaatatggtaggatgagaaaagatttcttcaggtgaacagtacttgcttagctctgagatcttacctaaattgatagatgtatctgacctatatgcagaattgaagtaagacatggtcttgtcatacaattaaatatcagttgaaattaggaacaaaatcactaacataaacaggactagggacacatatagactttcaggaacgatcttgaatctggtagttatatgtacctggtagacaatctgaatagcatcaatgctgtacttaattgggacatatatatatacatagtagtataatacaataaattttgtgcacacagcaagcaaccctaattaattgcatgatctgcatatactactcacccatgtaagcgtgctatgatgaatctaacagcaaaaactaatgaacaaagagaaaacctctaggttatcaattaatttacttcgctttccaaattggctcaccttcccctatctaccaaaaaaaaaactgacagatataataaattaattaatccatcagaatttcaggtgtgatgatggtcgtgcagcacaaacctaattaatttatatatccaagtatatataactgattaattcctacatgtatttacttactatatatttgcaagtaattaatttacatgttgaattaataaattattaatctaaactacacaggcgggaatgggagcgtcgtcgtcggatcaccaaagtgctatggttgatcagcggcggcggcagcagcagcacgacgacgacgagcacgaccaccggcgcggcggcggcggccaccactacgtcgggcagcagcagagcgtcgcggcgacgttccacgtcgtcagctcgccggcggaccccatagccaggctgatgtcgccggcggcggctcaccagggcaccgtcatgctccggcagncggagccgccgtatatttaccatcaccaggtacacgatcgtagtagctcgctaaaaataacgacgttttggacttttcaaatacaaatttgactaataatttaattctctttggttatacatttgaaaaggttatacaagtgtgatatatattgcgaaagaatttgttatgataaacttagctagctatataatttttatatgcttaagacgagtgactttagcgtggtgtctactggtaatattctaaatcttacaacataattcttgtgatcattgggacgtagtaatagattcgaaattagcacgtactacacttcttttggcattgtagcccttgtattaagccacgtacgtcatgatatatatccgtatacttctattaattattaattagtattgtgtatatatagtaattgactgtcaattagtcctattaattaattgtttggtctgatttgcgagaaaatgatcagcaggaggatgaacggccacaccaaccgcgaaagtttgatgggaggtcgacctctggttctggactggaggaggtgatcatgggctgcacctcacggaggtccaaaggaggggtacgtaaccatatatttcacgtatatatacatatctctctctcacacacagactgcagatacatactctgattttatatgctttacatccatctcatgtacggttgcacatccaacaacttgtttgatcgtagctagtggcattcacgtttaacacggtgcttagatttatctgatatagttagctactccctccatcccaaaacacaataactatatatgtatctggatagagatttatctagatagatacatatatagctaaaatatgttttattttggaatggtggtagtattactacagctatttaagaatgtatatatagttgtgttctaattttaggaataagcacaagaaaagtataaaatgtattttttctaataataataataataataataataataatatcatttctagctatgtgtacgtgttgtacatgagtggagttttctttttattaatatacaaagggtgattttacggtccttgagttagtatggagtatccacattatttgttactccccccgggctgataatacttgtcgttttagacaagggtaaggtcaaactttataatctttgattataaatcatttttaaaatatttgtcttttaaatatggtgactacatgtatagattagtcttaaaaagtactttaataaaatcatatattgttaacacttttatacatattacaacggaaaataatggtcaaagttgttttttggagaccgtgcatgctcttgtccaaaacgacaagtattatcaactggaagggagtattaatttgtgttagctcctgatgcactacaaaagtacggagagacaccacaatttacaccataatgtggtacttttctgtacctctaaagaaagtagtaaaaaaactattgtgtgcaaataatatacacctttaattagcatgtaaacatgtaactgcacatgaattttttttgcttaatttgtagtgaatttatagctagctagttactatttctataactcttgaagatgaatttataatggtgggagagggtagggttggaaaagccatcaacccgggttttattcaacgtgcatactttttttttaaaaaaaaaacaacattgttttattcaacctgacatttcacatatagcatcagggaacgtgcatacttttttaaaaaaaaaccaacattgttttattcaacccgacacttctatttagctgttccttgtgctatttttcatatggtagaagctagtttttcgtcataaaatattccattcagttatacaaaacaatgtggatttggaaacttatgcatttggctagcggtttgtattataatatacttgtaaagttgtaacgcctagcgtgattatgttatttggatgaaatttatgtgagaaaatataatggggaaatgtagctttgtcatttatgatggcatttttttccatgcctgcatagaaatatttgacaaccataatgcattcatattttttcccggaaagttgagtgtcctaattttgttcatggtgaaaaatgcattattttattatttgatatctaaggcacattatattttgttgggcgaccaagtacaagattatgtgtgtttctctttttgtcttttaaataatataacatatagcctcttgcatctgggtaaacactctttaattaatctttttttaactgtttttttctctccaggaaacatcaggtggtaaggatggcacagaatggcagtacccatccttctggccatctgacagccaggatcatcatgggtaaaagagcaacgtatctagctgcaccttgagtatgagtagtagccaatctcggtgaggcaaccaaaagcaaaacaagaaccctgacaacatcattactaccatgataggagcagcatacatgcactatatacactcctacaagactaaaagctcaccagcttagcacatagcataggaggcaggagtggcttccaagaaacacacaaaaggcaaagtttgcaacaaaatccaaccccctaacttttatcccccccttctccctctatctctctcttcctcctcctcctcctacttcatctttctcttcacccaatgtgtctggataacgggatggaagtttcatttgagtgctcaaatttacatgtctaaagagacaaagatgatattgaagcaaagcaaaagggagagacagaaaaagaaaaaggagaggaaaaacaaaggtgacatcacaaggaaggttagttaaccgtcggttgctcaggcggattgatgcgaaatcatcaccgcgatcattgtttaccgacacctttccgacaaagtgattgaatgttagtctaataatcaggagtattgataaatattttattacttttgttgtattgatttgattggttaatattaattgtacaccattacccttttccttttgtcttatactgagaaaagaagctaacatgttggaaaaagaatgaaagggtcaatttgtaaagatggcacaagttctcatttgattggtccatttgtttctacagatttgaattttttatagtttctcaagatacacatttgccaagaaatattccatgaacaaggaaactctaaagatttctaggtatgcatggctagctttagttccaaaatcttcctttttcctaaggaatatctttaattggttccaaaaactcctcagtggcatgcatgaggagggaataaatgtttccatattcttctgtgattctgtcacatgcaaaagaagagagctagctaggcgcaaagaaaagcttgtcatatctcttgctataaacgaaaagcttgatcttaccctcttactccttctgtacctctttcctctcttgcttttgatttcttttttttttctttcaaaaagattttaattggaccatgggcaacgttaaaattgctctctctgcatgtgtttagtattttgcattctggcatcttgtcagaatcgaagttgccggagaatttcccagtgtgtgtagtggagggagaatatgatgagcatggcaatgcatggatgaacctgatactgcccttttcagattcctccaaactgagattaatgtgaatgtgtgaatgaaatgtaatcaccttttaatatcagtaccacttcttcatggcgagagatatgacaggttgtacacgcatttggcgtacgtaaatattgcataaatgacactgattaatttcttttagttttagttcgaacaaatactcagtgcaaacagttaaatgtgtggcattaggggtgcggagtacgtcggtataactgaacaaaaggtccaggtagttcggttttagaaaaatcgttcgatctatgaaaataggaaaccgaactttgtcaatagaaaatcatgaactgtgatagttcggtcaatcgaactgtcgatcggttcggcggcgaaactagcatgtagcaatagcgggcatcatgagggaatctgttggagagagaggcaacaatgagggagggtcgtcacagatctactacaagggagaccgctagggggcggacctaggctctgagggccaatttggattgctaccctaccaaaatttgccctaccaaaattttggtagggtagcaaaccaaacacctctactaaaactctaccaatgctataaatttggctttgcctataaacttatctcttatgggtaaattttggcttcaatccaaataaacattttcaactctacactaccaaaattttggtagtaccaaaacttgcccaagatttggcactaccaaaatttgacatcaatccaaacatgccctgagtaacctgggtgtgtttggccgcttgagacaaaaggcccatagagcactctgatatttcaccatgtaaatttttattgggccgaaattctaatggagcggcttgggccttggcccatttatgtgtccacccctagagaccacaatggcttatcgggctatgatccaatgtttttttttttcatcctctttgtctcgatttggtttgtgctactccgaaatatgcaaatcatttgatgcttaaaagttaaggtacctgtggtagcagcctgaagagctgagtgaaagtcagtccatgcaaatgatagaccgatctaagaaacaccaactaatggttcggttatttcgagttcggtattggtttttggtcttcatattttctgtacctatccctatctgacactctaccggtcaatttgtttatttttcctagcatgattaattaaatgatatatatcatatctagagattaattcacattaattgtgcgctcggtgtggtgcaatattaggaagaaaatgacaatggttatcagtacaaatggaaaatggacagtgacggagcgcggggctcctcaccgggagaccgcgcaggcccccctttgccggttcggccgggggctcagggtgatgatcccaagctctctctgtttgtggaaagatcgcgacctctcaaaagagcatgaagcacaagcgatgtatacaggttcgggccgctgagaagcgtaacaccctactcctgtgttttggtggatctgtgtatcaaggagctacaaagtgtgagccaacctcccccttttcttctagctactgaatatgg

SEQ ID NO: 87819 - DNA, 744 bp, Oryza sativa
  unsure (1)..(744): unsure at all n locations
atgttcaagtacgacnagctgtacagnannncatcaacgatgattggggagtaattccatggaagagttgatcagttggtatcaactcgttttgcggaattcccatcgcgtccaaagtgttggcgaaaagaagattgattgagctaccaccgtcaatgagaactcgcgctaccttgatgttccgaatagtgggttcgaccacgatcagatatcgtcctgggataacgacggtcttggggtggtcttctttccgagaactctatcttctgctcagaccacttcatcttgggtgtagccccctgccatgtcgagcagacttcatgttccactttcttgtattctcgcttggaggagtacgttgtggaaccgccgaagatgtgtgagacgtggaggtcgaagtctggatacgctgagtccggttcgtgaggagctgtctcttcgttcgtctcgacaacgtgtactcacttgcctttttcaaatgccatgtgcttctcgagcgactttttgaaaacaaggcaatcttccagagaatgtctgtccgtcttgtgtatagggcaccatgatttctttgggtcgctgctttgggggtctatgcgtttgggagggttcgcgtattctgctgcgaggacttccgcttgagcttttcttttcccggttttgcgatttttcttcttgcttgactcagatgtgtccggggctggtttcttctctcccccggtcttcggcctatcgttctttgcgctc

SEQ ID NO: 87820 - DNA, 1144 bp, Oryza sativa
gaaactacacgctggcacgcaaaacgagaaaaaaactctaataaaaaccaaggaaacaggacataaaaactaaacaaacatgtagagctcaattttagatgaattttgcaagttgaatggctcaattcggagttcgaatgaattagatatggattttagaaattttgagccatttaaatgaatttctagaattaaaccgaattattgcgcaattaataattaatttctcaaaggaaatgacaagtgctgacgtcagcaaagggccggcgccgacaggcgggccccacacgtcagcgagccaagggggcggcccacggtggactcggtccaccgcggcacaggcgcgggcgcaccacgtggacggccacgtggcggccacggcggacatgcggcagaggtggcgccgacgtggcgccacgagggcaccgacgcgggcggcgccgaacggccacgtggacggcccagattcactcgaggtgcatcgggcggcctcaggcgggcgcgagccggctcgccgaccggccgaccggggagcggcggagtgcggcgggaaaagggagggggagctcaccgagtagcatacgacggaaggaggtggccggcggcgagatggcaacgcgaggcggtgacggcagagctcgggacggacggaaacaacgacgctccgacgacgggcggcgctcgggaagaggcggatgagcggcagctgcaccctaggatgggaggggaggtgttagggaggacggagcggcgacatggccggctggagaggaagggaagggaggaagggctcaccggcgcacgggaatctggacgtccagtgagtttccggcgatgggaagagatggccgaggttctcctcgtccttgtggagccgagggaggcaacggcgtgggtctgcaatgactgtagcagcggggcgacgcggctggagtcggccagtggtggtggtggctcgggttgacgggggaggtgtggatacggtggcgatttgggaaaacggagcgaaggccggggtagagcttggcacggcgttgccgacggcgcaagcggcgaggtgcagcgacgactaacgcggcggcaatggccggctgaaggcggtgtgtggcggtagtggctcggcctcgcgatgggagggtggttc

SEQ ID NO: 87821 - DNA, 568 bp, Oryza sativa
atttggatgcttgtgttggtgtaaccatttacaacgagcagttcctgtcctccatagactaggaacatatccttagttcttctcaagtactttaggatattctttatagcaatccagtgactcttacctggatctgattggtatcggcttgttgcactaattgcatatgaaacatctggacgtgtagataacaggcatacatgatggatccaattgccgaggcatatggattcacactcatcttgttttgctaatcagtcgtttgaggacactgattcttgccaagattaatgccatgtgacatcggtaagaaacctttcttagaatcttgcatgttgaacctcttcaacacattgtcaatgtatgtactctggcttaatccaattagcctccttgatctatctctatagatccttatgcccaaaatatatgctacttctccaaagtccttcattgaaaaactattttccaacgatgtcttaacggatccaagcataggaatatcattcccaatcaacaatatgtcatctacatataggattagaaacacctgtgcgctcccactaat

SEQ ID NO: 87822 - DNA, 1739 bp, Oryza sativa
gtcccaatttgtctttcctaaaaatttggggctgtgaggggctatgtaaaacgtttgagatcggacaaactcacatctaaatcagataaatgcttctttgtggggtatcgtaaggaaacaaaaggatattgtttctataaacgggaagaaggcaaagtgtttgtcgcccaacacggtgttttcttggaaaaagagtttatttcaaaaaaggatagtgagagcatggtgggacttgaagaaatccaggaatcaccggtaaacgcttcaacgtccacacaaccacaacaagttgagcaagatgttgttcaattggttgaacaagttgttgttgaaccagctgtggaagcgccggcttcacgaaggtccgataggatatgacgtacacctgcgagatatgcgttgttaactacaggacaacatgatatattgttgttagacaacgatgaacctactacctatgaggaagcaatggtggcaccagactttaagaaatggcttggagccatgaaatccgaaatacaatgaatggatgacaatcaagtttggaacttggttgatccacctaatggtgtaaaagccattgagtgcaaatgggtctttaagaaaaagacagacgtagatggaaatgttcacatctacaaggcacgattggtggctgtcacaccctaaaaatcctgaatttataaattgttgtttaaatagaattattagaaatgattttaaaagcctagaagaaaagatctaattttaaataataaattccaatataaaagtgggccagataaaattttattaaatacttctatagttccaagatttttcaggaatttatttgagtcaaggaagtatttttaataaatggaattgcatttcatgaataatttaaaaaagaaaaaggttttaaaaatcctcttttcgctttgggccgaaagtcggcccaattctctccctctctctcctcggcctgcttgcacccggcccaaccagcccaccgagtcgagccgccgctcactctcctctctcccgctgacaggtggggccgtgatcttcctcgcgcccgccagccgcgccctagccgcgcaagccggcgccgcccccttccaaaattcgcccgcatctttccatctccgatcaaatcaatagaggggaaatgatcctcgggatcccctcttccttttctcttttggaatcttcggctaatttcgtttggaaatcgttggattcgagctcgattcggattcgttttttcctcctaaccctagaccttccatcgccgttgttggccgccgtgggcctacatcgccgctcctagcccctatataaggacactcgggacctcctcttttcgtcgccaccctcgcctcagctcgccgccgcttgtagcgccgcctccacgacaacccgtgcgccgctgtcgccgccgcgagtccagccgtgcgccgccgccgctctggtcgtcgtcgtcgctcgggaaggccactgttgggttcgccaagtcgtcgccgtcctcgtcctaccctccgtttccaccgaggatcgccggagcaccgccgtcgtcgtcgacccgaacgcctccgcagcttcgacctcgtcgccgtcgctgtccgttgccgtccgccgtcgtccaagccctcagtgagttcgccgcgttgccctctacgtgtaggtgccctccgtttgcgccgtcgcgccatcgttcgccggcgagcgtgagttgccgagccgccgccggtgatgac

SEQ ID NO: 87823 - DNA, 620 bp, Oryza sativa
atcgtggtggtagcgataagggcggccgctcgctcctcctccacctcacgagcgatctccgtcagcgccgccttccgggcttcaagctccgagacgtgacggcggtgagctttacggcccacctccaccatggcgtccaccgagcgccgcccctcctcaacgcgtgcccatgcggcctcgagctccgctcgttccgcgcgcagggcctccacttgggcgctgaacccatctagcaccgcggtgtttgcggcggccaaggcctgcagaatgggctcggcgctcagcggggcgacggaagatgaggagaagagccgccttggagagaaggcgatgcggctcggccccccggaggacgtgctgggctcggggatgtcccccggacccgtttgatcctgggcgtcgcccggggaggtgggcccaggcgatgtgcccgcggcctcgtcgtgagcctccccggaggctgtcgcctgagggttgcccgagggagtgggcccagttgatgcgccagcagcagttgttgcctcagcctggcgagcccgggcggcctcctcccgagcagcttcctccgcttggcgaatccgggcggcctcccgggcggcctcttcagcttcccgaaggcg

SEQ ID NO: 87824 - DNA, 552 bp, Oryza sativa
accatcttccacattacagtcatcatcatattcacaagggatctttagatgacagttgtccaccttgtagtaaccatattgccccagatcatgatccatttatcttgtcaacctgtaacagaaaaaaaaacaaccattgatacagtattggaagaaagaagatcacatctaaagaatttgagaaatagcaccgtacaaaaattgctggccacgcaatatcaagtcgtacgacattgccaataattttgtagcctttgtatggcctgatcaattcttcatattttgccaatggaaaatgaacatgcaccatcaagtattcagttcctagctcaatacctgcaactttgcgtgttggatcacagcttacaattgaagcaacaaccacattcttatttcgatttttccagcttttcaagaatacattagttccaatctggtgcataaatatatgtccatcagcattatctctatataaagagcaattaagtatggaaaagaacatcatattaaaagttttacctccaatgaattggcatccataatgtccactat

SEQ ID NO: 87825 - DNA, 4228 bp, Oryza sativa
cgtggactagaatcactggtaccagatcacgcgtgggcgtgattcactttatgtcaacaggcagcgccgaaagttgatagtgacaactcgagctgccgcttttcatgtgtgctgttgtggactgtgcgcgctactggatctgacactaccgtgaagcgccgaaagtgtgttgtcgtgagcataatttgttctagcaccatatgaatgaaaagaactatggtgacgaagacaaacacaagtagtactgcagtagtaatagcaaaagtagtactgctttacaagtttgtaagccaaaagaaacggtcacataaggactgaagaggtagaacactactgacgaggccttttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggaccatcagtttcatacaggtatttaatagtattaataaaaagtaaagtaccgtgtgggcgagggatcgacgctccgtgagaggaagagctggcgaacgcgcccgaagaggtggcgaacgccactgcggagctcgcgaaagcgccggtcgtgcctgcgaacgcgctcgaaggcagacgaggtcctgcgatgaggaaacgtgcagttaaaacatggtgacatattcgtgcaaaagctgaaccaaaaatgaactaatctttgggctgaactgtaccgtgcgaaaccggtgctgtaggtcgcactgctccgaagctaggggcgctcgaaggcaaacgaggtcctgcgaggatggaacatcaagttacgacggggtgatgttttcgtacaaaaacagaaacaaaacttaagaaacctttgggctgagcagtaccgtgcaaaacaggtgccgtaggtcgaggtcctgctccgacggtaggcgcgcgaggccgtggttgtaccggaccagctggaggtacgacgtccacggcgctgtgacaggagaagacgcgcatgaccgcatgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtaattgtcctatattatgcaagataaatgaaataattgtaagaactaatacaaattcgacgtacccccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaacctcgtctcacctggacgtgagcgtaacgacgctgcaataaacatgatcggaattagacatgttatgtgaagaaaaaaaagaagacgactgataaacttgtaacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagcccgaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatccaccttccacccaaaaacaccgtccacgggaccaactggtgctcccgccagcggtagcccgagcaggtacgacacgtcctgtagtgtcggagccatctccccacagggaaggtggaacgtgtgcgtctcaggtctccagcggtctaccagagcggcaaggagtgaccggtctgcattccaccacttcgctgggtcacggtcgtccgccgccgcctcaacaagcctacaaagtggtagaaggcctgccgcacgtaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttgaacagcgccggtgtgtcgtacgccatacctgcatcaaatagattgatcagaaacatataaataattagttcaacataagtaataaatgttcataagcgaattattaacacatattaaacaagagtacaaacaaacaaaagtgtcaccatacggaatatttctgattacaacaataactgcagttacacgatatgagtacttagtccgaacactcatcacgataacattatgatacaacaccgaatagttcgcaatactactagtacaacaatagtcggaggtactcattacaacaacattcaattgaaattacacgatagaagtatttagtccgaacactcatcacatcacaacagcattttatttcctaaatcgatagcattgttacaccatggaatcgcctgctgcgcgacaacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagaccacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacgacttgcttgtgatagataccacgcctgctcctatcaacacacattatttcatacctatgcacttgagtgccttgagcaacaactatatgagtgcgcggccttttgattatatctacatggaccttggaac

SEQ ID NO: 87826 - DNA, 612 bp, Oryza sativa
attcactgggaacaacttgacaggaacagttccactccctctctacaatatgtcaacactcacattccttggcatggcagaaaataatctgataggagaattaccacaaaatattgggtatactcttaaaagcatcgaaatgttcattctgcaaggaaacaaattccatggtcaaattcccaaatcattggccaaagcaacaaatcttcaattgattaatctcagagaaaatgcattcaaaggtattattccttattttgggtccttacccaacttgaccattctcgatctaggtaagaaccagcttgaagctggagattggactttcctcccagcattagcacatacacagctggccgaattatatttagatgcaaataaccttcaaggaagcctgccaagttccactggtgatcttccacaaagcatgaaaatattagttttgacatccaatttcatctctggcaccataccacaggagatagaacaactcagaaacctcgtactgcttcaaattgaccataatttgctgacaggcaaccttctgactcacttggaaatctttcaaacttactcattctaagcttagcacaaaacagtttttatgggaaa

SEQ ID NO: 87827 - DNA, 688 bp, Oryza sativa
cagcaacagtggaaaaaaggcgatcctagcggggcttcagctccactccacaggcaaaactcaactggggtctgagccttggtcttctaactccgtcttcagctcagaagcactacacttctgaaaagggggaataatagcaaggctgagtacaaccaccgtactcagcaagccacaccaacgatgcagacgtgcaaggggaatacaaggatggtttgaggctatttgcataaaaggcggttgtaaaacgttttattgagcaaaacagtaacactgttgagtaattaaagtagcattaaatctccactgatcaacgctacaccacgttgaacaggcccaaccaaaacacctgaactacagtgcattgagtcgatttattaaggtgggactaatcacggtgaatctggtcgaccgcccataaccgcgggcacggctattcgaatagttttactctgatcagaggtgtacaactgcccacaagacacagccccacgacatgttaccgtgcgctgacatgccaccacgacataccggaaagaggccatgacaggacctttcgcataaccccctctaaccaagcacaccacaccttaggtttcaaccccactcctcgcaaggcagcgggcagtcccctctcgtgcctaggtgaatccggaagctgcataggccgtcgcagggcccatccaaa

SEQ ID NO: 87828 - DNA, 1235 bp, Oryza sativa
atgttactactgtttagctaactaactaatcaggtgagccattaacgagcgacatggacggacacgcgcaggtgcatcccaactcgaacgcgctggtggtgtcgacggagatcatcacaccaaacttctactggggaacccggcgggacatgatgctgcccaactgcctgttccggatgggcgcggcggcgatcctgctgtcgaacaggaggagggaggcgaggagggccaagtacaggctgatgcacgtggtccgcacgcacaagggcgccgacgaccgcgcgtaccggtgcgtgtacgaggaggaggacgagcaggggcactcggggatctcgctgtccaaggagctgatggccatcgccggcgacgcgctcaagtcgaacatcaccaccatcgggcccgtggtgctgcccatgtcggagcagctgctcttcttattccggctcgtcggccgcaagctcatcaacaagaagtggaagccgtacatcccggacttcaagctggcgttcgagcacttctgcattcacgccggggacgcgcccgtgatcgacgagctgcagaagaacctggacctgtccgcgcagcacgtggaggcgtcccgcatgacgctgcaccggtttggcaacacgtcgagcagctcgctctggtacgagctcgcctacatcgaggccaaggggcgcatgcgccgcggcgaccgcgtctggcagatcggcttcggcagcggattcaagtgcaacagcgccgtctggaagtgcctccgcacagtcaagacgcccgccgacgggccgtgggacgactgcatccaccgctaccccgtcgacatcccggaggtcgtcaagctgtgatcgaatccatggtagcctcagcctcgccctcgccggcggccgtcgcgccgccgccgcattacctcccctacacctgtacgtcacccgcgaagcgtgcgtcctcaaactttggagcttcttaatttgtggtgttttcttctttcctcctttcccctccctcgcttcttaattttttttcttgtcttccttttatttttatttttttcgctataaacacggattaaatcgatatactttgtctgatgtgtcacataaggaatgatcattcacaggagattaattattatatatttttttaattttccaatttagcgtggccgtggttgttcgattgttcgtgtcaggatccatgaagagggagagggattggggaattgaggggcgtgatcg

SEQ ID NO: 87829 - DNA, 553 bp, Oryza sativa
  unsure (1)..(553): unsure at all n locations
atctgcaggtcattctcgcgcatggcatcggcataggtccgcacggaagggtccggggtggcctcaccggcggcgaagggatcatggcgctccggcgagatgatgcgggccagccggcggcggcgatagtcatcctcgcggtcgatgatgcgctgcgacttcttggggaggccgtcgtcctcggcggcgcgggggatgtcggcggcggcgacggcgtggccggtgtaggaggcgaggcggcgggcggcggggttgacggccgcctcggagtcgtcctcgggcgcgtcgtcctcggaggcggggatggaggtgtcgtagccggcgaagcggttggggtcggagccgccgccgccgtagagatcggtgtcgaaggtgacggaggagacggccatgggcgcgccggcggcaagggcctcctccatcttcttgcgctcctcctgcgcccgcgcgagctccgcgtcgatggcgtccatggcgacggcgcggcggggggagaggcggttagggtttggggggtgcgggnnnnnnnnnnnnnnnnnncgaactcgaatca

SEQ ID NO: 87830 - DNA, 515 bp, Oryza sativa
cccgaacaacaaacagagacgcagctcagctggcacatacacattccatcgcggcggtgcaacaacgtgagcaatccatggcgccatgacaacgacgagacagcaagatgcatcatgcagcatgtggcgcaagcgtggcatgagctgacgagcactacgcatgcaggcacacgcgcgacggcccggtcggtgaactacggggagagaagaaaagaagattagttacctccttgatgaggtgcggcttggtgatgaggcaggcggcgctccagagcgggtcgttgatgtcggcgccgagcgcctccagctgcgtggcgaatccgccgtcgatcacggcgcacccgccggccctcctgacgatctcctccaccgccacggccatcgctcgatcgatcaatctatcaaccaaccaatcacttgtcgcaccaccacccccaacacgcagcagcagcagcagctagccgcgcgcaagtagatcggactaagagatcgatcgatcgacgagctgaagccac

SEQ ID NO: 87831 - DNA, 850 bp, Oryza sativa
tacaagaaaaaccttaaattatttattgcgcaatatattccagggctgacgtcatcaaggcggggcggagccaacaagcggggcccactggtcagcggctcaggggagagcggttcaccgggaccgggaccacgcgggtggtccaccgccggtccacgggaccgacggcccagatcgccctcgggccgatcggacgggcggcggtggaggcagccgccgggctcggctcggcatcaaagccgaccggccgacccggggctaacggcggcggcacgcgcgcgtcgcgttgccagcgacggcatccggcggcggaggcgacggcgcaaaagcgacgcgaaagcggcatcagtggacggcggcaacgaccaaaggcgacggcgagcgcgggcggcggcgacgcacggggaaatcgaggaagtaaaggaaaggggaaggagtcctcaccgaaggggacgacggcgtccggcgacgaggagcgacggagggaagtcgacacgcggcggacggcgaccgggacgacctaaagaacgaaacgaaagagattagagaggaagagaggggccataggaggcggggatgtcggccgaaggcggcggacatggcgaccctcaccgtcgcacgacgggaacggctctccggcgacggacctcgacgaaagaggggtggacggggtggatctcggccacgcgaacccgacggcggcgacgacgcggtgcggcggcgagcctagcggcggccggagtagcggaaacggcggcggcgggtggttgcacggcgcgggagcaatggggagcacgagggagttcggcgagaaaaggaaaaagcgagagggagcgacgggaaagcttaa

SEQ ID NO: 87832 - DNA, 613 bp, Oryza sativa
tccccctccccccctctttccctctctcccgtgtgcgccgccgtcctccgcgcgcgcaccgtcgtcttcggccgccgccgccgctttttgcgccgtctgccgtcgccgtccgcgccaccggttgccgtcgccagcgaccgcgcgtgccgccgtcgctcgccacgcttggcctgccggctttgaagccgagccgagccaccagacgcgcccctcccgccttgtgccactgccagtggggcccacatgccggcgcccctccctctctctcttgagccgctgactcatggggcccgcatgccggcgcctccccttccttgctgacgtcagccctggggcaatattgcgcaataaatacattaaggcttttctttaatagtaaaaacacaaagaatcttctaaaaatcataactaattcatccgagctccgtttaagcccattcaagtctcagtaaattcataaaaatgtatagaatccattaaaaatggttttggttcctgtttcagtagtcttatagcatgttttgcttgtgtgctttgtttggcgcgtagatttcgcccgtttcgtcgattcgtggtttctcgaagacgttgctgtggttccatcagtgcgaga

SEQ ID NO: 87833 - DNA, 706 bp, Oryza sativa
  unsure (1)..(706): unsure at all n locations
ccaggtcccctcctggatctgcttcagctcagtggacggcaagaacctgtgctcagaagagagctttgcagagtgcctccaattcctcaacgccagcgacaaggtgaccatcgtgggtgtcaactgcacgccccctcagttcatcgagggcatcatacgcgagctcagaagggtntgcaccacttctttcagcaccatngactcattcttgcacacaccccaacatttcttttctgcacgggtctgcaatcgtctgaaactctgaatgtgtttctgacagcaaaccaagaaggcgatcgcggtgtacccgaacagcggcgagatttgggctggcagagcgaatagatggctggtgagcacgacctgttacacttaatctgttctcatcgctggcacgccaagaaagattagcacagatctgttctcatcactggcacgccaagaaagattagcacatttccgtgcgaattcttggtcgtcttgatcatcaaactgactggtttttttgatgcgtcgcatgcacagccggcacagtgctttgggcacaagagcttcgacgcgctcgctaaaaggtggcaggaggccggcgcgagcttagtcggcggatgctgccggacgacgccgtcgacgatccggaccgtctccaaggtcctcaagggcaagacgtcctattcagcaactcagatttgagaccgactactgggta

SEQ ID NO: 87834 - DNA, 5127 bp, Oryza sativa
tgtgttgattacaccgacctcaacaagtcttgtcccaaaaatcccttcgggttacctcgcattgaccaggtagttgactcaacggccggctgcgagttactcagttttttggattgttactcaggatatcatcagatctgactaaaggagtccgactgcttgaagacttcattcatcacacccttcggggcctactgctacatcaccatgccttttggattaaagaatgcaggagcaacttatcaacgcatgatccagagatgcttttcaactcagattggttgcaacgttgaagcttatgttgatgatgtagtcgtcaagaccaagcagaaggatgatttgattacggatctacaagagacctttgcgagcatccgcgctttcaagatgaaattaaaccctgaaaagtgcatcttcggagtaccgtcaaggaagctgcttggctttatggtgtcctatagaggcatacaagccaacccggagaaaatcctcaacatgaaaccgctgagctcctagaaagatgttcaaaagttaactggttgcatggcggcgctcagccggttcgtctcacgactcggcgagcgggggatgccttttttcaagctgctaaagaaaactgataatttccagtggggacctgaagcacaaaaagcctttgaagacttcaagaaacttctcactactccaccagtcttagcttcgccacatccgcaagagccgctgttgttatacgtgtcggcaacttcccaggttgtaagcacggtcctggttatcgagcgtgaggaagaaggccatgttcaaaaagtccaacaaccaatctatttcgtcagcgaggttttggccgactccaagtcaagatatcctcaggttcaaaagttgctatgtggtgttttaattactgttaggaaattatctcactattttcaaggtcactcggttacggtggttacatcgtttccacttggggatatacttcacaatcgcgaagcaaatgggcggattgcaaagtgggccttagagttgatgtctttggatctatccttcaagccgcgaacttcgatcaagttccaagctttagctgacttcgtcgccgagtggaccgtatgccaagaagacacgtctacggagaagatggagtactggacaatgcattttgacgagtcaaagaggctatcaggcactgtagcgggggttgttctaatttccccgactggagagagactaagctacgtattgtggatacatttttctgcgtctcacaacgtggcggaatatgaggcgcttcttcatggattaaggattgcgatttctgtaggaattcggcgtcttatagttcgtggagattctcagttggttgttaatcaagtcatgaaagagtggtcctgccttgatgataacatgaccgcctatcgtcaggaggtatgcaagttagaagataaattcaatggccttgagctaacccacgtccttcgacataataatgaggcagccgacagactggctaattttggtacaaaacgaaaagcagcttcttccgacgtgtttgttgaacatctttatgagccaaccgtactaaggaaagaaataatcgagaccacggacactcaagaagtaagcacgattgaagccgactggagagagcccctcatcagatttttggctaaacaagagctccactactggagagggagaagctccctggtgctaaaaacacccggcaacaatggaaaaacacccggtaatcactgttgccgtgtacctcactccggaatcattacccgggagtgaaaagaaacggcggcgattgcgtagtgcgtctaaaaacacgggaagccttaatttacggagcgtgcgtacgcctggaacacccagcaaacaattttctgttaccgggtgcatagcatctaacacacgataagtctcagtatttgcggagtgcctataaaaccatacgttcatttgatactctgtaatgttcccgactctggcattatttacagtattgatagtgcaatatttgcttattcatttattatttgcaccagaacagcagcatccaaatcacacatcaacacagaagaatggattgaaatgcattgacatccatgttcagttaatcaatttgatgacaatctaatatggaacaattgaaataccaatctcagaaacagctacaattgagatgaatttgagcattacttcctctaccaacaagcttgggcaaccaggaactcttgcaaacagaagaaaacatcatatgaacggcaccataggcagtttgaccactcctcataacatagcaaataagccgattgactaggaaaacctgaacctgagattgcataaaagagagatcaatttcacataaaaaagtggtgacactttcatgtgttgtactaaaacaaagtgatgacacttatgtagaatagcactagcaaaataatatgaatgatgtatgcgcattgaaaacaaagtaatctgaacttgtacatcttttattcaagattatgtaggcttgttaaaatttaggcatagtgtcagtggaattgttgatggcgcatgatgaagcaatatgcgcccacgtgactgatttgccaattgcccaggcattacaaccaaatccaaataaatgattatgcagcttttatttgacagaacatcctgattactagtatataatgctcaatcaagattcaggaacaaaatagtgatttatcatcccagttgaaacaattgccattcatctatcaaaaacttatcttagaatccacaaggggttcataaaaaaattggatatcatgtagccagatcaaaagaattaactagcatatgaagtggcaaaatttggtagtattttacttcactgttattcggattcactattgttggcaaaatggcagcaccatatcataactaaaaacttgaaccacaaatgcagacatagtaaaaatggattaatatagatccatcttcttgctgagaatcaggtgtgagagcttacagcgcaggtgagtatctgatggaactggtgtacatcagatccctctagctggtagcaaaaagaatatctgcagaaatgatgaggtctgatttaggaacacaaatcctttatttcaaaagctccagagctaggagaatgcaatcttcatgtactattatttattgcatgatccttctaaaaatgaagtatgcaacatcttgggaacatctaacctagtggcatttggcatagcaggggcataaacaatgatggtccacctcatcatgtctccaattttgaactacatagtagtacttatatacagaaaacatgaatttatattttacaaagaaggaaacaagagcttgcatatggagctaacaaaatgagctttgtcagactatattaccaaataaaaaatgccaagtggaggaaaaaacttgcaggactcagatacaacccaatggaataattgacctggccaagatcattaattagattactcatcagacctgtggcaatgggtcactagttgatataatgctcgactatttgcgatacacatatataaatgcatgaaagaggggtagtaatttaatcttttgcacaaaactatacaaggatttgttagttactccttacaatggttgtttgtttccaacaagaatagtccagcaatgtgaaggaagctagataagtccacaagaaaagttaaagacctatattaaatgatcatacgtctttggactagactgaacaaaatgatggtagcttacattcatgggacctgcatggccataccattgtctggtacattcaacacggttctattgttgattgcgctcctatcaagaaaaagaatacagtgaaaatattcataagtgtaaatccattttattgttggtcaagctaacatggagtcatacatataccagaaaatgaataaatagttacttctataatcatagaacactgcctttacaaaaacagcttcagatataaagagtgtgacatatgaacagctggacaaaattaggaagtggtataagtttgttgctcgatggctttagataagtttaatatcacttctcacctaggaaaaataatgccatgcagtacacacagatctgaaagataagtgctgaaaggagattattactctaccaacctaataatatttagtgctgaagatttggcaatgagcacccgtcgtcggtatatttaggaagaacttaccgagcactctagcagcagtggcaggtagggaggatgagaggccagcactggccatgggaatgtggtggtggtggtaccaaagtggagcaagaggcaggtcgcagactcagacggagaagtagccatcgcagggtgtcggcgcctcttttcatgtcttggcgtcgcaggacagcaatagaggcaacaggctcgtgtggggaactgcagggacagtgaggatatggtgctgcacggctccttcgtacactaccacctccaccaggatggccgttgcggtcgccgtccctgtctcctcagctggcgtgccctcctccctcacggtagagatgcgcatctctgggcgtggtggaggggagcattgaccgccgaggaggtttcgaccacctcgccgccggcagcaccttcaactgctaaagtcagagggccgagtagccgacaacgatacgaggagcaccccccaactctgattaatcctactccaccccgaggcaccgacaggcacgagtacaattcctccctccccattctccatgcctagccaacgatgccgatgcggatctggtgcggcgaggagaggagagggtgagacgatcggaatcaaagccggcgtcgacgagctgcaggttgcagcctaccgcgcggaggagccaaggcggcggcggcggcggcgcgtgggagaggctgagagggattagggtgcgagtgcgactgtgcgagagtggggactggatttggggaggtgatggtggcacggacggctttggttgtctgtgaccgacggatcggacggctcacgcgagggatggttactgctgccctagaaagatgggggatttgtattcccgcccaccaccggaaattgggaatttggagggaaatatttggtttcattaaccctgattcgttttttt

SEQ ID NO: 87835 - DNA, 3557 bp, Oryza sativa
atgcattttagagtcgttttgggacgtgacaatctgcacgttcacggctggttcacctcccgccctactcgatctcatcatgggcagatctgtggcaacagtttatcaccaacttccaaggtacatacaagcgccacgcaatcgaggacgacctacacgcgttgacacagaacccgggcgaatcattgagggactatattcggcgctttagtgagtgcagaaatacgatccccgagatcagcgatgcttccgtgatccacgctttcaagtttggtgtccgagatcgctacactacccaggagttggcgacaagacggatcacaactgctcgtaagctattcgagattgtcgatcgatgcgctcacgtggacgacaccctgagacgcaagaacgacaagccgaagacagcaggagagaagaaaccagccaaggatgcacctgagtcaagcaagaagaagagtagcaggagtgggtgttaacgaccaaatttggtaatccaaggatcggatgtggaggaggaattgagacggagttcgagatagagattgtcccggaaacagagtgtgcagagttcgagtcggacagggttagccgattgagccgaatccaacaatatgacacgacacgtgttgtcgggttaggttaacgtgcttcatgatggttgccacgcatggatagagtcctgagaaggcaattgtatctattaattaggatatttcatgtaatttacttagagatatgtttgggcaaaagtctgccgcaaagacttatggtatcttagagtttgttagagataagagtcgtgtccgataaggacatatcttgtaattctcgggtataaatagacccgaggcccatgtaatcaaactaacacacgttcaatacaatctcggcgcatcgccacccttttttgctttcattttgtttcgacgagttattgctttcgggttgagctgcatcggtttcgatcttcaacgagagtaaaacttgttatggcggcttgcgttcttgggattagtgtttccatcttcatgatactctaatcttgtttatgtaattcgtcgagttatcatatatcttacataatctctagctatatcgttatctaacctacaatcggctaacatctgtcagtagaaagcagccgattaggttaaatatcgatgttggtttagattatataaggtatccaccactctatgacacatccaacggcttgattgtctagatattgtccttcttttcatacttatagctacatcagttgagtttgatcttaggagtcatgattagaatctcaatctatagcctatctttggttgccgattatggtagtattgatgtttcagccgatcttacatttattttatatgcttgattgacatgttaaatatgccctttatgctaggatcttgttgcatttaagtatattaggctctccgtttggtatattttatttgctgtgatatcttaatatagagtggtatcggagtattagctgatacatgctagatctatctgatcggctatgctatgaacacatatagtctcgttattaatatatatttcgatctaagtgatttatattgtctcggcacggcgaccgatctatcccaatcacttgatttaagtatatatcgatataaagactatataccgttaatatctacaaccgatcgagtagatttagttctttcttacttattaatgaatgccgatcgatgcactatatgacatcggcttaaagatgaatgatatgtcatcggcacctagctgatcggctatcgtttatggatttaaccgcggtttctttgtctttatttattgttgattgcaggatcaaatcagctggcacgctcatacatctaaaggcaagttttggacctacactggagttaagcagatctcctaggccttgtgtttttacatcaatagtgggaaaaggaaggctcaaacagaagtcttcgcagcagagtatgcgaacccacccaagcacccagacccacaaggcgacgacacgaagaaaatatggtgccctatacacaagtcggataagcactctcttgagacttgtttcgtcttcaaaaaggcactcacaaagcaactagcgttggagaagggcaagcgagtaagtgtagtcgagaaggccgcagaagcagctactcaggactcagactcagcctacccagactccgacctccatgtttcgcacatcttcggaggttccacgatgtactcctcaaagcgagagtacaaaaaggtggagcgcgaagtttgttcaacatggcagggggctacatccaagatgaagtagttagagcagaagatcgaattctcagaggcagaccaccccaagactgctgttactccagggtgatatccgatcgtggtcgagcccactattcggaacatcaaggtcgcacaggtcctcatcgatggcggcagctccattaacctactcttcgccagcaccttggacgcgatggggatcccacgaagcgatttgacgcctactgatcaacccttccacggaattactcctcagtcatcgtccaagccattgggcaagattatgctacctgtgactttcggccaagcaaacaacttccgaacagagcagatcacctttgatgtcactgagtttgacacaacgcatataattccatcatcgggaggactgcactcgcgaagttcatggccgcatctcactacgcatatcaagtgctcaagatgcctgggccaaagggaacaatcactattaagggaaacgcgaagctagcggtacagtgcaacaagcggagcctcgacatggttgagcatactcccaacccgcctgccacagctgagccgtccaagaaagtgagcaaaaccaacaagacactgaagccagatggcgcaatcaagattgttctgctctccagtgccaaccccgacaagactgtcaagatcggggcgtcactagatgagaaataggaattcgcgctcatcaccttccttcgcgacaatgtagacgtgtttgtttggtagccgtccgacatgccgggggtccctagggaggtgattgagcacaaactcatggtgcgactcgatgccaagccagtaaagcaaaaactgcggagattcgcaccagatcggaaacaagccatacgagaagagctcgacaagcttctcaaagctggtttcatcctagaagttctccacctagagtggctagccaatccagtcatggtgcgcaaggccaacgggaagtggaggatgtgtgtcgatttaaccgatcttaacaaggcatgtccgaaggatcacttccctcttgtcacaccctgattttcgtcttaggatttataaattatttaataaattattaatggaatttatattaaatgttctttaatttacaagtaaagttaaatgtgggaaataaaattttctaaatataaagcatggatggatttaatttttattaaattctccatggttaattatactctctggaattttctcggatttttcggagctcaattattaattttaatcatacaaagagaagttcagcaatt

SEQ ID NO: 87836 - DNA, 2255 bp, Oryza sativa
caacttctcactgaaatatgcaacgggctgtccattttgcatgagaacgcctccaataccaatcccacttgcatcacattcaacctcgaaggttttagtgaaatccggcaacacaagcaaggggccttcggacaatcttttcttcaattcttggaaagctttctcttgcggttctccccattggaaggcaacacctttctttgtcaactcgttcaatggtgcagctatggtgctgaaacctctgacaaatctcctgtaaaaaccagcaagtccacgaaaacttttcacctggcttacattttcaggagttggccaatcctttattgctttcacctttgattcatcaacctgaattcctaaacctgaaacaacaaaaccaagaaacacaacctgatctgtacaaaatgtgcacttctcaaggttagcatataattgttctttcctgagtacatccaaaacttgctgaatatgagcaacatgttcctccaatgtcttgctgtaaattaggatatcatcaaagtacacaacaacaaattttccaataaatgctcttaagacatggttcattaatctcatgaatgtactaggtgcattagtcaaaccaaaaggcataactaaccattcatacaacccaaactttgttttaaaagcagttttccattcgtctccaattttcattctaatttgatggaaaccacttctcaaatcaattttcgaaaatatcatagacccactcaattcatctagcatatcatctagcctaggaataggatgacgatagcgaacagtgatgttatttatggctctacaatctacacacatcctccatgaaccatctttctttggcaccaaaatcacagggacagcacaaggacttaaactttctcgaacataacctttatctaaaagtgcttgtacttgcctttgaatttccttagtttcttcagggttggtgcggtatgctggacggtttggaagtgtagctccagggatgagatcaatttgatgttcaatgccacgcaatggaggaagtccaacaggtgtttcctctggaaagacatcttcatattcctgttaaacacgtgcaacaacactaggaacagaggttaagtcgttagctgaaagtaatgtgtccttgcacacaagtatgaataatacttgttctgggtttctcctcacatctctcatttcagatttggtggctatcatcactaagttctctccctctcttttcttgttgtctctcatgtttggcttgtggctctcactcaccgatttgtggggggcactcaaattatttttctgtccttcttttgcactctcattcctcacttcagagctcttttgcaagtgctcagctagaatttgctgcggtgtcatgggtttaagaatcaactccttgcccttccacttgatggtgtattgattggttctaccacaatgtagagatgaccgatcatattgccatggtcttcccaacagcatgtgacacactgtcataggtgccacatcacactccatggtgtcaatatattcaccaatcttgaaaggaacttttactctttgtgcaatcttaatagaacctgaattattaagccattgcacatgatatggatgaggatgttttagcagcttcaaaccaagcttttcaaccatttctttgctagcaagattgtggcaacttccaccatcaatgatcaccttgacaactttatcttgcactttagctctagtttgaaaaagattgtgccgctgtccattttcagcatcactcatttgtacactcaaaatttgagttacaacaagagcagcaccagattcaaattcacagatatccttctcaagattattctcctcttcactatcttcttgttcttcctcactagtagattcatactctccttgatcattcacaacgatggttctattgtttggacactctctagcaacatgaccacgaccaccacatttgaagcattgaattccactactcttggtggaagaacccactgaagtagatgatgtgtttgctgcatttttcctctcatttggagcagccaaatctttcccactggaagtaccataattgctagatcgtgcaccaccacttgagctagaaaatgcacctctatttccactacctcttgatgtgaatttgcttccacttgctgcattctttgtgctgaaagacactcctctattggacttcatgtcttgctgcaattgacgttcagctttgctagcttgatgcacca

SEQ ID NO: 87837 - DNA, 4027 bp, Oryza sativa
gtcaaaactgaaccctcatggattatatactcccttacctgttcctagtgctccttgggaagatattagcatggattttgttttgggattacctaggacaaagagggggagggattcgatttttgttgttgttgatcgattctctaaaatggcacactttataccttgtcataaaagcgatgatgcttcccacatagcttctctatttttcagtgaaattgtgaggttgcatggcatgcccaagacgattgtttcagatcgtgacaccaagtttttgagctatttttggaagaccttatgggcaaagcttggaacaaggctgctgttttccaccacttgccaccctcaaacggatgggcaaactgaagttgtgaatagaacactctctatgctgctgcgagccttgataaagaagaacctgaaggaatgggaagagtgcttgccacacgtggaattcgcttacaacagggcagtacactctacaactaacatgtgtccatttgaagttgtatatggtttcaaaccactttctcccatcgatttgttgcctctaccattgcaggaaaggagtgacatggaagcgtccaagcgtgcaacttacgttaagaagattcatgagaagaccaaagaagcaattgagaagaggtccaagtactatgctgcatgggcaaacaagaatcgcaagaaggtgacatttgagcctggagatttggtttgggtacatcttcgcaaagaccgttcccacagaagcgcaaatccaagttgatgccacgaggagatggaccattcagagtgctgtccaagatcaatgacaatgcttacaagattgagctacctgaagattatggtgttagttcaaccttcaatgttgctgacttaacaccattctttggactagaagattcagagtcgtcgaggtcgactccttttcaagagggggaggatgatgaggacatcccaaccgtgcatgctacttcaagtaccaagcaaccatcatcaaacacaaaggatacaattcaaggtccacttacaagaagtcgtgccaagaaactacaagttcaggtgaattcattcctaactgattttaatttcagtacttctgagaatgttatactacctaagtgttctactttagttgtgcttaggaacatacaacatgaggaggatgaaagtggatcggtggattctatcactggagtacagaacggaccagtgaagcaaaacggaccaactgcagtgcaaaacggaccagttcaaagaactgctcataactctcaatttacagaagctatggaagtaaatgaggactctttggaaagcttatcaagtcagctttccaatgccaccaataccaagtactttggacttcacaccaatgagaaccaagtacgtttgtgaagactgctctgaaggccaggagtctgctgagtcagcacgttggtacaagttcatgttcaaaactgtaccaatctacaatgtttcgtggtgcatgtatacatggttcaaaacatagtgaagttaactttccaacgcaactgacggtgcatcatttggacttcccaagttggagttattgccaaattactgaacaccactccagaagaccaacagcctcgcgaacccacttcagaagccatttcgtggaggccctttcacatttttagtcttttcatttccatctcgaattcacacctatctagcagggctgttgctagtgtaaataacccctaagaccattgcaaactcagacttttgataatccaattcggaaccctttgttcagctgtgtgctaacaaaccccagagagagattctctaccccttttctcttgtgttttccttcgcggagattacagaagcggccgcgtcatcggcacccaatccgtgctcctgatcctcgagtttaggttgcgtaggttggttctttgagagtgtggttgggcgaatccttggttcaggctgccgtatagagacggtggttggctccttgtgcgtgtcgtcaggttgcactaattatcgctgcttgcagcaagttatcgcacggtctttggctagttatcaagatcaatcttacgtcgtgaagatcgggacaacaaccttatcagttgacggaagaccgaatgcatggcgacggttcacgaaaacggacggcggagattcatccatccaaaacggacggccaagatccatcggtccacaaccggaccatggcggactgcaacgatgacgtcggcgatgacgtcatcaccggcgacggctcggcctcgcgtgctcgccggcgaacgacggcgcggcggcgcaaacggaggacacctacgcgtagcggacggcacggcgaactcactggtgaccaaaacgacggcggaagatcaacggacgacgacagcgacgaggaagagcggcggcgacgatcgggtcaacggcggcgacggtgctccggcggctgacagcgacggcgaaagggcggacgaggacggcgacgcgacggcgaccacggcggtgacctccccgagcgacgacgacgactggagcgatggcggcgcactgctggagtggcggcggcgacggcggcgcgaggcggcacggcgctagagctctaccggcgacgagaggctaaggcgagggtggcggcaggtataggggagcttggggggtcaatttatagggtctagggagcggcggcgaaggcccacggcgaccggtgacgggaaggaaggtttagggttcggaggagacaaatcgatccgaatcgaactcaaatccggcgatttccaaagcgatttagacgatgtttccaaaagggaaaaggtagagtggatcacggggatcctttcccctcaatcaatttcaccggaaacggaaagggatggccggatttggaatggcggcggcggcgcagctcggctagggtttcggcgagaggaagacgacgactgacgggtgggacccacctgtcagcggcggtcgcacgcacgcgcgcgggcggctcggcttgggctgacttgggccgagggagagagagagagagagcggtttgggccggctttcggcccaaaaccaaaagggacttttaaaaacctttttccatttaaattattcatgaaatgcaattccatttattaaaaatacttccttggctcaaataaaccccagaaaaatctaggaactatagaatcaagtaaagtatttaataaaattttatctagcccacttttatattggaatttaacaaattaaaattagatcttctcttctaggcttttaagatcatttctaataattcccttttagacaacaatttataaattaaggatttttaaacaagaaaagcacttaacataattataattagatcattaatgattaaataattactgaactgttctttgtatcatttaggaattgagctctgaaaaatccgagaaaatttcagagagtataattaatcatggagaatttaataaaaattaaatccaaccatgatttatatttaggaaattttatttcccacatttaacttcacttgttaattaaagaacatttaatataaattctattaataatttattagataacttataaatcctgaaacaaaattcaggctgtgacagtttactggaaccgaagcggtgatcatggtcttggtctggttcaagatgttgacgacgtgattggcttgattgagtgcgtcttccttgaggagggtgtcgagaagagtgatcggtgcagccgcgttctgctagggggtgcgaaaaaccgccgtcccctcaacgtcttgttgcccgatgagctctcgtgctcgtcgctcggcctccaaggcacgctgtcgccggtcctcagcctcctttgcagcccgttcgcgctcctgttgctcacgctgcaatcgttctcgctcttgtgcttagcgttcctcctctagtcggcgacgttcggcttcttgtcgcacgcgctgttcttctgcttcttgggcttggcgctgttcttctgtctcgttgtcggccatgaaaatgccgaagtagagaggtgt

SEQ ID NO: 87838 - DNA, 774 bp, Oryza sativa
ccgcgcgaagagataaagagagttggaccgaattcggcccaccaactaaggaagggctttttgaactttttcaataaaaataaattgtgaaatgatgtttcatttattaaaaatacttccattgctcaaataattcccagaaaaatctagaaaatagaggagcaagcatagtatttaataaaattttatctaacccaattttatattgagatttagcaaattaaaattagatcttctcttttaagcttttaaaatcatttctaataattccttttaaacaacaatttataatttaaggatttttaaacaagaaaatcacttaacaattataattagatcatttgatgattaatttaatatttaaataattgctgaacttctctttgtatgattaaaattaataattgagctccgaaaaatccgagaaaattccagagagtataattaaccatggagaatttaataaaaattaaatccatccatgctttatatttagaaaattttatttcccacatttaactttacttgtaaattaaagaacatttaatataaattccattaataatttattaaataatttataaatcctaagacgaaaatcagggtgtgacaagagggaagtgatccttcggacatgccttgttaagatcggttaaatcgacacacatcctccacttcccgttggccttgcgcaccatgactggattggctagccactctaggtggagaacttctaggatgaaaccagctttgagaagcttgcgagctcttctc

SEQ ID NO: 87839 - DNA, 797 bp, Oryza sativa
  unsure (1)..(797): unsure at all n locations
cagcgcctgagcggaggaggggacgcgtggaacacgccgctgcgatgttggtgaaggtggtggtgcagcggggcgacgagccgacgaggaggaagnanaggccggcgcgganacgacggcgttccggcgaaattcgggcgaggaggaggtgatgccgggaaagaaggcgatgccgcggtgtcgaagaagnagatggcggcgtcgatcggcgcaccggcgatgaacagcagccggctggagggagtacagtggcaccaatgtcactggttgccggcgggggcaccgttccggcgagtttccggcgaggagacggtgaggccggtgaaggggacggtgttgcagagccgagggaggcgacggcacggccggacgatgctccggtgaggagggagaggcggctggaggtggccggcaaggaggaatgagaagggcgacggcgggagtgcgcctccggcggtcaccgcgcgaaacggagggtaggccggcgaagaggaggcggctgcgatgctagaggaggcgacggcgcggccggccggcgcacgggcgaggcggcacaggcggctggaggtcgccggcggcgtgggagagggagggcgacggcggggatggggctagagaccacggggaggctcgggatggggttaaaacggtagaacggagtgcggggatcccattttatatgagagaagagggagccggccacgggggaggtcggaacggcggcggaaaagccggccggcggcaatggaaggcggccgggaatggcgcggccgttcccggcgattgggggcaccatc

SEQ ID NO: 87840 - DNA, 601 bp, Oryza sativa
  unsure (1)..(601): unsure at all n locations
cactcttatggtcttattgtggatgccctaaacagaaactaaaatgcaataactctgtctttagatgttggaaaaggaataaattctcgcttcatgcgtacgttacgtacctgaacaatcccagcgtgttgccctttccggtgattctccgccggctcaaaccatgtgccgggccaatgcgtcccatcagccatccatgtcgcgttttcaccgtcatctttgccatccttcgctctgttgtacgcgtcagatcgcttgcgaatggtgctgaacagcgagtcgatcctgaccttgaactcctcgtactctcgccgcacgcggcggcgatcgctcatcagctcgccggcgacgccgcccctgtacgcctgcgtcttcatcgcgaagtagctctccggcgccctcggctcgacgcagtgcttccggcagaagggcacccacagctcagcgaacttggcgacctccaccatnggccttcggttaaggttgggggaaccccaaggcccggttccccccccgggccccccgggttttcccggggttttttccgacaggtagaggcgacctgtcaccggtagtcggcggcgaggatggagaggatgga

SEQ ID NO: 87841 - DNA, 5185 bp, Oryza sativa
ggcctcgccgacctggtcacggagagttccttcatctacgcttacggtccctacacaagcaggctcccctcctgggacatttgggccacgacggctctcacccctcagagccgcccctcccctccgctgctgcagccgctcgagccctggctcagtccaccgatttcaccttctcgttcctcccgtccccctgccgatgagttcaacaggattgccgggatggccgcgtcctcctcgtacacagcctatccgaaagcccccccccccccccccccccacgttagcctttgtttttaacccctgcgtcagcagaatcctagatggaaagaggcgcaatttggttactagttaaaccgccgtgtcgtcgtattcttgttttgtgtggccaaaaatatggtgcctctcggacctcttgtatatatatttaggtgctaaatagttgtgtctatcatcgatgaaacgagtaattagtatgcataaatgtcaatggcttttcatgtaacgagttgcgttgttgatttctcatggattcagcaatttgctctctaatccaaacaagagggctataggatgggcctccgaatgggcgatcttagggggtgaaccgaaccctatccgccccactccatctcctaccctccgccttatcgttattggagcaagccgtgcgtcaagcggaaggagggtgacgacgggattgacttgcggcattttttgtttgcacgacatgtcgctgtaaaatctaggtgaggtgaggcagttggcatggcacgttggaggcggcggctccaccgcgccggagttgcccattgggccacctttaacatctgtctccaccgcttcccgtctcctccactgctaatgccatatggatatgaaaaacggaggttcagacaccacattgctagccaccatctactgacctggttccgccatccatcttcaatgttgtgcttaggaaagccaccgctgccaatagctaatcttacatgttatttttattaatatcataaaaaacttttgtagcaatgcacagagttttatctagttatttttaaagtgagtgtatttaccgttgaatgtctttacctacacaatagtacatgttacctcaaaccatgatagatagaaaaggtacagctcttgcatgcgccttggtctgtacatccggtgtgcggtgtgtgccaactgctagtgacaagttggcaatcttaaactttgcagagcttctctttggattccttcctcaatctctgaaacttttctacttattacaacagtgctgcgtctgtatgcgcgcgccggccatcgcgaacttcaacctcaacttcttcagagttcgtaataacttttttgcaagcattgaggttggcaaacacagtaataaaaagaaccaggagcaagtgatggatatgatgcattgttaccacttaccaccaccagacagagagagacaagcttggtagagcgtcctggcgtgcttggcatcagcgtaactgctgctgatgaaaggtgagactatgaaaggagtcaaatgtagtcacgctgcacgtacgtgtaccagtaatccgatgagatgaacaacgaggcagggttattgaatttctcggtcggatgttttctggcactgcacgtcggctgtcactctcggggcactgttattatagtgtgcaaaatatatctcaattgggccaaaaatacgacttctgtaatgggcgctatctctaacggacataaatagaagcccgacactaacaagagtcatcggtgactggcagtaaggccatatcaatcgggcctttgttgggcctagtaattatgcccgattgagacataggtagtaatctcaatcgggcctaactgtgagcccgtcactgatgagtgtcatcggtgacggactatagttatatgcaccttgcttatatctgtacgagtacatctacaacggtattaaatttaggctcaattgagatgacttcattctgacggcccatattgcccaggcatgtgatgggccgtcacagatgagagaatctgtactagtcaatgatgtttgttttcgtctagaggaacgcgctgaaagaataatactcaaatggatcgtttatgtggttcagttcccctttctttccaaatagattgttttctatctttataacatgttatttatgcctagcacattgatatctctatgtgaaaactaaatctcacaaagaaaccaggatatgccatgtcatctaacaagtattaaccgtcggatgcacttaaagacaaaataagtcgaatcaatctttacgattggatgaaacttaagtatagttgtaaaaaatgtactccctccgtccaaaaaataaaggcaaatcttagatttctgtgtccaactttaactgtccgtcttatatgaaatttttttataattcgtattttcattgttgttagatgataaaacatgattaatgttttatgcgtgacttatctttttaatttttttcataatttttttaaataagacggacggttaaacgttggacacggaaaccatggtttgttttttttgactaatcagtttcatatttagttcttcacgtacttgaactgattatttttcactgcaaaaatgcaggtacgaataattcagcaagcaaaattctggtaatcaccttgccgacagtgacagttgccatcgtagctgcaatttccctttgtatctggaatgtgcgtaagaagagaagtttggcgagatactccagacgtgagtcctctgcacataattttggcatatatattcttgttaacattcttataccaccagcgtccattaacatttcgtcaaattcatgcaaatttgccagctgatacaactgaggattttgaaagtgtcaagtcaggcctgttatctctggcatcgctgcaagtggcaaccgataacttccacaaaagcaagaagattggtgaggggggattcggtgaagtttatcaggtagtaggcccgtagtcgttacgtctacttctgaatcattgttgatttcttttgagaaaaaaatgttgatttgatggtgtgaattggcaatggtcaaaatataacttctaaattaatgactagaagtatgaatgcactactgctcaattgtgagtgagtcgcaaattttgtgtcctcttgaaacaaatggcgaagctcctgccccttgttttagaaaaaaaaactattagtgcagattatttatagtattttattaatagtgaaaatatattacatcctcgactttagccacataataattagctaacaagttctttaacttaaaaaagacataggtggtgagacaaatcctcaaatacctttgaaagaaaaccaatcgatatacttaaaaaacacaaattctagcaacaagtaagcctatatgtattaggccacacatagaaagtaaaagaccttcggtaactagctctaagaatatatagcatatccttgcgcataacatactgctccacccatcgtaataacatagaccaacatttgaaccagttggacagataacctgcattgcagagttagacaacattttttttgttattaagacttttatcattttctcaatgccaaattgacgaatttcaagcgtctaggcactcccgaagtgagttactaaatttttttggcacatcaggaggaggcatattgtaaggagaagaacacattgtcgtgcaaaatgagcaacatggcaatcaaaataggtgttgaattgtttcttgcacattgtagaaactatattgcttgtgtcctctccaattccttttagggaggttatgtttcattaagattacttttctataatttctataaagaaatcacatacaaactttgatttttatagtaacctttaaaattagttatgttatattattaggtttttaacccattacaaaattttgtatttctgtccatgtctccatgtataagttagtaagaaaataagatactaagctaaattatttagggactactgtccgggcaagaagtggccgtgaagaggatggccaaggactctcaccaggggctacaagagctgaaaaatgagctaattcttgtcgccaaacttcatcacaagaatcttgttcgtctcgttgggttttgcctcgaaaaaggggagagactgctcgtctatgagtatatgccaaacaaaagcctcgacacccttctttttggtactattagcattatctttgatcatttggtactcctgtaatcatttcactccaccaataatagtgacttttctaacatttggtgaaaaaagatacagagcaaaggaaacggttagactgggccacacgatttaagatcatagaaggtaccgctcggggactccaatatcttcaccaggactctcagaagaagatcgtccaccgtgatatgaaggcaagcaatattttgctagatgctgacatgaaccctaagattggggactttggcctcgccaagctcttcgagcaggaccaaactcgagaagtcacaagccgcattgctgggacattgtaattaagttgatggaatactttatatttttatgcttatattaactagcaaagtaatacaatcatcattgtggatgcagcggttacatgcctcctgagtacgtgatgtgcgggcagtactctacaaaatcagacgtgttcagtttcggcattctcgtaatagagatagtgacgggccaaagaaggaacagtgggccatatttctctgagcaaaatggtgtagatatattgagcatagtgagtatccccggtagttcacataggaattcatgatattgctttgcattgcaatatttgcgtatttgtgtatagccgcacatgtctatcgtaataactactgactgctgaagacatacatatttgtgactattgctaggtatggaggcactgggaagaggggacaacagcagagatgatcgaccattccttgggaagaaactacaatgaggctgaggtggtaaaatgcatcaacatcggactcctatgtgtccagcaaaaccctgtagatagacctacaatggcggatgtcatggttttgcttaacagcgacgctacttgctctcttggcgggttcctggaccttagggcaacattctttgattgatgggaagcctctggttactcaacagggttctcaacaaaattggtt

SEQ ID NO: 87842 - DNA, 739 bp, Oryza sativa
ccgcgggtgattcgcgttttctgctagtagctcatcacgaccatacagtgcttcgtaagaagccatctgaagactagcttgataactgttgttgtacgaaaattctgcatatggttgattcttatcccaacttccaccgaagtctaaagcacaagctctcaacatgtcttccaaaatctgatttaccctttcggtttgtccgtctgtctgcagatgataagcagtactaaagttcagcttagaacccatctcttcctgaagcttcttccaaaaatttgaagtaaactgactacctcgatcagacactattttcttagggacgccatgcaaacacacaatccttgccatatacaattccgccaaccgacttccagaataagttgtctttactgggatgaaatgagccactttggtaagtctgtcgactatcacccaaatagagtcatggcctgatgacgttctgggtagaccagtgatgaaatccattccgatttcctcccatttccattcaggaatcttcaaaggctgcagcaaacctacgggtttctgatgttctgccttgactcgctgacaaacatcacatactgctacgtattctgcgatttcacgcttcatacttgcccaccaaaatctttccttgagatcctggtacatcttggtactaccagggtgaatggagtataaagtatcatgagcttctttcagaattgcatcttttaaatctttgttgtcggggacc

SEQ ID NO: 87843 - DNA, 619 bp, Oryza sativa
tggccgtcccgcactacacttacatgatgctgaagatgcctggtccccgaggagtcctatccctacggagcgacatcaagcccgccggggcatgcgacaaggagagctgggacttggcccaaacccgcgagatgacttttggccgagaggaaattctactggctgtaaccacagccagcgaacgtgaagtgcccactaccaaaacttcaaaaagtggataaagcgatgccttgacttataaaatttccctagagacttgtgatcctactaaaactgctgtgatttgcgccctgttatactgtctataagaaagcgcgctcatcacctttattcccaacaataaagatatatttgcgtggaaaccatctgatatgcccggtattactagagaggtgattgagcacttcttacatgtcaaagaagacgccatgtctatcaaacagctgactacggcgattcgcacaccacaggaaggacgccatcaaagaggaattaaccaagctggtagcagcaagcgtcatcaaaaaaatacttcatgccgactggatagcagacccgggtctacatctgaagaaaacagggcactggcgcatgtgtgatgattatactgaccttaaca

SEQ ID NO: 87844 - DNA, 668 bp, Oryza sativa
gcaaattacaagtacaaggaaaattactttttctcatctggagttgacaaaaatttaaataaatgtaattcagtgctggagaaaaaaaaaatcatatgatcatctaaacagatgcagaaaaagcatttgacacaagtcaacattcttataaaaactttcaacaaattaggtatagcaggaatacttctcaatataataaaggttatatatgacaagaccacagcttacatcatacccaatgatgaaaagctgaaggctctttcctctaagaccagaaacaagacagggatgctcactctcaccactgctattcatcttagtgctggaggtcccagccggagcaattagacaagaaaaagaaaatgcattcaaattggaaaggaagttatgaaactgtctctgttttcacatgacatatatcttatatacagaaaattctaaagactctaaaaagactgttaaaactaacaaatgaattccgtaaagttgcaggatacaaaatcaacatgcaaaaatcagttgtttttctacacactaacaaggaactatccaaaaaagaaatttagaaaaccatactatttacaatagcatcaaaaataataaaatacttcggaatagatttaacaaaagaagtgaaacatttgtacactgaaaactgtgttagtcat

SEQ ID NO: 87845 - DNA, 697 bp, Oryza sativa
gtgttggtagaagttatgctatgattgccccatatgacgtagatggtaaccgtattacgtacccttctcttgggggacgaaactacaactctactacccctgttaaatttacaaaactagcaaaaccacttaaagtcggggatacagaggtttttgtagaagatgttagtctatggaacggacaggcaccgcaagactaccaacgtagtattatcatgtggggttataaaaactcgttcggctatacttatcccgatggaacgtatagtcagctaatgcagatgaggacatatgatattggtgcagttgacaccacagctaacaagattacgttaaacaagccatgggcagttgcaaacccaaatagttcagatgggattttcccagtagggcatacacttagcccaacttctgacggctccacatatttgtatttgaatggtcacgtaaatatacaagtacctactacgtacaccaagtacagccatttgattagtggctcttctgagtttgctaatacaacgattatcccagtagaaacaggttttattcaacttggattcttgttgaaccgtgatacaacaggtgaaaaatcttggctaaatggtttacgtctacgtgactatacagatacgtataaactaaacgatgacgttagagaaacacaagaaaacgtagacaaagctcaacaagatgc

SEQ ID NO: 87846 - DNA, 659 bp, Oryza sativa
tgttatatatataattgcttagcaatgcttagaaacattagctcactaatgggatgaatcatatatactacattattatttatggttatatttaatggtagctcacgatggttaatcgtgttatgataattaattggtaattaaaatatgattaatggtgggttgtgagcacatggttttgaaggtcgtgctcatgacaattaaggaccggttcgcgagctactgttgtgaaacatttatcgtgctaaccacaagccagcgtgggcaacggctttatcttttgtgtagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctggccagagtaaaactattcgaatagctgtgcccgcggttatgggcgggttgagcactgttcttcgtgattagtctcacacctctcacaataattatggatgttatacctggtaataatttgcttagcgggctgcagga

SEQ ID NO: 87847 - DNA, 1496 bp, Oryza sativa
gcttgtgctaaagctttgaatgatcacttcaatattaatttgacttcagatcagattaataatcacattaggacttggaaaagaaaatattctaagatagctgatctaaggaagttgagtgctgctctttgggatgatgagaattttatcatattacttgatcataaacattacgcagaccacatcaaggtatgccacaaccacacttacaccattttattgttacctatagtggttgctgaaatttgtagtggttgctgaaccttatagtggttgctgaaatttataatggttgctgaaacttgtattggttgctgaaatttgtattagttgctgaaactaattttattattaaaccatgttgtaggatcacaaggctgatgctgaatatctgaacaaatctattcacaattatggcaagatgcttgtgatatttggcaatagtttggctacagggaaatatgcaaaagggtcaggtgatcctctagccaatgaatctattgccattgatgatgatgaagaagaagaaattggtattggaagtgctgcagcaactggatcagctagtagagttcatgcccttaatgaggagaatggtgcatcatcttcagcacccaaacccaagaaaacaaagactgctgctgcaattgaagaggaagggctgataggtgcatttaaatctgttggtgacaagcttgctggagcaatagttgaagctggaaaagaggctgcaaaatctaacaaagagctgcccgataacctgtatgagagtgtgcatagcattccagggtttgaagatacatatcttgctcattatcatgcacatctagttgacaatcctccaactgcaagggtgtttgttacccttgaatttgctcacaaggtcacttgggttgcaagatatattgccaccacttttaatgggtgaactgtgctgtgatggttgtgtgatgctgttggtagttgccctgtgttcaaccttcttttgcatactcagacaatgaactatgagtattgagtgtgatggtagctgttagatggtagtaggcatgcattcaaccttcttttgcatactcagacattaaactatgagtattaagtgtgatggtatttggtagatggtaataggcttgtgttagcctacttttgtccctaaaccagtcacttttatggctgtatggttgatggtaaaattcagatgtggtggttccattggatgatggttaattgatatattttttcatatttcatttctgggagcatatggcgtgttgtatgtgtgtgctcctctcctggtatgtgtggtaactggtaacacagatgcatgttaaaaatttctgaaaaaaattgtcttgggctcatgatccatgtacaaatatgtagacaagtaacatgaatgctcatgagcatcttgtttaattttaattttctgttctcaaggtagacaacaaatacgttatgcatttgattatttgtacatgcaactatccaatttt

SEQ ID NO: 87848 - DNA, 674 bp, Oryza sativa
gtatcttggagtttgttagagataatagtcgtgtccgacaaggacgtattttgtatctcgggtataaatatgacccgaacccatgtaatcaaacaacacacgttcaataacaatcttggcgcatcgccacccttttactttcgtttacttttgacgagttcttgctttcgggttgagctgcatcggtttcgatcttcaactagaggtaaaacttgttatggcggcatgcgttctcgggattactgtttccatctttatgatactctaatcttgtttatgtaattcgtcgagttatcatatatcctatctaatatctgacaatatcgttatttaaccttcaatcggctaacatctatcattgaaaggcagccgattaggttaaataccgatgttgatttagattatatatgatatccaccatcctatgaaacatccaatggcttgattgtctagatattgtccttcttttcatacttatagctacatcagttgagtttgatcttatgagtcgtgattagaatctcaatctctagcctgcttttggttgccgaataaggtttcatcggggtttcagccgatttaactactctatatcttatatgcttcattgacacgttaaatccgcccttatgttaagatcatgtcgcatttagatatatcaatatggagtagta

SEQ ID NO: 87849 - DNA, 740 bp, Oryza sativa
gcggacctcagtctgccctacaacgcggtcctagggaggcccgcgttggtgaagttcatggcggcggtccactacgcctaccttcagatgaagatgccgggccccggtggccccatctctgtccatggcgacctcaaagtcacgctcgcttgtatggagcagcgcgcggaccacctcgccgacgcgtccaagcccgaaggtggcgacaagaggcttggcaccttccgtccccgccgccccgaggcagcggatgatcacatgcgacgaggtcccggtcaaggaggttgccctggggcgacggcccgtccaagaccacacgaatcggtggtcttctggacggcaaataggaagacgcgctcgtttccttcctgcgggcaaacgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccaccgcggggtgcgaccttttgtgtttt

SEQ ID NO: 87850 - DNA, 694 bp, Oryza sativa
  unsure (1)..(694): unsure at all n locations
tatgcagnagttcatacgcctcctccgcgcgttccgggcgctggagcggatcgacctctccgcctgcgcctacctcgacgacgccttcctcgccgtcgcgctctgcggcgcggatctcgacggggtgcgccgggtctggctcgcccgcgccagcggcgtcgggtggcgcggcctcaacgcgctcgtgggggggtgcccaaggctggaggccgactacctgtcgcactgcgtcggtgccggcgaccgcgaggccgccgcgctggccgcggtgacggggctgagggaattgagcctagagaagtgcctcggcgtgacggacatggggctcgccaaggtggtggtcgggtgcccgaggctggagaagctgagcctcacgtggtgccgcgagatctccgacatcgggattgatttgctctacaagaagtgacacgagctccggagcctcgacatctcctaccttaaggtatactatactcttaccatatgagctaatgaaaagtggtctttgctttatatgctggtaaggcctcttcttgttgataggctgattttagttagcactaggaatgatatgcgacagcacggagacaaataatgccgtgaagtgtgacttggatagttcgttgcgggctgattctgacatgagaaaatgacagtcatcggagcttgggcgtactgatagataactcctgtt

SEQ ID NO: 87851 - DNA, 635 bp, Oryza sativa
aataaataatggtgcctgactgacatcatgggtgtgaaacttgcaggagatgatacagtcgtttctgtcaaacttggcaaatatgaagtataccttgaaagtgcttagactagatggtcttgaagtctcatcatatgttcttccggccattggtggttgtaatagcttggtcgagattggccttagcaaatgcaatggcgtgacacatgaagcaatctcttctcttgtaactcaatgcagccacttaagggttattcttctcacatcctgtaacctccataccaacaatgcccttgattcaatacctcacatctgtaagatggttgaccatctccgttaggaatcttgttcttccataatccaaaagggcctgcaccagattgaaccctccggccccaatctaaaggagatagacctcactgactgtggagtgaatcatgcaggtttgtgtcacctcttgttgcttcatttgcacattttcattacaagccttctttttatttgagcaatatcatgtacaaccaatcacttgttttgcagcattgcagcacttggacaagtgctttgtacagcttgtactaaaattaggcctgtgctcaagtatttctcacaaaggtcttgctttaatcatgatg

SEQ ID NO: 87852 - DNA, 726 bp, Oryza sativa
atgctggcttgtgggctcttgcccgatatgcactaaaccttaaacaggtaatttttctccagagttttagattattcccttgaaagttctaaagaaacaacaataatcttataaggttgttcttctgcagcttactatatcatactgccaagtcactggccctgggcctgtgtcacctgttaagctccctgaggtgcctccaggatgttaagatggtacacctctcatgggtctctatagaagggttcgagatggcactgagagcggcttgcgggaggctgaagaaactgaagatgctgagtgggctgaagtctgtgctgtctcctgagctgctccagatgctgcaggcctgcggctgccgcatccgttgggtcaacaagcctcttgtctacaaggactaaacctgctctcatatcatcatctgtgcagtgttaatatcctcggatcatacaccatggagcccttaccaagtctagcatgcttacaagccatgttagatacccgcaataatcgtcaattttcatacccaagatgtactgacgatggtgtctctgcattgctgcagtgccatccttatgtttggcaactcctagaccaatgttgtcatcttcagattaaaatccaacatttgcaaacatgaggcatcgaaacagttatgttctgagcaagtgatccttgtaccagactgcaatgaaatgctctacactttcaattggtatatgcaaa

SEQ ID NO: 87853 - DNA, 2569 bp, Oryza sativa
cggtgctaacaatttcttgtctgtttctggtaaataataaatatatttgtttgcactgaacaacacaggtgatgaacaattttagcaaagaattattttacatgctttgccactcttgtccagacttgtaggcaatagcctataagtactacctttgttaaaaaatataagagattttgaccatataattatgtgggtactacatagtttagctacatctagcatttgttagagtacatgatgaacaaactggccgtgattttcttttattttctttaaattctgtagccagaaaccatgtaataaatctccctgaaaaaagagatatcatcataatttagaaaaagaatatagtcacgggaaacgggatagtgtacaaactcatgtctgaatctacacaagaatttcattttcagtgctgaagaatgatggggtgcgtgtatgcgtgtggctaatcccagaaaagtacagaaacttattgtagggttattacagatttacatgaaaaatagctgcttttatcagatgatgataacatcagataaaatgggtagagcttatcaaaagaaaaatgtgttgactatggcagcaggcagctacaattgagcagccaggatctcattccatgtgtctggaacaccaggaaggcaccagtgcaagcaatcctggacccctactctacctctgatgctgtacctggatatatgcccttcatccctcagccgcgaaatcgcggtgatatgcaagagcttgattgcggtgcctctcaccgcttcctcggcttcggcatcgtcagaacgattccgaaacaccgaattccccttggataaagggtttttgttgtcacatgttcctccagtgttccactcaccattgaagaaatgcctgggtgacaatgacctgtagaagaccttagatgggggtaccttggaagctcatcatccagccacctgacaacattgtggatggtgaagttcttcgccttccagatgacggcgatatcccggtcatggctcggtgccccggagacgtacatttgccaccggttcgccttcatcttcccccggttccagtggtgcccggtgttcagaattatcacatgaaacctgtggaggttcttctgaagaaatgcaggagggcggtctaggtgcattgcatagccggttgcctgatcagacctcctgagaggctccagatcacagagcgttgctgaccagtagtagaggatggtggtgttggttcttcggaaccggtatgcccaacctttcggtctcttagcgtggcgcgcaacgacaaggctgtagcgtttaccgacatcttcgacatgcgagtgatcatccccacctgtgagcatgcacatcatggactggaacatctgcctccccaaggagtcacctacaaaagcaatggttttgtcctgcatcctgaggcatgttaggattagcatgacctgaaagacagagaaaaggatgcagaagaagaagaatgtgttgattaactgtttcttgcagaatgtagacttaccttttcaagaactgggaggcttggaattctggcatgtcacagccttcaggctgccatctgaatttctcataagcgaaatcctttcgttgtgtcaatctgcaagcccagctatcagagagccattttttgcagctgagaccagaatataatggtctgctgtcatcaggaacccatcttccattcctgtagtcacattctgctagacagatgaagaaagcatcagaagaaacagcattgcattagagctgcagaaacttctgactagtaaccggttttgctaggcaaatctgtgagttgagtaggatttaaaggaacattgtcctctttgagcaagtttataccaatttagtaaaaaaaattatcttatttacatttttaaggggatatttctataacagacattatattggatcataatcagagagatgttggccatgacctttcttctcaggaggtgatgcttcccttttaccagtgacgttttctgcttcatgaactacagactgaggtggagatgcagcagtagcttcccttcctacttcatctactaactgcactaatggatccaagctagaaaaaatttcttccttggagatatcatgatctatatacttggattgaactgaagaaatttacagaaaaatgtcagtgcaaagaacaacacatagaaaaaaactcaattagagaatggatatcagctgttgagcttgcaaaatgagaggacctggatggctcaaagccaatggctctgatcggaggagctcgccgcgatttcgcagcgatcccttctcccatttccatgtcaggagcaccacaaggagggcaagacagacaagcttgagctgcttgaacctcagaccattcagattcaccaatctcatccctttactgtgctctgaagcaaacccctgttctttttcaggactgaattgtgctcacaagacatcaactgcagataaaatagaggttctctgaattctgttggtcagccaatcaggcagctgcatcatacaagaagaatgtagacaataagtaaaaaaaggtg

SEQ ID NO: 87854 - DNA, 1757 bp, Oryza sativa
agtaatggcatgcgtagaaggtaggaggcggtggtggcggcggcggcggcaaggtcgccggacgccggcggaggcaaggtcgcctgcttgcgccgccgcggcggaggttgtgggagtgggagggccgagggaggtgttagaaactccgaactgagagtgatgaagatccaatggttgagattcggagatgcctctttagcccaccgacggctgagatcatactaactttgtttttcttttttccttttctaggtgacattcttcgggtgtgtttaagaggagcaaaaagaaaaaaaaagattaagaagaaacaagataaactattgatgcatgattatttgagtattaattattttaaatttaaaaaattaattaatataatttttaaaaacaacttttttataaaaaaaaatatagaaaaaataccatttaatactttgaaaagcatgggtatagaaaaccagctacttttctcccgactgcgcttgtctcaaagacaacctcgagttgtctgagcatctgattgattgcttcctgactctgaaatacactactccctccgtgctaaaaatagtcaacttaggagaggaagtgaccactcttattcgttgtataaggaggagtcacatcttcacctaggatttttttttttaacagagggagtaattcagacatcttgcacatcgtctgagaaaatccaagtactaaaatggctaactcatcaggcatttctaaattaattattctattgcaatatgcagattgcagaataaggtggtcgctctatgtcacgatttattcacacacacacacgaactaatacgcaatttagaaataaaattagaactcgaaaacatgtagaaatggcactagatcttcttgatgacgagtgtgattccgtttttcagctatgcgtgttatgcttgggcctcttcacgatcatcacggtcaagtgcgcgtgatggctgcagtagtcgctcacgctcccaagaacagccctgcaaatcaaaccgatttgatcaaatttcaggcaaattcaaaatccagaagagaataaatcgagtgacggatgaacgtaacagctgatcctacaaaatttctgcagattcttacaacaaattccatttcaatgatcacactaattatcaactttggtttttcccgtaactgcttattgcaaattaatatttttaggtaataaaaatagtaacttctaattgattaatttaccttttccatgccccatagccatggctgcccacaaccagcatatctgcatgatgcctttcaactgcctcacagaggatgttcctcgcgtctccctctaacacctcatagctcgcatcgatcacctaatcgatgaaaattggagattcttcgagggttgatcaatgcttgattataggagatatttttttctgctgagtttggattcaacaagcgaaggattattatatcacctgggagcacatctcctttgccttctcaattactctggcggcaccgcgcttcagatccaattctaaagtcggcaacagctccgtcgtacctatatttattacaagtcctcacgtgagtacgatccccgattctataatcaatacattcataatgtctaagagcgtgcatccaaggttacctagaccggcaatgccgatgacggccgatgcggggggcttagaggtgagcaagacgaggtggtactgttgcggctggcccagggcgaaaaaaagtttgagcgtgcactcccgcgcgta

SEQ ID NO: 87855 - DNA, 2747 bp, Oryza sativa
agttggcattcaatgaagtatatttctccacctgaaacaagcgagatggttgtcagaaaagagaatgtaatacatatacattcagataattgtcagaagagagaatgtaatacatacacattcagatattaatacttaagatgtcaataccaacatgataaaagaaaaatagcagagcagtaattcttaatccaaagatcgtttctcaggggagaataactgtacattatattgcctgtctgtctgatcatgctgaattccagttttagatgtgtgcatgtagcactagaaagaaagaggtgtatgtcccacataaactgcttgaagtggcaccgtaatgagtataaatgggttacttggggctggtaattgtaggttttcacttcaaagcacttcaccagaagtctccgcatgaacagcttccattgttaaaatggtgaaatctgtagacatctcgtaatacaatttgtcttcccatgacgtcggaagtaaatttcatccaagtgtggcaatcgctacatacacgaagatttttaatgacttgaaggggcatacagggaggcaaactcatcaacccaaaagtcacagctaacttctcgctgtgcacaagatcagtaggatctctcccttcttgctctttatcatggaagagatgatatttctcttgcttgtatcctactttggctaccctatcatttataacagccaaaaaattgtatatctgctcagccaaggcgtgtaatctgtcaccaacaaagaatgcatgaaccacattctttacttcaatccaactccgggcatggtcctttctgactcctctgtctctcatcatctttctgacctgatccatatttgaccacttctcggtaacagcatatgcatttgagagaagaacatatgatgcagaatcatgaggctccaattccaatagatgtttggctgcaaactctcaaacttctatgttcttgtgtactaaacaggcgctgagaagggttctccaaaccatagcatcagcagcaattggcatttcctcaataaatttctttgcacggtcaagttgcccagctcgtccaaagatatcgataacacaagcataatgatcaggccttggacgaatttcatactcatcagacattgatttgaagtaactaaggacttccttcaccaatcccacatgactgctagcagctaaaacacctatgaatgtaacatcatttggtttaataccttctttcttcatttgatcaaataaatccaaagcctccaagccacgtccatgctgtgaacagcttgtgataatagtattccatgacacctcatttctctcagacatttcagaaaattccatcttggcatcctcaaagctaccacacttcccgtacaaggaaatcagagcatttccaacttcagttttgaaggaatgacctgttttaataactctggcatgtatttgttttccttgttttatttctgcaaggttagctgaagcactaagagctgatacaaatgtgaacacattatgcttgacacctgattgatccatacgcataaataccttgagagcttcttcatgtaggccactttgtgcaaaaccagataccaggccgttccatgttatctcatctttatgttcaatttcctcgaatgaagagaaagcttctctgattcttccgcatcgtgcataaaggtttaccaatgcattccaaattgaaacatctcctgaataaccagacacataaatccgagcatgaatctgcaagccttgcctcattgcattgattccagcgcagccacttatagcacttgctagtcctatgttatctggccaaattccacatttctgcatctctttaaaagctgcaagagcgtccttacaacactcatgttgcacatatccagcaatcatggaagtccaggaaaccacgtctttctctttaagcatttcaagaacacgtcttgccttttcaagccacccatatttggaatacatatctatcaatacaccactaacatacatatcagactcgaagccagtttttacacttaatgaatggatctgctctccaaggtcaatttctctagtgcaagtgcaagtccttaaaatgcatgggtacgtgaattggttagggcgtatacctgcagcctgcatttgacagaatagctcaaaagactttgctagatcattgatctgcccaaatgccacaagcatcaggttccagagtactacgttagtcctatcactcgaattgaagatcacaagggcagtttcaacatcaccacatttcacatagaggtcaaggagtgaaccttccattatgtaatccgaagagatgcctgctttaaacagataggaatggagttgcgtccccttttgaagatcaccaagcgacgcacaagctgcaagcagactagaaatggtcacacaatcagggcttaaccctgagaactgcatctcctcaaatatctctaaagcatgctccccatgtccacactgagcatgtcctgagatcaacgtattgaatgttactgtgtcacggtgtggcatgtcgcaaaatactctctctgccaatctgaatgatccgcaccgcaagtacagcgtgataacagcattccccacaaagatttcagagcagaatccgtgcttgtaaccttgggcatgaatcaaccgtccttgcgcaaagagctccgctttagtgcacgaactcaggacgctagacagaacataaggtgtaggaacaaccccagct

SEQ ID NO: 87856 - DNA, 1438 bp, Oryza sativa
tcatgctgaagctgactagaagtgtcaatacaatgtcaatttattcacacagatacgtgcacaatttggtggtagatatatacatgaatgatactgttcagtccaggctgggccctccgctcatggactcagtgattgagcttcggcttttttactatcatcgcggtgcagtgcgcatgatgagaacagtagtcactcacgcttccaagaacagctctgcagggaagttcaggcatgccagtaagaccaatgtaggtgaataacatgaagtagggaacggaaaaagatgattgggagtaaagttgatgcatcagccagtaatgttgcatgagttcataagattagctttggttactgtcttccatgaaagaccaaacaaaattaagttgcaggcagcacgattggtcatttgtaggtcgatacaatgaaacaacaatgcattgtaatctgcctgttctaaaaaaaatctagtctagtccaggtcataataaatcgtgttaatccacttttgaagttatttctttccggtaagaccaatatcagttttctggttctatttttgacaagtgtaataaatcatgaaaagcaggaggattcacagctacggggccaagccgccaagtgaacttcatgacgaatgatggccataaaacatgtatagcgagagaaaaatgatgtactctattcgaatatacaaagaggctacaccaaagtatcagaagagcattatgttgtttatggaaattcatcaactcataatctggtacagcttctactatagcaacagataagcttttaatttaaatcaatgtccactgcttgcgcacgtgttactctatcaaatgcctagtcagacaccattttatagattctcctctttttttttcacagttctttttttcgaaacattttttttttcagagatgaagaagaggcagcagttttcaacaaattgaagaaattctttgtgggaaacaggggtcagaagaacaaaagtaggaaatggcaataccgtttaattgctccatagccatggcttccgacaaccaacatctccgcctgatgcctctcaacagactcacaaagaacattcctggcatccccttccagcacttcaaacagagcatcactcacctgcagcaaactctcatttgtatcatgatctaaatcatcaaaaatgtatactcataactatgataatacacactaataaaataaacaaaagacatagacaaatgaatgagttaagtcatggtttgattccaacagctggcaatctccctgttcttcagccaagcccagctgagctgatctcaattagctagctttttttagggcttccttaatttagagcaagtgtgacgtcttgtatatagtaagctaggttgccagcttaacttgctagtaactactactcccccatttcatattataagtc

SEQ ID NO: 87857 - DNA, 2423 bp, Oryza sativa
ttgtaagtctttgatgttttcttgcatttacttgggagtgttatgattagttaggacttagcgttcgcgaaaaaaaaagttaggacttaggacgatattaaaaaccggtggacataagacgagagccacatcagaatttattaagaggagcatggcttgaaccccgggacggctagccgacaccttatggggctagtaggaaggccctgggcctttctcttaagacaatatttggctatcaagaattgacatccagtaacaacacctcaccgaactaccgaagtctagcacgatggaagaaaaataggtaggaataaagattcgacaacattgacgtccaagtaaaatttgacaaccagtagcattttctacagtattaaatataggtaggaaaatacattccacaacattgtcgtccatacatcacaagtactattgattactgtacctacattcttaatgtatgactctactacctacacccttaatgtatgatgctggttagttcaacatacaaaataattcggaaggagtaccataataaacttttcttgttcatagttggcagttgttttggcagcaaacacaaagaaactgtaaaataatcggctaatcttagattattgattcatttccagaatagaggataaactacagactactaacaagggtgatatataatgataagagagaagaataattcgtataaactgcatgttgttcatcacaatttcaacatagttttgttgctggttgccctgtcgcaaccttttttgatacttcagcactgaagcagtgacataccctacagaaaagaaagactagcagtctacctcttaggagaaactctatgatctgaacatactatcttctttttgcctcttgatactaagccttgctactacaggttacacctggcatttaggctatccaatgagttataattaactcatactagtagaggcttttttcccccttgtacaattcgactccgttattttttgccatacatacagttcagaatttgaagtgatcagagaagaactccgttgcattttgcgaacttaccgtgggttcatctaaagatcatgttgcttgcagaggaacatataggcgcacgacgatagttatcgcgatggtaactgcaactataagagcaagaatggccatagaatcaggcctacgagccatggtcaaaacagctcctcccattgcggtagctcctgctttggtcaggtcatgctcattcagctcaccgttggtgcaatcttgctctagcttcatccctgtctcattccatctaggattcacctgccctttcttcaccgttcgcttaagcagagatggcactgaggaatatgccagtgaattgaccggtttaacatattcttccttagaattctcttcctcatgttcaaactcatttttcttcatgactttttcttctgctagtttcacttctgctgtttctgccattggtatggtctctgtttcttctgcgagtttcacttctgctgtttcagccattgatgcagtctctgtttcttctgccagcttcagttctgctgtttcagccatggatgtggtatccgtttcttcggctggtttcacctgtaaagtttcagccactgttgaggtctctgtttcttctgccggcttcacttctgttgtttcagcaactggtgtggtctccgtttcctcttccagtttcacttctgtttgaaccattggtgtggtttctgtttcttctgccggtttcacttctgctgtttctgccatcttcacctgctctgagacttgttcttgatgcatcaccttctctgtagttggtgttgtctctgttgatgcagtatcttgatcaacacagttgttgttgtcatgttcctcaagggtgatgtcagggctgctgaagctaaaagtgttttccgcagaattttcttcaccttcattttcctagcaatcataattcagaagaaccagatagaataaataaggcccctataaacaaatagcacatggatgatcacaggaagcagatttccacaaatgttaaagagttgtagtaggaagacagtacatttacaattatctcattctcggcatcatttttgcctgaattatcatcatcctctgtcacattttctgtgtcctgaagcgaaaacaaaaatgaagttacagaacaagaagtgcaatagggctcctagaaaatggcatgctttctatagcaaaatgttttacatggttgcaacaacactcaccataacatgtgcagtgatctcagcgcagtccctctctgaattgtgattatatgtctcaacagcttcattaaccttagacccaaaattggcataaggaatatgaatttacagagcaaaagtgcaaaaggtccctagaaaatcaaacatgctgctcaaagctaaatg

SEQ ID NO: 87858 - DNA, 2911 bp, Oryza sativa
acgtgggccccggcccagaacgagccaaatgagcctgccgatttggaggagtgggccggagtggggcaatgggctgaatgggccgacctgctccggttgtcacttccgagctgcttgagcgtgtgcttggagtggtggtggtatgagctcatgacgatcgccgccggctatctccgggacccgcacaccgcattggcgacggcggccatcgtcatccagaccacgtcgttgttatacacaattccggtcaccctaagttcagccgtttcaacccgagtcgcgaatgagctaggggcgggccgaccgagatcggcccaagtctcattcgtagtagcaatgggaattgcgatgatgggctcgtgcgtagggctgacatggactacatttgggcgaggactatgggtccaagtgttcaccactgaccccacaatacagtcactcacaacaagcgtgctaccggttatcggattatgtgagcttgccaattgtccgcagacaaccggttgtggagtgctacgcggcagtgcgaggccggctgtcggggcggccatcaacctatactccttttacctcgtcggagcacctgtagccctagtgcttgcttttgggcttgatatgggctttctgggcctttgtcttgggcttctctcggcccaggtagtttgccttatatctgtgggctttgctacatttcaaaccgattgggaggcagaggctttggaggcctttcatttggttggtggtggagatgagaaatgtggtgatgacctgccatgtttggcccataaggtaaatgtatagattgtaaaaagttgcatggtttgtgtaatttgattttaaatcttttgcggtgttgcaggtaaaaattgtaaatttatgatcccagaaagatgactacgagaagtacgtttggatacacaaattatgtctaaaaatgtagtaaagcataatttatatattgactctccatatcctaaaatatagcaacttagtgtgagttcttatattttgggatgaagagagttataacctcagaaaataatttaatgcataaaaattagcaacattaatatcctaattttgtttattgaattattaaagaattataattgctagggaacatacaaaaattaaaaaaacccggtgcagcttctttaaattccttttcgccgggcaaacatggccggcgcaagcaccggccggtttcttgctgctcacaacctcgttcttcatcgccggcgatatgtctccggccggccatcgccggagcttgataggttcgccggccgtgcttgatgtcgatctgaaatgctagctagctagcatcctgatccgcgaacggggtattcatagtatgtacggcgacgcagcttgcatgattattgcatcgccgccaattcttgggccctatctctgttattcaatattgatcgatgctggggttcaatccaacgtgagcttgacgatgatgttttcggagaaggtatatgcggtcttggtttttactcacctaacagtcatttgtttgactgaccagtagcaaaagtttgtttttggataagttcaagtttggtttcccaccatgcaattttttactgtttttcatggtagttaattaagcgttgtgcattctctgaatcttactggccataatttgtacccaagttcttttacctgacggttgatcgaccatcaagaaaaatctacaccctgacaatggctactccgtccgtttcatattatctaagtcaaaactcttcaagttatagtatgaaaatacatctataacactaattattttcattataaattcaccactaaatatatttttatagtatattttttttgtatggaaaatgttgctctgtgtaacttaatcaaacttaaagaaatttgacttaagctgaattctaaacagcaattcgaaacgtctatttcctcattatccgtggacacgcttcctaaactcctatataaatgatgtatcataccagagttttctacatttaagttttttttaaattcaaataaattggtttttcgagtttgtaatatttaattcttgattaatagttataattgtgtcgttttatgtgtccccacaaattttgcccaaacaaccattgcgaacttagctttagctctagcccaaaatgtttataacatgaaccggagggtccggttcagtacgagtcagtcattcatgagattgattgtgtttggcatcagtctttactttgttcgtgttacaagtagaattggattgtattagtagcattttttgcctgtcttaagtaactgctacacccgctcgagatagaagacagggagaggatcaccacaacgttgtctgtaatagtctcagtcacaatctcctgctactgcgggacgatgttgatttgtatattgaatttaaacgtaacctatgtctagattcatcgttgtgaattataaattttatatgagggagtatgtctcatataataatactaattaattctatactagttcaatacattgcatttaataacttaagaaaataactcaagtcatacaaaaattagcacagtaaaattgtaaaaacccgctgagcaaacttggcctgcaccggcttcttgtctgtttgattaaggactaatattgccacacatttttaactaaggtagctaagtttagtcttgccacacttttgtggtaaataaaatgacaaactaagcttaggtaatgtttggcaaaaaaatagagtgtatgacatgtgggccaggtgtccaggtggttaagagttagacaaaaaaaaaagacctgtggtaagaaccaaacgctatctattaaaactgtggcttgccttagggtagatatggtaaatttagggcaggtttggtttgaggcctaaattaggcttaccaatatt

SEQ ID NO: 87859 - DNA, 1772 bp, Oryza sativa
  unsure (1)..(1772): unsure at all n locations
tgaaatatgcctttttggatgatgaattatattatcaaacaattgatgaggtgttacttaaatgtttcagtgccaatcaagctaaggttgtgttgggagaggtgcatgaaggtatatgtggtactcatcaatcggctcataaaatgaagtggttgcttctgcgtgttggatatttttggccgacgatgttagaaggttgtttccgatactataagggttggcaagattgccagaaattagaagtaattcagagagcaccagcatcggctatgaatcctataattaagccatggtcattcagaggttggggaattgatatgatcggtcagatcaatacaccttcaagcaatggacataagtttatattggtcgcaacagattattttacanaatgggtggagggcagttcctttgaagaaggttgattctggagatgcgattcaacttgttaaagaatatattgtttaccgattcggtgttcctcaatatatcacaacagatcaggtatcaatctttctgtccgatgaagttgtccattttgtagacatcatgggcattaaattgttaaattcttcaccatactaagcgcaagctaatggacaggctgaagcatctaataagagtttgattaaattgatcaagaggaagatttctgatttccctcggcaatggcatacaaaattagctgaagcgttatcatcctatcggatggcatgtcatggatcgattcaagttccttctttacaaacttgtttatgggcaagaagcagttttaccatgggaaagtgtcaccggctcgaggattatagatttacaagattaattgacagccgatgattattacatcttatggtagatgaacggaagatctggtccattctagattacgtgctttggaaaaagtaacgagggataaggaacgagttgctctccattacaataagaaagttgtgcctaagtcattttcagaaggtgagctggtttggaaattgattctgctgataggaactcgtgacaacaaattcggcaagtggtctccgaattgggaaggaccgattcgagtatacaaggttgtgttgaagggagctgatatgttgcaagggcttgatggagaagtttttggacgagctctcaatgggaaatacttgaagaaatattatccaagtgtttggattaatgcgtgaccggctgagttttgtcgatacatgttagccgatgtgttaacatcgcctttagatggccgatataagttatatcacccttagcattgtttttatcatagttggttgtgttttaccaatgtatgatggccgatataagttatatcggtggtgtcgtgccgatatgtgatagccgatatttgtcatatcgcccttagcacaattataattttatcaatgtgtcctcagcatggcaaaattaagggggcatacatatatgtaaaatgacggatttcaaaagcaaaatatcaatgatgggtttctaaagcaaaatatcagaacaaactatgtttttgtctgcattacaagtattgcacagttggtttctaacttgatacaagcttgttaatagccgatatggcccattgcctaatttgttctatatcgttatggcttgggcatcggtagcatcggttccagggatcacttttaaggatttgctcagatctgacagatgcttgatggaattccttaactttgatctcggcttctttcctagctcagctaagagttctgctctacgagacttcagccgatcaatgtagatttgta

SEQ ID NO: 87860 - DNA, 739 bp, Oryza sativa
gtgcttatatttttcttgtacaaggttaaggcattatctattgtccaatgaatgcactgtcatatgcaaagccgatgtcgtcaagtgcatgttatcggctccaattttgaaaggaagggttggaaagtggatattttccttaacggtgatcgatcttcggatgagtcaccgaaggcggtcaaagggaaagctatagccgattttattgttgaacatcatgatgattcaatcggctcggttgaagttgtgccatggatttagttttttgatggatcagtatgcactcatggttgtggcatcggcttgattataatttcccctcggggggcaagttttgagtttgcttacactattaaaccttatgcaactaataatcaggctgagtatgaagcagttctcaaagggttgcagttactcaaggatgttgaagccgatgctattgagataatgggggattcttggctagtgatcagtcaattggcaggagaatatgagtgcaagaatgatacattaatggtttataatgagaaatgtcgagagctaatgaaggaatttcagctggttactttgaagcatgtatcgcgatagcagaatattgaagctaatgatttggcccaaggggcgtcgggatataagccgatgatcaaagatatcaaggttaaggttgctgcattaatagccgatgattggagatatgatgtatatcaatatttacagaatcaatctcaatcggcttctc

SEQ ID NO: 87861 - DNA, 654 bp, Oryza sativa
taatttgcgttttgtaacagttgaagatgtgagtgacttgtggctcaatgtgaaagaaagtttcgagcaacgcttaccagtgaagaaggcctgcctcaataacaaggcgaggaatcctgtttttgtggaaaacctaccagctgagtttatacagaccactgattcgaggctacgtagtcgatttccacaagatcaatacttggtttggttccgggaaccatatgcaactgttgttcttgtcagttgcgaggtactttcgtgtcctcatgcatgctgctctttctaattcttctcaagtaataatatcacttctcaaacggaccatgtggatgactttttgcattcatttctctctattgaaatctccaggatcttgatgagttcaagaccattcttaagcctcgcctcaaattgattgtgcaaaatgatgagagggaatggttcattgtatttgtgtctaaggcccatcctagcaatgaccaagcatctaagatggcaaagagagtatatgctatgcttgagagcgatttcaacactaaaaaaagagaaaggtatttgtttgccaattctgcataacagtattggtaatattcatatctttgactttgaaaaatgtaaatgttttggttgattcagttcaacatgctatttgcg

SEQ ID NO: 87862 - DNA, 645 bp, Oryza sativa
  unsure (1)..(645): unsure at all n locations
gtacagttcatcaccaccttgaaaggctttatcttcgtatttggaccagcctaaggaggggtggcttaaatgatttaggtttggagaatctccactcccttcggcatgcaaccatttattcaagcagcaaggctgttgttagagaggcacttaaggactatcctaatcaagcagcgctcgaaatacgatggtgatgaactaactcaggtacttagctgatttcttcccctaatcaacaaccttttttttcatgtactagccattatataatgctaggtccaccaagcctcccactcaacgtttaatatgatgtatctttatgaacgttatttttttctatctttgcttggcgtacagtaatgcatgatagcctatgtacgtctttgatgcagctgccgcgttattcattatcttaaaaaaaacccaaaaaactctttatgaactttagcatatcagcatgcaatcaacttcttactcctagttatacattctttttttcccctccccctatatcgntacgtaagagaattgttatattgagatgatttcttttatgccattgcagtcaagtgtcaactatgttacgtaatttgacatctcattggaaataatgcttatattaataaaaacaagatttggagggag

SEQ ID NO: 87863 - DNA, 1297 bp, Oryza sativa
atcacctggacactatggaatggtttgatattgtggaattggattcacaccttcccctctattcaaaacccccaaaaggttttaggctgggctcggggtgcatggttttgatagtagcacctcggccatataaggaccggtcttcgggcctctggtgcaaagcactaccgtacttccacatgtttagttggttaggcttagtttgtggctcagtctggttataacaaaagtacccgaatgagattgacgaagtcgggggtcgatgaacatctctaggacaaatgaaggctacacgagctgcggcccggtagtcgagatgtcatggcacagggccggtgtcctgctgctaggggctcagtcctgcctacctgtcccgggggttccggccgtaggtgggattgggtcggtactcttttctatggctaggatgggttggaaactatgtcacgtcttccgtctgtataccgtggtggtatgtggcacgtggctacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtgaaatggttggcctgggttggcttaggacgagctgggacccagggtcgggttgccagttcggtctgaatcatcataggccttgggttaaggcaggttcgtgtgggttcacggccttgattaataacattgtttagttctaggatcgtgtttacaaaatagctttgagcaactaaatgtcttttaatgctgtttactgcaactctaaccccttatgttataactcccttgtactcccttgcatttattatgcatttgtgggtgtgtcttgttgagtacggtggttgtactcagtcttgcttaattttcccaagcccagatgaggagttccctgaagatgaaggcttcggtgtctagctcgtgcctgccgtcaagtgcctgtggtcgtcgccctagtcttccgctgtttttcgttgtctttgagtgtgctgggccttcgttgcccatgtaataattatatttacgcttccgcttgttaaactctgaactgtatcaacttttggtgtaccttgcctcctgggacaaggaataatacacgcacgtcaggaacgcctgttgggtgatttccggtcgtgacaagttggtatcagagcctcccttgaccctaggacgagccgtagatcccaagccttagcaatattttcaaaaataaaaatc

SEQ ID NO: 87864 - DNA, 1369 bp, Oryza sativa
ccaccaccaccagacaccaaggccattctcacccaaatcctggcccagcaggccaacatgatgacggctttcctccaccacctccaaaatccgccacaacagaatgctccaccaccacccccacaacactttaaactcgccgagttcctccgcatccgtccacctaccttctctagctccaacaaccccgtggatgcgttggattggttgcatgccgtggggaaaaagctagacaccgtgcagtgcagcgatgaggagaaagtcgtcttcgccgcccaccgactgcaggggcccgcatctctatggtgggaccatttccaggctacgcagccagaggggcagcctattacttgggcccgcttcaccgccgccttccggaggacccatgtgcccgccgaagtcatggcccttaagaaaagggaattccgagagttgaagcaaggcaaccgctccgtgatggagtatttgcatgagtttaacaacctggcccggtacgccccggaggatgtacgggaagatgaggaaaagcaggagaagttcttggcaggaatggaccctgagctgtccgtgcgtctagtctccggtgactatccggatttccaacgtctggtggacaagagcatccgcttggaagccaagcacaaggaactagagtcgcacaagcgccgcttggcgaatttccgcaatcaacagggtgctaaccaaagggtccgctacaccaatccctatccagggggatcgtcctcgcagcagcaacagcagcaacaacctcgctccgcgccccgacctcaattcgtggtgcgcgtcccacagccgcagcaacagcagagtcaacaagggactcgtgcgacccgtcctcctatgccagccgtgcagcctggtcaaggccgcagggacgttcaaggtccgcagcgtctgtgcttcaactgcttcgagcccgggcactttgcggataaatgcccgaagccgaggcgccagcaaggccaaccgcctccccgctccaacaacggtggtaaggatgtcattcgggatcgtgtgaaccacgtgacggccgaggacgtgctgacaactccagacgtcatcgttggtacgttcctcattcattccatccctgctaccattttgttcgactctggagcttcccactcgtttatatcggtgccattcgtggggagaaatcagttgggggtagaaaggcttaggaacccttgctcatcaccacccctggaggggttatgacagcaaagtattatagtcctgccgtccctatagaaattcaggggattccttttccctcggatctgattcttctagacaccaagaacttggatgtgattcttgggatgaattggttggctcaattccaagg

SEQ ID NO: 87865 - DNA, 902 bp, Oryza sativa
taatctgtacatcatggagctgtttcatgactacaagatggctgataaccgttctgtagttgagcaggcccatgtaatacagaccatggctaagaaactcgagcaggcccatgtaatttgtggccgggtgcattattgcgaaacttcctccatcttggagaggttttggtactgcactcaaccacaagacacaggaatactccgttgaggggttgatagcgtctcttgatgttgaggagaaaactcgggaaaaagactctgcgtctaagggcgatggtgggcaatccagcgccaatgttgtgcacaaggcccagaacaagagcaaggggaaatacaaagctcagcagaccaccaacttgaagaagaagaagaacaacaatcctaatcaggatgagaggacttgctttgtgtgtggcctacctggtcatctggccaggaagtgtccacaacgcaaggggatgaaggcacttgcagggcagacttctaagtctgctaatgtgaccattggcaacactagagacggaagcgggtatgataatttaccttctggtttttcagttaatcagtctactaattggtggattgatataggggccaatgtacatgtttgtgctgacatctcattgttttcttcttatcaggtcgcacggggttccaccgtcctaatagggaatgggtcacatgcttctgttcatggtgttggcacggtagatctgaaatttacttcaggaaagatcgtgcagctaaagaacgtgcagcatatccctactatcgacaggaatcttggtagtggctcccgtctaactagagatggatttaagttggtttttgagtctaataaaatagtcctgtctaaacatggatatttaattggtaaatgttatgagtgcggaggcctgttc

SEQ ID NO: 87866 - DNA, 874 bp, Oryza sativa
agccactcggtccgcgagctgaaaaagctccgcggtagtctggggctctttggaagtcatcttttcgagcatgcggtggggccgcacgccccccctgaacgcgtagatcaccgcgtgtgcagggatgcatgggatagtgttgcggacttggcaaacccgctgattgtccgagcgaagcgactcatattcgccttgcttgactgcatgcaagccgcttctttgcctgggcgcggatatgtgccttggaagttcatggtgaactgtgggcacaaatcttcccaggagtggaccgacccgggtggcaggttcattagcccaacccgcgcctgtccttttagggccatgggaaagaagttcgccatgaccctgtcgtcacccccagcggccttaatcccgggcgtatagacctggagaaacttcggggggttgacgctccaatcgtacttctcggtgatggggggccggaaccttgggggccaacggacattccgaagactcgccacaaggctctacagccaacaccaccggtcccggggcacggagggctgatcttcacgtccatgtcgaggtgacactctggacgaggaggctccctccgttgcacggggagtacgccggctattacgccggcgcccgatgttgaggcgggcatccggctccccatgctgatcctcccgagtcgacggtgtagacgagggagtggcagccgaatgacgtgcagccgccgccgctcgccgcgccctccgccttgatgacacggagccggtggtagcagcgccggaggtcttggtggtggtggcggaccgtccaccagcacccaggcgctgctgtgccgtcatgaccaagttggccacgtcttccagccatcgttggg

SEQ ID NO: 87867 - DNA, 546 bp, Oryza sativa
tatgattctatatgggtagttgtggatcgattaaccaaggtagctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaaaaagagctgggtacccgattaaatttcagcaccgcatatcacccgcagacggatggacagaccgagcgtctaaatcagatcctagaagatatgcttcgcgcatgtgtcctaaatttcgggaagacctgggataagagtctcccctatgccgagttctcctacaataacagctaccaagccagcatacaaatggcaccttatgaagcgttgtatgggcgcaaatgccggacaccgctcttgtgggaccaagttggggaaagtcaagtgttcgggactgatatcctgagaaaagctgaagcgaaggtcagaaccattcgggataatctaaaggtggcacagtcccggcagaaaagt

SEQ ID NO: 87868 - DNA, 3197 bp, Oryza sativa
ttgctgatcctcgccatccagtaagtactattgcaaaatatttgtgcaaaacacacttggtggattctttttcaattaaacaacacacggcacttttatcatgggggaggaatgaactctgcagatttctaatacatatcaatgcctattagatatatagcattaaacataacatgctagtcttattgcttgcatcatgccccactgttattgaaatgttatctaccacaaatgtttgaaagcaatagcggtatatgcagttaagttccaaacgatttgctaggacccttgttgatctttcaccttgtcctgcaggctgaatcgaccagcgctaccaatgagtcagttttgaaggttgctcttgaccatggcaaagcttccggtgtgatcaagtcgcatgatcgcgttgttgtctgccagaaagtgggtgattcctcggttgtgaagatcattgagctggacgattagacgaccagcttgtgcttgttgatgatactacggcaagtcatggtttgccagattttgactaggccaaaaacgatgcttcttggctatatgtataattcctatataggctttccaatgagcagtttttcctatggtgtaatcataggatttgccttactatttgaaacaactacgttttagttatgtaagttatcagatttcaatgcatcatatcacttcgatgggcaaatggaataatgaaatcggtactgtaccctttggtcttttgatgttcgttccacctttgtcaatgtgctgatgtgatttgcgtgttccctagaaaaatgtgatcatgtgatatagcaagggttaagggacatgacatggttgaagatctcaatgctccaatcaaattcgcagatctaattttggttgaaatgtaatctcccttgctattcaggcatgttttccacacaagaacttgagagaaaataactgctaattttggttgcaatgtaatcttccttgctattcaggcatgttttccacacaagaacttaaacagaaaataactatgttaaaacagcaaaaacagataacctgttgtggtcggcgacttccaggtttactaacttattacaaagcaactggggtcagctagaatcatacacattccacatcatttgcagatctcatttgctgaaatgggctatgatgtctgaacaaacctgacgttgctgaaaaggtcacaacaaacagctgatttatatagcttgtaatcagctcaatacagcctcatctctccctcctctataccgattatttaagcttacaatctatacacgtttattactgcattgcatgcacccattggatttcgcagtttgtacacttcaatgtgctgtacttcagtccagtctaaacagaatgtgtagctaaaggaacattttggcttcccatactagtgctgttgccaagcactacgtaaaaaatggtgcaaaatgctacttgcacaaaagaatgatcattgaccaatacccttaaccttccagaagcagttgtgcaggagaatctttagcttccgatggtcctatcataagtagtcaagttttctcttaaaaggggcaatcccgttcccacgtcattgacaggttgcttgatggacaattgttgatttccttgctaatttaagcaacacgagagactgaaaactggggagggtcagaagatatctgattagcccacagatttgcaactttaacaaagtagtgatcggcatcccaaatgatgacctccattcctacatcaggtgaagaaaataattattagttggttgatagaagcatcccatagttgaaaagtcctttgcggggaagaggtaactgcaggataagtatttaccaggtacaagactagtgggcaagagggtaagtttacatgccatcttgtcactgggaaggaagctttgaagattgggcacctcaatgtcattaatattgatgatagactcgagaagaactttagcaacaggtgcatgtaagttcttgctgtcgacaaccattgtaagagccattcctaaaccactagtccatgaattaacgcagctgttccaacaaaccaacattttactcaacattccaggatctgcaagaacccaaggcttgaaagatagcatggatatatgtaagatctgtgcaactctgtagatctccccaagagcaataaagtaatgagcacctgtgcaaccaacagaaggcatgttagttgatcatctttctgcaagcaaatgattaccgaaaaaacaaattatacagctctgctcattattcagagtcccaccttgagaaattactgtttcgccaacatttgcatgacaagattcctgccaaatcatcgcaccatgctcaattcttgggcacaggacagaagcatactgtaccatgcactgacataatcacattgctcctctttggatgctatttccaaggtacgaaggattgacacgctgtgcttatagactttaacagctgaactcatgtcttccagtgcctacgttgagtatcatatcaagaaatttcaataacccaatcaagatcatgtcatgactcatggaaacaagggcagaaggtaatggcaaacagaaacattaagtgcacatacgtatactgaaatcaagcaaaatgacatgtcatctatgaatcactttgcctggtacaatctatatatcactttggaggcaagttcaatgcagcttatagaaaagcacaatatcattttcacatttaattatgtttatcatctacaaaagaaaatgtgcatgtgactactgaagactatccgccaaagaatttaagaaaacaagtgtactgatctaaagtaacttgatataaattacaagatttgacagtgtaataaaaaaaacattttttcttttttgtcaaaaagcaggatatataaatgcctaaagacaataaggtgtatagagtctatagacaatgagacaaaaattatatttcctagataaggatgcttaccattgctattatttctgttaaatggtattctttatcaaaatccttcaaatgatcctctttggcactgttaagcagctcaaaaatgcaaacatcctttgaaggatgttcatctttgcaaaaacctttcgcaagtgaagaatcttgtaattccttgcaaatttcctggagattatggaaaatgattaaacaaaatattatgtttaattcatgttttgc

SEQ ID NO: 87869 - DNA, 2548 bp, Oryza sativa
attcgagctcggtacccgagagagagagagagagagagagagagagagagagagagagagagagagcaaccaatcgaagaggcatatggatccaagagactgagaggaaaggagaagagaggcagaaattgctgcagtcgagcgaggccaagaaagccacccgagtccccttcctcccatagatccagctcccgcattctgattgatgatggagtgaggagattgcctgaaccgatggagacattgccaacccgtggaaggagcaacacgaagaaggtgaaggcgagtgggggcagcacggatgaggcgaggcagctggaggcgaagcgcctgtccttgtactcacggagaaatcacaagcgtagaaccacacaagagatcactttctttgggctcatatggaagagaagcaagaatgacctacgtagcagcaagctcaaggcagatgatgttattcttagaagcagggatggcgtaggctcgccgatgaaaccgacctgctttctctgcttcaagccatatcgatcagacttgatgtatatccgctgcgagagttgcagaagtaggtatacttgtcagttttgcagaatgaaagtctattatctttatttgtgtattgttgttggttttgacaatttgatgttctcctgtgcacagattggtttcatggagatgccctggaacttgaggaaggaaggatagctcaattgatttcgtacagatgctgcagatgtcggaggaggccgttgccgaaatgtcctcattcagatttttactattccaaagtgcctgaaccacaacccgtcagtcaagaaaatgcagatgacatgctctcgagcgaggaagctgctggagcagatggagatccaccgctcgattcatctggaggagttgaaccaactgtagaagaaactgttggtgctaatttctcagcgaacatgaaaagctctgtcccaggaagtgttcaagagactatctatatggatggttcttcccatcctactcatcctgtcagcaagggggttgcgaaggtagaacttgtgccaaccgttaagtctgaaattgggattggggtaccgagcacaattatagtttgtttttccactactaagttttgtagattttttccagaaccaaaaagaatagttgatagaaatttcaacttgctgtccttgtatgatcctagaggctagataaatcgatccaatatttgtacttctttttgcctatcaactgttcttttgctgcataatctatgtctttcatatgtgcgctgtgaaaacatgatttcaagattgagaacgaaatcattgaagttgttactcattagaagatcatgcatttctcgtgcacttagttcaaatgggcatatatgataatctttgtttacaagaactaggttgtttagcacatgcatgataaaaagtgaaacttcaaaggcatctaatcaagtcaaggatcttgtagtgcgcatttttagttctagtgagaacagaaactctaatacatcctatattcctatgatagatgtggtgttttgtaacaaaaaatgctggaattaagttcaatggaggcatatctattgcaaaccatggtttggattgtacattccatttttcagcaccagatcagcacaaaatattcccaaaacaaggtttttcatgattgcatctaaatcttgtttgcactttgtgatgattttgttcgcatacaaagttcagagcttcctgtatcacctatatacatttgcaaagtcttagtcttttaaataatccaggaggtccggccatatgatgcatgcgttgcatggtatgtacctggtacctgccgaagatcggcccctgggggatgatagccccccacaagctgctacagtggggagcaactttgccaacgaccactctgtcatacttcaccaggctgtatgttccagaattgtgtatagtttatgattttttctgtgtgacgtttgctatcttatttacactttttgcagtatgatggtttccgggcaatagctgcggagacaggctcattgtatgagcatctaaggcaaaaagaccatcagacaagtgatgatatcatgattaccttggacaaacttcagcagattgctttgcatcatatgaaggatattgcctgccatcaagccaacaatgtagttcaaccatctgatcagagtaattctagggctccagtgccagacacagatgctgctccaccatagttaacggtgctaccaagtgagaaaccttttctttgttgctgatacggcatttttgactaataattactatatcagcgaaacctttctttgtaggagctgtaaactaagcagggacggaaccaaaatatgatcacgcctagggctatgagttattgccaaattacattaccgcttaagagttttcacaatgtttttatatattttattgggatgttgtgctaagcctaggacttaaagccctaactaccccctgccactgaaactaagcatatatcaattatcatttatgtttctgtgcaggcaattgatggagcgcgagga

SEQ ID NO: 87870 - DNA, 730 bp, Oryza sativa
ggagagctcctgaactgccttgcagcaatcggagtcattatggatttccctccagctatacttggcatgacggtcttggcttggggaattcggtgggtgacctcgttgctgatgtagctttggcaaagtctggccagccgacaatagccattgctggctgctttgctggtccaatgttcaatatgctggttggactgggaactgcacttgtaatacaaacagccagggtgtaccccaaagcttatgtactcgaattccatgttggaattgttgttgcatttgtatttcttcttttgagcctgatgggcaccctgttgatggtcacctggactaggtttcgggttcccaggttttggggttactgccttatggggctttacatcttgtttacagtagtgagtatagctatagcgagctcttctggatgatacatatttttatacataaatagcagctagtcgtttgcagtatatataagtgtttgcaatttttccagttgctgcagagcaatggttcatttcgatggggatggttcacgaggtgcaagatgcctccaggctgcaatacaacttcttatcttggcagctgatgcatacagcccttcacactgaattggcttgtactggtctggcatgttcctgtggattcttctgtaccttcattttacgagttcatgagttcaggccagaggggagatcttgctggcgatgtgcatcagtgcatgcactgt

SEQ ID NO: 87871 - DNA, 1469 bp, Oryza sativa
ctcttgctgcaatccaaacattcagaatggtgcataagcattgttggtggatcgagtatgaatttcggatgcgcattgttttcgagtaatggagatatgaatcgttggctagtttgggtgacacctaatttgttgggcttggagaagtaaagaactcaagatggataaacttggttcagtctagcactcatacatgtagcattgttggtagaatgattgttaatttgcagatgtagttctgactttgggcccttttagcaggatacctggtgagattggatcggtgagtgtgcatattataatctgaacccttgtgagcattagattatttgcacaggaaatgaggttgacgaccaccgcacttaggaactgtgcaccgcgattggaaactcgatgccttatgctccccactgggttagaaaacaatgttatgcgcatggttaggcctccgagagataaattagttaaactagtgttgtttaattagtagtctgtctgtagctttcatggtgttgccatctttcacctttgttttgccttgatggaaatgtgacctcgtcttgtttgttgtcagagtccagtgttctatatgttcggttaagctgtctttcttacagaaaggaaaagttgtctcttctgtttcagaaaagtatagctattctcagattgggtttctgccttttgcagaagaaagaaaaaatactgattcttgttatcatcactatcggtagcttttacatgttggaaaatttgttatccttcataattgcttactgtaacacattagactgtattacatactatggtaaacatataaatattttttatgagaaaacagtggaacatctgattttaacccttttttttaaaataaaaacttttggggcacctttgatttctcaataaaacagtccataaaggaaaaaaaagaagatgattgtgaccttgtaatttcattttcttttgagcatgtaaatgatgcctcactgatgcttgtagatcaagaagtattgttatgaataattcacatatccaattaagcattactgatatcatattctgatttcaccattattttctttgatttcttagatttgatgccagaaatatgctggagaagttgagaaacaaaagagtagtatttgttggtgattcaattgggcggaaccagtgggaatctcttctttgtatgctctctgttgctgttcctgataagagctccatcttcgaagttaatgggaatcccatcacaaaacacatgggtttcttaattttcaagtttagagactacaattgcaccgtggaatattacagatctccttttatagtccttcaagggcgtgccccacctggagctcctggggttgttaaatatacaattagggtagatgccatggattggttgtctgaccggggccagtggagggatgctgatgtattgatccttaacactgggcactggtggaact

SEQ ID NO: 87872 - DNA, 890 bp, Oryza sativa
catagattgtcttttcaacaagaggttgtagacatgctcattccatgtatcagggactccaggcaagcaccagtggctgcaatcttgcctgtagagagggacagggcctgaaggactcaggtgtactgagacgtgcccatctttccgttgagccgtcatctgagtcacgttcagtatatccaacccgagaagcttgggcctgaagctgttccctagtacatcatttacggggttaagaaaatcagcccattgctccaatgatttaactggtgtcacatccggatgagtttccaaatgacaatttcctccagtcttccagtcaccacctctgcacaaaatatggattactaaagttgagtttgacagatcatttgaagcacatgttgtttgtgcatccaaaaaaaacattatcaacatgaagctaaagcactaatttccagccaaaagtgaatggccaagagattgcagaatagttctgcttttaaagcatctttgtcaacatgacgatggtttattgttgattgtcttactatatatggtactcagtcaagcatttcaatggaaactatgcacatatgttgctattattgtgaaagcagacactaaggtacctgactacaaaatttaagcaagtatccaaatcatattcttagaacaatatcccaagactgtcaaataatgcttgagcaaggaaatagttgaacaatcacatcactgtcgagtttgtgttttacggacctgaaatgcacaggagcatatgtacggaagatgacatgggtcttgcttgagttaacctcattgtgaagccaaccaaacaatgtctgtatggatcttttgtaagcatctccgacagtcatgtccattttaactgcatccccttcttgaaaata

SEQ ID NO: 87873 - DNA, 819 bp, Oryza sativa
actactatagggcgaattttttctcggtaccccactgtcgagtttgtgttttacggacctgaaatgcacaggagcatatgtacggaagatgacatgggtcttgcttgagttaacctcattgtgaagccaaccaaacaatgtctgtatggatcttttgtaagcatctccgacagtcatgtccattttaactgcatccccttcttgaaaataggtgccactgatacaagacataacagtaagagtgtaaggcttatgccatgtatattacagatatgcaattatgttaacttaaaattttgctcaaaagcagaacaaattgctcagaaccatctatcagtcatcatatatgaattagagaacataactacagaactatagtttagatattaatgcttaccttctgattgttttctcgtagttccaccagtgcccagtgttaaggatcaatacatcagcatccctccactggccccggtcagacaaccaatccatggcatctaccctaattgtatatttaacaaccccaggagctccaggtggggcacgcccttgaaggactataaaaggagatctgtaatattccacggtgcaattgtagtctctaaacttgaaaattaagaaacccatgtgttttgtgatgggattcccattaacttcgaagatggagctcttatcaggaacagcaacagagagcatacaaagaagagattcccactggttccgcccaattgaatcaccaacaaatactactctttgtttctcaacttctccagcatatttctggcatcaaatctagaaatcaaagaaatatggtgaaat

SEQ ID NO: 87874 - DNA, 815 bp, Oryza sativa
tagggcgaattcgagctcggtacccatctctcggatgcctaaccatgcgcataacattgttttctaacccagtggggagcataaggcatcgagtttccaatcgcggtgcacagttcctaagtgcgggggtcgtcaacctcatttcctgtgcaaataatttaatgctcacaagggttcagattataatatgcacactcaccgatccaatctcaccaggtatcctgctaaaagggcccaaagtcagaactacatctgcaaattaacaatcattctaccaacaatgctacatgtatgagtgctagactgaaccaagtttatccatcttgagttctttacttctccaagcccaacaaattaggtgtcacccaaactagccaacgattcatatctccattactcgaaaacaatgcgcatccgaaattcatactcgatccaccaacaatgcttatgcaccattctgaatgtttggattgcagcaagagatttcgcttgagatgtctagatttctccttcacgagattgctaaagtagacaatcgagtagattcatctaaacccccaaacccccaccaaatccaaccgagcggaagcgtacaagcaagaacttaatcgaacaaaccgaccaacctggggagatcgcagcgcgacggcctccaccgccacttggagtaggacgcgtcggggcggccgttctcggagcaccggaacccgacgtccaggaaggggcagtccgtggagtggtagagcgggtagctgtcgttccacacccactccccgtagaacaggtcgcactcctcctcctcctccccctcggcg

SEQ ID NO: 87875 - DNA, 672 bp, Oryza sativa
tcgccatcaagtccaccaagaagctctgtgctgtgagttctcctgacaattcattcatgatctactagttagtcttgctgtctactaacatttgggagtcctctcgttgttgcgcaggtcatgctcgacactgtcggcccggagttgcaggtggtgaacaagagtgaggctgcaatctcccttgaagcgaatggcactgttgttctcacccctgaccaggggcaggaggcctcctccgaattgctgcccatcaacttctccgggcttgctaaggtataccttcagtagttcagtgttatttatatgaaatattatgattgtttttacttttgttgcaatcagatcggtccttgactgtttcctagagaaattttgtatgttaccattacgtcaccgcaatttgtagcatctgctatgtgaaaaaaattgactctttttgtcctttgcaggctctgaaaccaggtgctacaatttttgtggggcaatacttgttcactggcagtgagactacttcagtttggttagaggtaaaaatcttcagcatgctaaaactggtgttctgtgtttgtgatgtgtaatgtgttacgtccttgttagtaggatgtgcttgctgtctacattttctgatacctaatctccattctgcttgatataggtttctgaagttaaagg

SEQ ID NO: 87876 - DNA, 986 bp, Oryza sativa
ttcaacaagtacaatgaaaattcacttcttgtttttctgtctatatcagtctgttagtaacatgatttagtcatatttgtttgtccattgtttcacaggcagagaaggtattcaaccaagatttatacttcaagcggactgtgaaatatgttggggagcccatgacccacttggagtctatcgcttcttctgcggtgtgtttcttctcttgttcccaaaatttcttaacgtttattgtgcacatataaaatatttttgactattccattgttttttgcttcacaaagtctttatatgaaacaagggtttcttagtctgaaattgtttcttgcctattttgcaggtgcgagctgctatcaaagtgaaggcttctgtcattatttgcttcacatcatctggacgcgctgcaaggtagaaagatgtgaatataaacaggataatggtgtagtttaatcaaaactaatttcatatttcatctggtatctgtaatgtctgcagactaattgccaagtacaggcccaccatgcctgttctatctgttgtcattcctcgtctgaaaacaaaccaactgaggtggagtttcactggcgcatttgaagtatgtaatcagtccttcccttctatgtttatgatcttttttctgatttttttcatgtaacatgctttctgttatctggtttatgcctgactattgtatctcatatttctcgatgcttttctttcaggcaagacaatcactcatagttagaggtctctttccgatgcttgctgatcctcgccatccagtaagtactattgcaaaatatttgtgcaaaacacacttgggggattctttttcaattaaacaacacacggccttttatcatgggggaggaatgaactcttgcagatttctaatacatatcaatgcctattagatatatagcattaaacataacatgctagtcttattgcttgcatcatgtcccactgttattgaaatgtta

SEQ ID NO: 87877 - DNA, 4531 bp, Oryza sativa
agtaatgatttactaatgttaaaaaatggtatttaaaaaatggaaataaaagttttttaaaaaagtaatgatttgctaatgttaaaaaaaagaaaaaatggtatttttttgttgtgttgaaaaatttaaaaatatagattgtgatttattattttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagataatccccttaatttacacctaggatctaaaacaaaagcaaaagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtgaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttcttctatatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttattggcacacgactccgcatggcgcttgaggtgacctgtaccaccagaagaacgagcagataaaatttgcctacatattctacaacgggctttcgatacctcccttccgtcggggcatgtttcctttatctcgtcgaagttttgccacacaccggaggttctcgatctcttcgagccggtgtgtgtcgaaacacttccgctcgcggttccggaaaatccttccgaagctgtcgccgtctgaaccggtaccttctctacgacaggcgtatgaaccggtacctcctacacagatgggggagttggagccgatccggaggtatcgtcaaacctcgacatgtagttggggtcgaaatcacccaaggtgaacgacggcgactggtatggaaagttcggatccattatgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaataaaaaaaaatgcacacttgagaacaaagagagcacttaaaacacttgagagcacaagatgaggagtgtgggatgaggagaaatggctggggttcatgccctatttatagggcgaaatttgagatttttttggaattttttcgaaatttttatgaattttttagcctcccaacggttattttcaaatttgaacggtcaaatagccgttagtgccacgtggcgccttcccattcgaccgccgcccgccctgtccctgctttcggcctggcgcgtgcgccgctggcccgctttcggcctgacgggccgccggcgaaacgggccgtgccgtgccgcgggccgtgccgtgccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccgtttggccacctctactctgaacattgcttatttctgcactctgttcttgctactagttgaccaaagttcatgaaatgcagtgatctacaacatcactacatcaaacagacatccatagtaacaactgacaaggacaggttatttgcaacagaactacattcaactgatcacagccggcctggagttcattcctgcttgaacaacaaaggtacagagatcatactacacacccagaacactgaagcacttgccatgcaggcagtacttctcttttatgaaaagatgatacagatcagttgcaactatgttacaccaccaccatgtacaacgaccggacaccgaaacatcatcctagtgcagagctgtgaggattgcagtggcgctctcaacctagcaatgcatccagaaaggtcgaatgagttcagatcaaatgcaaatgatgaaaaaaggagttctgttttattgagtcaagttaattaggatcccctcgagggatcaaaatagtttccctcaacattatattcttggcaagaaatcaatttcctttttaccttgaaggttgcaccacagatctcttcttcatttgcaggaacagcagtcaccttgttctttgggttctcatagcacttcaagcctccaagagcattggaatagaagcaacctgcagtcagaatgcatgtaattagtgagcataaccaaaaatggctctttgcacatatttgagcagtgaagattcaactgacccacaattttatactaaatgccccattttaaatgtcatttgcaatgattggcaacataaaaggactatgattcaaacattaccttgtgggaaaggtgcaagtgacttgccacatgatcctttaagcaggtcaatgtcgttagagaaggcaacagatccatcagcagttatcccccagaacagaggcaccttgccctctggatcctgagacaacaattgccagcacaagatcacgtcataatcagtaagctaaaccaaccaaatcaccaagcactgtcaatgcaagtgtttgagcaacagcatgtaactgtcggttgcctcgagatgaagaactcacagaggccacaaggagagaagaggtggacttgtcgaagagcacaaaggcgtagctgccggtgagctgcgagagcatgaagctagcagggtaaggtgctctgtctctcagcgtcttgtacgcctcgataaccaggagcacctcattggcgcccttggacaggccatactgctggctcagcctgcccagattgtccag

SEQ ID NO: 87878 - DNA, 692 bp, Oryza sativa
ggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtacgagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaa

SEQ ID NO: 87879 - DNA, 1092 bp, Oryza sativa
ccatcagatagtgccgattggagttgtggtgcctgccgggagtgccgatgatgagcttcaaactttcattgcacttgttacctgagagctgcatagagcagctgtctaattacagtcgaaggtaagcacagcattttatctttgaatactacctgaatttttcagtttaacaagaatttggtttatggttctgagcataatttgtgtttaggtggatctgtagaagaaatctcatgaagcacaccaaggaggagcgagggaaaatttcccttctagctatttggcattgtcagtgccactgaccgtttgggagttgtggcgttgattactggacacaccttagcaatatggtttgacaaccaaggttttcggcgaactgtacatatattaatgaatggttgatcgaaaaagccgttttccattcatctaggcggttttctttttaaggggaggattataggattagattgctcttagttacgtgttatataggagctctggactttggaagccatgttcctgacaatgtgttgtcttggattcttttgcccctttttttccctcagaaaaagaatagaagtgcctctttctccgagtggatgcgatatccttgatatatatagcctcggctttttcctctgattaaagatgcttgttgctctgcctttttctggtgtggacgtgcggtggctgtacgagtacgactataggaaagatcatttttcacgtctttactctttacccttatatttttcataatgtcatggcttttatgtttctttctgcttttacttttgaatcgtacagtcaaaatgcttcaccgagccacacgagccacttcaatgcacaagaagattgtgatgccccattatattgtataagcaggaaactttgcatggattttgtgaaagaggcaagttcaattcctgctgctctttggtctctcatcactcaaaacatcatataggcctccagcgtagttgcatttctacatgggccgagcaggacgtcacatcatacaggcccagattgtagaaatgggcctagcaggacgacacacatgcagccccatatgcataaatgggccgagaa

SEQ ID NO: 87880 - DNA, 1887 bp, Oryza sativa
gtcataaagagtgcacattaaggtctgttggtacaaagaaggcaatgctgcttccagtttaacatgcaagttgtgcctcaagaagcgtagtcttatgcttacaaattacaatacaaacgcaagtttcatcctacctcaacagaagagtaatgtccatcacgcagtggcagctcccaaaataatctttaaggttggttcttcccattccgctgaaccagccacaaaggttgaagctccgccaatcgtgaaggtagaagcccagccagtggtcaagaaggaaacctgccagttgtgaagatggaaacccagccaactgcaaatgtagaagcacagccaactgcaaaagtggaagcctttccaatttcgaatttggcaactcagaataatgcaggggcgcaagtccagcctaagacaaaatctaaaaaacccaagccagaaaaaccgagaaaatccaagaagactgaagagatcaaatactttggtctcgtgtggaagaaaagcactaatgacaaaaataataatgaaaattctggagaagtgttcagggcgaatgatgttatcctaaaaggcaaggatggtgtaggttcatcaataaaacctacttgctgtctttgtaataagccttattgcccagatttcctgtatgtccgctgcgagaggtgcaaaagtaagcccgtctatcattattgtaggcttgtagcttcaagttatgtatatatatatatgtgtgtgttatctatcagattttaacttcttgatattcttctttgttcagagtggtttcatggcgatgccttgcaacttgaggaagaaaagatatttgaattggtttcataccgatgttgcagatgccgaaggcgagccataccaaaatgtcctcattcagatgattataagaagcctgaaccagaatacagtgagcaaacagtcgctacgtcatcacagtcaactatgctttctagtgaggagaattttgctgtagcagatcaagatccactgcttgcttcatatggcagagttgaaccgtttggagcacaaacaatggatgctgatttatcgatgaacatgatgagctttaacccaggaaatcagaaactatcagtaagaaggggacaaaacaaaaattgtgaatatgttgaccaatccagtatacatgtggatgactattatatccagaatcaacctcaagggaatgcaaacatcaatttcagtcactcgaatgaattctctttgtcagaggctgatggtgtggatgcttcagagctgttgggatgggatttttctcaaggaaataccagtgctgccccttctgatttcgcagctaattgcccgtggaatgacatcagctgtggcagcgttgctggtgatgaatatgaaccacagacttatttctcattcaccgaactacttgaagctgatgatacacagttcgataatacatttgggatgtctaatagtgtgcaagatgatggtgaccaacaaggaattggttttgatgaaatggctttcatgatggaagatggggcctcaaacatgcctttcccaactattgactccgcctctgacgaggtagcatgtgacaggtgcaagaatcctcagccgccacctgatctcaaatgcgcagtatgtggactgcagatgcaccgtcattgctcgccttgggaggatggtgaacagccatcagatagtgcctattggagttgtggtgcctgccttgagtggcgatgatgagcttcaaactttcattgcacttgttacctgagagctgcatacagcagctgtctaattacagtcgaaggtaagcacagcattttatctttgaatactacctgaatttttcagtttaacaagaatttggtttatggttctgagcataatctgtgttta

SEQ ID NO: 87881 - DNA, 724 bp, Oryza sativa
actatagggcgaatttttcttcggtacccttagcctgaatgattttgttgtgcagaaccaacaggctttgcagttccgccgcgggtttcaagaggcaagcaagtttcttcctgatgagagcaagcttgtgattgatgtggataagctctacagtggagatgaggggagtaggttccttggtgaggttagacaagagaagaagcttgtgaaggtgaagacagaaacctctgatgttgaatcagcaggtcaccgaggaaagaagcatttctatggtgatgacctggatgcggaggaagggaggtgcagcaagcattccgcgcaagggattgacactgaccaccttgtgagggatttgatggacaaggtcttgctatgcaatggtgagacatgctcaaaaggtgttaaggagttgcgtgaggctctgcagcatgatgtggcgaaacattcaggcggaggccatggcaaagggtccagccatggcaagggtcgtggaaagaaacaacccaagaaggaggtggttgacctggagacccttctcatccattgtgctcagtctgtggccactgatgacaggcgcagtgcaactgagctcctgaagcagatcaggcagcatgctcatgccaatggtgatggtgatcagcgtttggcacactgcttcgccaacggcctcgaggcgaggctggcaggtactggtagtcaaatttacaagaactacacgataact

SEQ ID NO: 87882 - DNA, 635 bp, Oryza sativa
tctactaacatttgggagtcctctcgttgttgcgcaggtcatgctcgacactgtcggcccggagttgcaggtggtgaacaagagtgaggctgcaatctcccttgaagcgaatggcactgttgttctcacccctgaccaggggcaggaggcctcctccgaattgctgcccatcaacttctccgggcttgctaaggtataccttcagtagttcagtgttatttatatgaaatattatgattgtttttacttttgttgcaatcagatcggtccttgactgtttcctagagaaattttgtatgttaccattacgtcaccgcaatttgtagcatctgctatgtgaaaaaaattgactctttttgtcctttgcaggctctgaaaccaggtgctacaatttttgtggggcaatacttgttcactggcagtgagactacttcagtttggttagaggtaaaaatcttcagcatgctaaaactggtgttctgtgtttgtgatgtgtaatgtgttacgtccttgttagtaggatgtgcttgctgtctacattttctgatacctaatctccattctgcttgatataggtttctgaagttaaaggagatgatgtggtttgtgtgataaaaaattccgctactctggct

SEQ ID NO: 87883 - DNA, 912 bp, Oryza sativa
tatatattacaaattgaacaaataacttaaaattatatattataaattgaacaaataacttaaaataagtgatctaacaaatgtagttgaagaaaattttatgagaaaacgtatttgtagaagcatgacgcagataattcgcagcaataatcaggtagaatgattgcgttcatcttaagcctaagcgagataaaattttgcagcatttggtgtactagtgtccagaagtgtaaaaacgtattgtcattaatattcttttaaaaaaaattactcaccttccaagataggtcttgagccatgcagttctgaaccatttcttggaatgccggtgtgttgtactgcttcagagcccgtttgacagttgaagcaaccgctgtgacgtccactggatcaacagtttcgcactacaggatgacatgacaaggctagcatgacgaactctttcctgatcttgagggcaatcaaaaagtggaaacacactgctccttacctcgacattgaacaaacccatgtggaatccggtcacgccctccttaaccgtgtcgacaagtcctccagtagatgagcagatgggaacctgtagtttgcaacattgtgaatttgattttctttttggtggtattacccacagtgtagttttactttgaacttttcaccacattatgatgaatacaaaaattcaattatgttgtattgctgtgattcataataacttcatagttcatactgcaagcaaggatataaaaattgactagtaatatagtatcaaggactgtctcattaacttcacaattgtgtaatcagacctaaagtgagaatacttaccactccatatctcatcccttgcaattggatgagaccacatggctcaaacctactaggaacaattataaaatcagccccagcaaacat

SEQ ID NO: 87884 - DNA, 696 bp, Oryza sativa
agactagttagtagatgctacagctggctgcgagttgatgggtttcttagatgcatactccggttatcattaagtttttatgatgaagatgaagagaaaacgtcgttcatcactccgtttggaatttactgttttattcgaatgccatttggtttaaagaatgctggagcaacttttgcaaggttaataggcaaagtattggcaaagcaattaggccgcaatgtagaagcttatgtggatgacattgtggtgaaaagcaaacaggcgttcactcatggcaaggatttgcaggaaacatttgagaatttaagaaaatattcagtcaagcttaacccgaaaaagtgtgttttcggggtaagagcaggaaagttgcttggtttcttagtatctaagagaggcatagaagcaaatcctgacaagatcgcagcgattcaccaaatggagccaccaaaaaacacaagggaaatgcaaaggctgacaggaagaatggcttctttgagcagattcctttctaaatctgaagagcagggtttgccatttttcaaaaccctaagaggagcaaacacatttgagtggacggccgagtaccagaaggcttttgatgatttgaagatgtagttacagaatatgccaactttagcaagtccacagaaaggtcaacctttactaacgtatgtagcaacgacaccagggaca

SEQ ID NO: 87885 - DNA, 859 bp, Oryza sativa
aagttgcttggtttcttagtatctaagagaggcatagaagcaaatcctgacaagatcgcagcgattcaccaaatggagccaccaaaaaacacaagggaaatgcaaaggctgacaggaagaatggcttctttgagcagattcctttctaaatctgaagagcagggtttgccatttttcaaaaccctaagaggagcaaacacatttgagtggacggccgagtaccagaaggcttttgatgatttgaagatgtagttacagaatatgccaactttagcaagtccacagaaaggtcaacctttactaacgtatgtagcagcgacaccagggacagtaagtgcagcattagtgcaagagaaagaaaacaagcaaatgctagtttacttcgtattagaagctttacaagggccaaagacaaggtacacagaagtggaaatgttgatttatgcaattgtgatggcctcaagaaagttgagacattatttaatatcagatgacataacgatactgtcagcatacccgataggagaggtattgacaaataaggaggtagcaagaaggattgcaaaatgggcaatggaacttctaccatttgatttgaagtatacctcgagaacagctataaagtctcaagttctggcagatttttttggcagaatggactcccaatgaggtggaggaaaaggaagaagatgaaaaactatggataatatactctgatggagcatgcaatgccactggcgtaggggcagcagtggttgtaaaaacgccgatgaagcaaacactaaaatattttgcaaagctagttttcccatcaacaaacaacacggcagaatatgaaggggttttattagccatgaga

SEQ ID NO: 87886 - DNA, 7478 bp, Oryza sativa
tttttcttgatttactgagacttgaatgggcttaaacggagctcggatgaattaattatgaattttagaagattcactgtgtttattactataacaaaaatccttaaataatttattgcgcaatattttccagggctgacgtcagcacggagggggtgcggcgccggcaagcggggcccactggtcagcggctcaggggagagcggttcaccgtggaccgggaccacgcgggtggtccaccgccgttccacggaaccaacggcccagatcgccctcggggccgatcggacgggcggcgatagaggcggagatgtgggcgcggcggcggttgcgggcgcggtggcgcggcgggaggttggggaagggcccgacaggtgggccccacctgtcggtgaccccgggagaggagggcagcggggcggcctggctgggcctcggcctgcggccggcccagcagggaggagggggaggaaaggagagaatgggccggcggcccattcggaaaaggaagggaaaaagaaaaagaaaaaaggagaaaagaattttccctggaattaaaatattgcttgctcaattttaattggttaaaattatttttagggctctgaaaattccactaaaaatcctgttagtgaatttcgacctgtagaactcaagaaaaattccacatgccaattccgattattatttgcattgatttaaaaggggtttactcttgctttgcaccggtattttcttagggtcatttataaattaaatttaggcttgggaggagaacttcagggtgtgacaaacctaccccccttaaacggaatcttggccccgagattcggaggagctggcgaagaggtgcggatgggcggctttcaactcatcctccctttcccaggttgcttcctcttctgaatgatgactccactgaactcggcaaaacctggtgaccttgtttctggttcttctttcgctggtatcaagtatatgaaccggcttctccacgtatgttaggtcctcctggaaatcaatgtgttccgaatcagcctgttcttcaggtacccttaagcacttctttaattgggacacgtggaacacgtcatggatgccgatcatattggatggaagttctaactgataagcaacttccccccttcgttccaggattttgtatggtcccacgaagcgtggtaccaacttgcctttcgtctgaaagcggtgtactccccggagcggagtgacacgaagatacacgtaatcccctgcctcaaaagtgagctcccttcgacggttatccgcgtagctcttctgtcgagactgggcaatcctcaacctttccttgatgattctgactttctcttctgcttccgctaatacctctgtcccgaacagttgacgctcgcctgtctgatcccagaagaggggtgtgcggcacttccggccgtataaagcttcaaacggtgccatctgtagactggcctggtagctgttgttgtacgagaattccgcatatggcaagcttttgtcccaagctccaccaaaatcaagagcgcaagctctcaatatatcttccaagatttgattgactcgctcggtttgaccatcagtttgcgggtgataggccgtgctgaaatttaaacgggtccccaattcttcctgcagcttctgccagaattttgaggtgaactgactccctcggttagatacaatctttttgggtactctatgtagacacatgattctcgagaggtagagctccgccaaccttttgcccgtatacgtggtatgtactggtatgaagtgagcaaccttagtgagtcgatccatgactatccagattgaatcgtgacccgatgatgtccagggcagtcctattataaagtccattccaatctcctcccatttccattccgggatttgaagaggttggagtaaacctgctggtctttggtgctctgccttcactcgttggcaaacatcgcagagtgcgacgaattcagctatttctctcctcatgctgacccaccaaaacttttctttgaggtcttgatacattttggtgctgcctggatggatggagtactgggtctgatgagcctcggtgagtatcagatccttcagttccttgtcgtcaggtacacacaatctttctcccaaccagattgtgccatgctcatcttcgtggaaatcccgggcttttccgactctcatgttctttttcagctctgctatttcagaatcatttacttgagctactctgactttatccacgagcgtaggccgtgcctccagagcggctacgaacccgtattcaacaattcccatgttgagatgctcaaagtcctgccgcaattcctcacacatgccctcgatgcacagggcagtgcagtgacttttcctgcttaatgcgtctgccaccacattggctttacccgggtggtagtgaatgctcatgttataatctttgattagttccaaccatcttcgttgtcggagatttaggtccggttgggtgaagatgtatttcagattcttatggtccgtatatacttcgcagcggttgccaatcagatagtgcctccagatcttcaaagcatgaaccactgctgccaattccaggtcatgagttggataattcccttcgtgtggacgcaactgccgcgaggcatacgcaaccaccctgccctcttgcattaggacacatccaagtccgtggcgggatgcatcgcaatagacttggaagtctttcatctgatcgggcagaatcaaaactggtgcggatactaatttctttttgagctcctcaaaactcttatcgcactcagctgtccatttaaacttctcatctttcttaagcaactgagtcatgggtcgggcgatcctggagaagttttcgatgaatcggcggtaatatcccgcaagtccaagaaaactttgaatctgcgacacggtcttcggtggggtccatttggtaactgactccacgttcgatggatcaactgccacaccttgagctgtaatgacatggcccagaaatttgacttccgttaaccagaagtcacacttgctgaacttggcgtatagctagtgctccttcaacttctcgagtaccagacggagatgttgctcatgttcttcttcggactttgaatagataagtatgtcgtcgatgaataccacaacaagcttgtccagaaattccatgaacactttgttcatcagattcatgaagaatgcaggtgcgttagtaagtccgaaagacataaccgtgcactcatatagcccgtaccgagtggtgaaggccgtctttggaatatcctcttcccggattatcaactggtggtaggctgatcgcaggtctatcttagaaaacactttagctcctttcagttgatcaaacaaatcatcgattcgtggcaaaggatatttgttcttgattgtgacctcgttgagtgcgcgataatcaacgcacatcctcttcgtcttatcctttttctccacaaaaatgactggagcaccccaaggtgaagtacttggtcgaatgtaccctttctgcagctgctcatcaacctgcttcttgacctctgctagttcgttggccgccattctgtacggtctcttgtaaattggagcggttcccggtgccaagttaatccggaattcaatctctctcttgggtggcatggtagtgaggtcttcggggaacacttctggatactcgtagactatggggatatcttccaatttcctcaaattcttctccatggtgaccactgggatttccgcttcaatctgattcaaggagaccccttgctttggtgagtttggtgatttgtacactaccgtttctcccttctcgttggtcagggtgactgtgcgattcacacaatcgatgactcccttaaacttggtcagctaatccatcccaagaatgacatctaggtttttggattcgagaagaatgaggttggctagaaacggtgatctttgaatttctattgttatagaagggctgaattgaaccgaagtggagctattccctggggtatgaacccgcattggtgtgctaagttcctctcttattaacccatgcatcccgacaaacttctttgaaatgaacgaatgcgttgcaccagaatcaaaaagtactgttgtagggattgagttaacaggaaacgtacccagtacaacctctggtgctgcttgtgcctcctccgcagatgcgtggttgacacgagcctggataaaccttggcccggcacgcctaggcttcgggcatttgtcggcgaagtggccaagctcgccacagttgaagcaagaccctggttttgctccagtctccttcctggcttgcgcggacgggccggactgtgccggtgccattggtgggcgtggagctgcaccgcggttgggctgacctccatggtggttctgactgccactggcgccctggggaaagttgctagggtggaacgggcggtactggcgaacgatcatggtggtaggtccaccctgctgcccgggagcgaagcgcggcctctggtgacttccctgaggtgccctgaactgagcggccttcctcttcctgtccatcttgttgcgttgatcctcctgacggattgccttgtcaactagcctctcaaagtcggcgtagtccccagatatcagttggttggtcagctcatcatccagacctgccatgaacctttcctgcttctcggcgtcggtacggacatcctcgggtgcatatcgcgcgaggcgattgaactcatggagatactccgtcacagtcctgttgccttgatggagtgcccgaaattccctcttcttttgtgccacgaccccgtctggcacctgcgccttcctgaagctacggcagaactctgcccaagtgacttcagtacctggtgggcgggtggccatgtgattatcccaccaagctgacgcaggaccttgaagctggtgtgtggtgaaagcaaccttctcctgatcattgcactgcaggagattcagcttcttctctatggcatggagccagtcattcgcctccatagggttggtggtgctggagaaggtgggtggcctgacacgtagaaactctggcaacttggactgagggggagggggaccaaactgctggtgctgctgttcggcgtgctgcaacatcctctggtacatctgctggtgctgctgctgcatctgttgcatcatggctgccatcatctgagtctgatgtgccatcacttgggctagcgtcggattctcgggaagtggtggcggaacattgccggaattgctgttgggatgcacaccctcagtgcgctcttcgccgttgctgccctcgcctgttgcgcggctaccattcctggtgtagaccatctggaggaaaagcatacaggggaaaagaaggaaaacagatgctcaggaactaagctttattatataggaatttaaactgcaattgttctgatctgaattaaaacacttaaaaagcaagcaaaaaaaataccttattaagacagccatatcataggcacatgatatcgaccgtcgactgaccccaaacaagcaacctaaacacacaaactaacaagcagaagctagacagtcgataaactaatggaaaacgagcctaatgctccgaacggctcctgcggtcggtggagtcgaaggcgtcctcctgctcgtcaccaggtccctctgagcgactcccggagcctggccgataagtctcgccgctgcccgactctgagccactggagctactactgctgagatcgcggctgccactgggagtagcagacaaccaacctccgttgccactggctggacccctggcggctgatgctggagcgaaggagagagcggacgcgggagcggacatgtgaacgggagctggagctggtgctggagctgcaggaactgcgggcggaactggaggtgctgcgggagctgctggcggaggtgggttcctgggcgcaagttggatgcgcacgggtgcagtcgtcgacatgcggggtgtagtgcggatccggactccttctggcgcgggaagtccctttaactgagcaatcttcctcttcaggcgcgctattctagtgcttcagagcgacgatccttatgagcgggccatcattcaaggcctttgacgccttgtgcaggtccgagtgcatcctatccaatccccttatcacagtacacatgtgaccaaaggtagtgtagttctcgtcagctgtcggacggaaagtactgacatcatcaccgctggctcgacaagggtgaaatcggtacgccgtgtcgtggaagatgtagttgtggcgctcccgtagtctggccatcatcaggtatgctgcctcctgacaggcgtgatctactgtgcctccggatgcctcaaccaccatattagctaggcaggtacccacgtagccgtggacctccaggcgaacacggtgaggaagctcgccactgagcggtggaaccgtcgtgtactctggcgcgttggggtagcccaccaccagcgtcatacgtgccaactctgccacaaagtcgatcatgccttctcctcggtggttgggggggtggccggccatctagagaaggcaaaggactaggatcaatgcatgctcaaatccaaatttaaataaagcaataaaagactcaaataagagaatcgaataagagcgaaattttatgcatagatcattttgcatgagagcgaataaagaagacagacccacataacgataaaataatggggaaattagatacatactaataataacaataagagcataaataccttgcaacccatgttcctgagctaggacccaaatcccaaatgactaacgaataaatctcaacagttttactaaaaccctggactgacttgttttgacaaatctcacttaaacgagcgaccaagatttttcccttgaaccacaagacagatcccaatttttcccggaacaaatccaattgcaaagaacatatgcaatgaaagggattcagagagctcttaggtttttccatttggcttgtcctacggtcaaggttggctctaatactaacttgtcacgcccagaaattcccgagtagaattccaagcagaatgttcattaaaatccccgtccaggaccggccggggtacacaaacgacaatgttgacattcagatccacgtcttacaaacatcataaaagtcttacacaaatgcagcggaagaaaagaaagacaacaggagctaagccttgactagaactgcagcgggaacaccactccacaggcatcctcgacggcacggacgaagcctactcctcggagaaaccttcatctgacacatactcgagctctggggatgggaaaaaatagagcaagactgagtactacccactgtactcagcaagtcataccggaataggggtatgatgcagggaattatcaaagaagagctggagtggttcatttgcataaagcgagcatttataaaca

SEQ ID NO: 87887 - DNA, 1171 bp, Oryza sativa
  unsure (1)..(1171): unsure at all n locations
ctgatgcagatgctgctagctgcttattctgatgagacgcggaccagaatgctctgagctcctcagcaaatcccctctccctgccgaaaaccaccgtcttgtggtcgcaggcttccatgagtcggagctcggcgccgggaagcttggccttgaggtggcggccgcactccgccggaaccacctgatcgtcgccgccgtggatcacctgcaccgggacgccggccgcctcgacggcctccaggttcctgtcctgcagcatggccccaccgcagatgacgttgtgcatcgtgtgccacgccgagtggtgcgtgtgcttcgtcagatcacccagcagaaagtccacatccctgcagcatgcaacaacatttttttttgtttaaaatcaatcttagttaaaaggagctttgttttctgaactctgaattaatcctagtatgtgattacctctttcctgtgatgagcctgaagaggcgctcccagagcaggtgatttttgcagaccaagaagcagacagtcctnccaatgtgctcgtaccatgacatcactgcggatccgaactgcaatggcggccacagcttcttctccgccagtctcttcagtgccacttggctcgccttctcttcgcatgctccgaagtacggctacaaccaaagtcaacggatcgatatttccttaattaaattcagagctctcactgattcttcttcagatatatatgtactgtacttaccggtgcaatcagtgtgattgatctgactcgttctgggtgcttggcagccaatgcgagggcgatgatgcagcccatggagtggctgacaagatggaaggagctcaggttgagtggatcgatgaggctccgctcgatcatctcgacgtgatctttcagtctgtacatgcagtttgccggcttgggagacttgccgaagccgaggagatcgaccgccaacattctgcagttgttgaggatggatgattcgcggaacactgttgcccagaacgacgatgacgaggtgaagccgtggatgaagatggcgtcttcttctccactctgctgcgtcgttgtcactgctccatctgcaaaagctaagctcgcgaacgttaatgtcgccgacacggcaaagcgaaaggattgtaacagaaataacggaagcggttgagaccgtttggcggc

SEQ ID NO: 87888 - DNA, 824 bp, Oryza sativa
ctaccccggccaagcgcttacagagctggagtgaacatcacattggcagtggtcgtctgcagcttcagatggcgaaggaacttgtcttccggcttgatgttgcgcaggaaagtcggtctctttcccccttggagacctggctgtggcgagatttaaagttgaagtgtcttggtcttgcctcgcttgagcgtactatcgcgcgtcaacgttcacgtttggtctggcttaaggagggtgacgccaataccaagttcttccacctgcacgccagagctcgtaggcggaagaacttcatcacgcgccttcgtgatggtgaccagcttgtcgtctcccatgatgcgctgcaagagcttgcctcctctcacttttgcgccatcttggggacgagcttcgagcgtgaactcgccctagacctccactctcttggcctccgccctgcgcagcttgaggggctggactgtcccttcacagaggatgaggtctgggcggtgatcaagtccttgccctctgataaggcgcccagtcctgacggttttacgggccgtttctacaagtcttgctggccggtgatcaaggtcgaaattctggcggcccttaactccttgttcctgaccaacggccaaggttttgcttccctcaacgacgccctaatctccctcttgccgaagaaggacgaggctgttgatgttaaggatttcaggccgattagcattattcacagctttgggaagctgttctccaagatcttggcctctcgtctctcccctcgcctggacgagcttgtggcgcctaaccagagcgctttcatcaagggccgctctctc

SEQ ID NO: 87889 - DNA, 706 bp, Oryza sativa
ggccaccggggaagccatcaagcactccctcggacagagccaccctgtatgtacatacatacatacatacatcttcttcattagataattaattcagtctgtttcatatatgtcaaaaaatcagtcaacgtagtggttggagcgtcgtagtagtagcaatcaacgcttacgatttctggaatggcgtcacatgatgtgaatttgtcgcaaaaccactactacactagtagttgatgatctgacacgttcgtctgcacgcaggttaggctggtgccatacaacccggagtacctggacgagtcggtgctgtggacggagagcaaggacgtcggccatggcttccgctgcgtccgcatggtgaacaacatctacctcaactttgacgccttccatggcgacaaggaccacggcggcgtccacgacggcaccaccgtcgtgctctgggagtggtgtaagggcgacaaccagcgctggaagatcctcccctggtgtaagtaattatcaccgatatatagcttaattagtcagaatctttcaactgacattgtttggttttgttccttctgacgcagaaatgaaaagccggtcaccaaaagcatggatggatcggtccctggggctggaattgggcatggttcgagtccgcccaggcaggcaggtggtgttactggtgcgtgtcctgtgtttatgtcactgcagaataaat

SEQ ID NO: 87890 - DNA, 1270 bp, Oryza sativa
agcagaacaccggccttgtgccataacatctcgactacgggcccgcaagcttggtgtatccttcatttgccctgaaaaaatgtcaatcgaccccggacttcatccatctccaatccgtgtacttttgtttatgactagactgagccacaaactaagccttacccactaaacatgtgaaagtacggtagtgctttgcaacagaggcctgaagaccggtctttatatggcagaggtgctactatcaaaaccatgcaccccgagcccagcctaaaaccacttttggggattttgaatagagggggcggtgtgaatccaattccacaatactccaacaattccacagtgtccaggtgatatgaatattcccaaggtctagagttgtaaacccacctaatgttacctaattaaatagcgaagcatctacctaaaatcatactagtggtaccatgagtagagtgtccactagttggggttttgttggttctagggtgaacaaggtaataatacaataccaataataaggtcgtaacaaaggtaaataggcatggctaaataaaacagtgataacgcgggaatttaaataaagcgataatgcaataagttaaatcaacataattttacaaactgggattcaatatgttcaaagatgatgtgacttgccttgctcgctttcccaaacaccggcttcaacttccacgaaaagcggatcttccgaagctgcagcgtctacacgaccaacgaaaaacaaaaggcttttcctctcctaaactccatataacaagcagaaccaaagcacaaaaatgggttcttgacttcataaggaaaaattagagacttgaacggtccaattccgagttcaaatggccaagttatgaccatttgaagtttatatgctctttaaatgaatatttgcgaatttcttcatttaaattttaatttaaaatcggatttattgcgtcagccgaggggaggggcgcgcggaccgggtccacgggagtggggcccacgcggcagcctcacggtccacggtggaccgggcgcacgcggcttgcgctggccggcgccgtgggtcccacgcgtcagccgcaccgagggcgctggcggctgacggccgggccccacctggcagccgcggggcgcgcccgaaggcggtctctccggtacggtcgacgggaggcggcgcgcccgcgcccctatggtcgccggcggcggccataagcaccgcggagcggcggcccaaagaggggagggaagggggaaacgaaatggc

SEQ ID NO: 87891 - DNA, 5085 bp, Oryza sativa
  unsure (1)..(5085): unsure at all n locations
atttgagccatagcactaatggcggcagttaactagaacaccctctaaagtttggttaaaagactaacttataaaacttgtagtctttataaacaccgccagcctcctgcaatagtttcggctgctgtgtgtctttggaaggtaaatatcccactgtttggactttggctatggattaagcttactttggttcaaccaaaaaacaatccctaccaagaggtagaaagaaatatttgaactataacacattgaatatattgttgacaaaaaaaatcaatatattgcttagttccaatgatagtcatgttgggttacatgctagttccaatgatagtcatgttgggttacatgccaagaataaagctaataaacttctagaaagtcaacatgaaacttttctttgcaacctgctcaacaagacttggtatgataacaaacaacacaatgcacacatattcctattaaaatgtgagtatcattaacagaactccaaagaagtaccttcccactttcgcttgcaccataggtcaactgggtagtttgcccatcagagaaccccactgtatgcaactcatcatcccgcacatacgcaatcatgctcccatctggagacagatgtgggtcaatgatgggggatgtggctgaactttgcagcttgagtacaggttcagcaccagacaaatcctggaagtaaacctatggaaatagaaaagatatatttccatgaaactcatgatatttagcatccttgaaaatttacaaaggttatctgaaacatcaaaaactaccagaaaaagaatatccatgatacgctgacaacacaaaactaaccatagatgacaataatcaacacaacagaggagttttatttctttgaatcagtagcgagatcactatttaggaacatgtcagctacctaatccaccaatacaagatgcagcactataccaagaatgcaggaagtgcgatctcaagcacagacctgcaggcactgataaactcaacttcatagccatcactaacgactacagagcaaatatggctcatcccgcgacatccaaaccagaaccataataatggtcacccaacactgccccacaaaaccaataccagccttccattaattcaacactcgaaacggaaattaatgagcctaagcctatccatgtgcagttgctgatagcaaaatcagaatgtcaacctcataccaaatccttaatccgagaaagtggtccaatacacaaggataaaagtataaaactaccgaatttgattagggcaatgcgtatcatctaatactaagttactaactcaactgaattggtaataatataaatcaaggaagaactaaatgggggaaagggtttgcggtttgagagatacgaaccccagaggggagcggcacgacaatgccggcgcgggaggcgggggtgccggggaggcgggcgcgccactcgtagcgcgtgacgccgaggccgcgctcccgtgcgcgctcgcggcggaggcgctcctcggcggagaggttcccctcctcgaggccgccgccgtcggggggcccgaagaggagctcctggcgccgctgcgcggggtcgaaggcgtacacattccggtgaagcgtgccgtcggggctgtacaggaaggccacccggcggtcgtcggggctgaagctaagcgccacgggcgccccgtagcccgggagcgggtgctgcacgatgtccaggagctcctcgttaggggaggnggagaaaccccccgcccccgccgccgcgccgtccccgtccccgctgctgccggcgccgacgaaggcgtcggcgagcggcatccgggcgagctcctcctcctcctcctcccccgcgtcgaaccgcggcttcttgcggctgttcccctgatccgacgacgacctcaccgcccccgccgcctcgcccgatcgcatcgaccgaccgccacaggcagccgccgctaccccgcaagatcgccgccccaagaaaacctcccccctccctccccaacccgcgatcctccacacccaacaacaaaggcggaggagaaggtatggtgccctttgaaggcagacgaggatctcaaatccgaggcggagatcggagtggaggaggagagagagagagagagagagagaggatcggaggagaggtggagggcgacttggagttggtcgttcgttccaagaaggggaggagagagagagagaggcggcgctaattgtaagtaagtttgttgagaggagggaggcctttgggatgtctcggtttttcgttggattggatcatggatggaagagggcggtgtgaggagggtggtgagtgagtgtggttgctttgcttgactgggtctggtctttcttgccctttgcctctctccaattctatcctaggcttccatcggttgccattttgcttaaaatggcttatttggtttattagaaaattaaagttaatttataagtaaaacttttgtagatttgttcgtagcgacttaaaagccaacattaacaaaaattacgttaaaagcatttcaaaatcaacttcaaaatcaagttcaaaaattcaaattttagcttattctttggctgtttaggccaaacgatggggctgctatactctcttttttttgttgttgttgttggataagaggaatttgtaatggttagttgtcttgaaattaactgttctgtagatataaaatatcatactttccaatgattggatctttcttgtctcgagatgaatttgaccaaattatcttccatgtgcttctttttcgtctttaacatcctaaatagtctacctgtcttgtgttaattttggtaccatccttattccaagcacagttatttgttatgtgttttttaataacgttgatataaaccttagcttgtgtccatagttctacatattgagttttttttaaaaaaaattggttaaaagttctctaaaaattaagttatatattattaattatggactaaaattctgcaaagacacttggcacgtgtatgccaccttagtaaacatggataaggaggaatgattgcacatgcaaggacatatgtatgagagatggaactaccggtgtgtagtaatgcactaatgcgccagtatcaatagaaattaaataattccggcaatcctagaataccaaggtctggctgatgattttctcgattgacttgagccaagagcatccagacttcttcacctggcatcgggagagccctggatgctactcgatgtgatctgcttacaatgcgatgttctttgagagtgtcaacttcccaacattcctaatttgggagagaaaagcccctagcgttgctagtactttgcatggttagttgctaactgacgatgttggatgaccgattggctgagtaagcgaggtttgcctcacccagccttaagtgtgctttatgatcaacaggaagaaacaattgatcacatcgaaacatgtatctcatcaattttggcagctgatcctgatcgccatcgggcatccatgcttctttgcaaaaaaaaaaactttcttcctctcatggtggtgtgagtgcaagaagaaagtaagcgggtagcttcaccgaggattcgacaccatcgtcactttagccacctggttgatttagaaggaaaggaacaatcgagtgtttaaccaatggcaacagacctagaccgaagtgacacgtgatgcggaaaaagatgtgctttggtgtgaagttgggctgctaaagtagcatcacaatatagtatcttggtcgcacaatggatgtcatgatagataatcttgtttacactttgtgtttatgtttgtttttctttttcacttgttggctgggttagcaagatgcacattaccctcttcttaatacaaaataaacacacatcttatgcatattctgcccccaaaaacaaataatttttgtctagaagcactgtagtttgttataaatttacaacaactttcaagcggactaatacttgtctcatgggcgggggtgctagcccttgctagatagatccggtagccttttcaaaattaaacctataaatgggagacctatcatgcacatgtgaggactaaaatagtaaagaaaaaaaaccctatgtcgattttgtttctaatttcgaataattctaatacgaatagtatacggaacgaaaatggtggtatgcacattgaggaaattcctatatttcttcctcacgcaacactccatcagcaacttaggtcttgtttgaggagcttctagtaacttctcttagaatctaaagttttccaaatactgcagattcttacctagcaatggtggattaggctcatcataaaagcccataaagcaattgaaccagcccaacaattgcatgttactgtgctacatgcacccagccatcccacacgtgcaatccccacctccgctccacccgagcctcgtattggtagttcagtggcattgtcttagcatctctcacccaagcgtgccgtgcgccaagccaaatctcgcctcccccctcctcctcctcgcccttgccctgttcgtcatcccactctccgctcccctctactgctgctccatggcccattcctcttcgcaaccattgtccctgtccccgtccacggtggtcgcacgcacgccactcgtcccggttctcttcgtgatcggcgactccacggctgatgtcggcaccaaaaactacctcggataactcacccgcgccgaccgcgagttgtacggccttgagttcgacactcgccacaacacggggcgcttctccaacagtcacatccccatcgactacatcggtatgtatctatgtatgtgtcgtccccttctcggcactatggctagctcgaggacatcctagctggtctaccgagcataaggcaaactggcgcgtgctaaccatgacagggtcccgatcatgaatttgttggcgacttcgatagggaatgatcactcttgcaatagctgaaaccccacttctccaacatgggctctcgcaccaatcttgatcaagacaacatcatgaccgcgatattatggagagttgttgaaaactgatcgccaggtgtttg

SEQ ID NO: 87892 - DNA, 6495 bp, Oryza sativa
caggaaaaagaaaaacgatgatgacgtcatgatgacctcatcaatggccggaccaagatggcgacctcgccggagattggatggtcggctgcgactttggaggacatgaacacgtagaggacgacgagacgaacccaacggtactcaccctcgtgccaaacgacgaccgacgacggccggcgacgaggaggcgacggcggcggctcgggttgcacggggcggcggagctccgatgaccggcgacggaaaaggaagggtggccgagcttcccctcaccacggcgcacccaacggtggtgacggagaccggcgacgacgatggagacggcggcgcggcggcaccggagatggccggcggcggcggtttgcttggcggcggtggcgacggagctacggagcacggaagaggacgggagagggggcaaacgaaagaggaggactagggggtcctatttatagccttggattgaagagatcggactcctcccgtaagaaatcgatccgggaaatcaaaaactcggttttggagataaactcaaaaacgagtttgattcggataaaatactcaacggtttgctccgattcttgggggtaaagatagaggaggataagaggaatatttcccctcaactaaattggaaaaaggagcaacggggaggcgagatttggaaggaggaggcggcggctgcacagggcacagcacgggcggctcgggctctgcctgagctggaagatgaacagtagcgcagggagggaaaatagacttttccggctaggctgagaggagaggaggcggctcaggttgggccggcagaagagagaggaaggaaaggaaggaatgggctgaaaatggcccaagctgaggaggaggattttattactttcccaattaaaataatcacttaaatgatctttgaattattaaaaatacttccaatgctcaaataatttcaagaaaaatcctgaaaatatttggacactcaaagtacttaaaaaaattacaattagaccatttaatgattaatttaatatgtgggtaattactgaaatgctctttgtataattaaaaattaggaattgagctccgaaaaatctgagaaaattccagagagtataattaaccatgaagaatttaataaaaattaaatccatccatgctttatatttaggaaattttatttcccacatttaacttcacttgtaaattaatgaacatttaatataaattctaataatagtttattaaataatttataaatcctgaaacaaaaatcagggtgtgacacgcttacagtacgaggcctatgccgaggacctggcgaagagggttaaggacgcccgcggtgtcctcgatgcggctgccgcccaagagcggcgggtatcggaagccaacacctcgctgcaggctcggacggtggcgttcgagtctgagcgcaaggccttagataagcgtgcccgctccgcgcaggagtttgaggccacgattcgtcggcgaatcgaggtcctcgatcggaaccagcgcgagcaggacgcgcgcagccaggagcaagcgcagcgagcccaggagctggagtggcgggctcaggcgttgaaggagcgagcgcgcctgctagaccagcgggagttcaccttggccggccgcgtggaggagctacggctccgggaagcggcatgccgggaacgggacgccgcactcgccaagcgcgaagccgaggtgaaccgccgtgtggtggcctcgcgccggctgggcgagcagctcgcgaaacgtgaggaggccgtcgctgggcgcgaggcttggcatctggagagtgctcgcgccgagcgtgcggtgatggcggcgagggcttctgagctggaggcccgggagaaggacctggcggcgggcgggcagcccggcggcgcggagttggtgagccagcttaccacggctcagagcactcttgccgacctagagcgcttggtgcaagaccaggctggggagatcgcggccctccgccttaccaatgagatcggacccgggcagctctccgatgccgtcgatcggctggagcgcgcggggcgcccagtcggcatctccgtgcgccgggatagtaagctcccgcccacacaaccggcggatctggagaggctggaggaggaggtcggcgagaccgtaaaatcgtcatcggcttccttggcgcgagccgcggtggaactggtccttgcgagccaccaagcccgcgaccccgacttcgtcccatggcgcgcactcgaggatttccccccggggaccgaggcaaaggctcgggagcaagtccgggaggcggccgacgcgatcgtctctaacttcgaagggtcggcccctcggttcacctttgggattgcctcggacgaggagagcgggagcggggacgacggtgacgacgtcggcggcaaggactgggacgacgtcgttagcggcgccggcctcgggggcccgggcactccgtgattatccccacttttaatttctttttgttgggtgcctgcagcggacacttcttgtctttaggccatcgtgccgtcttgtctgtaaataaagcttccccttcgcactttctacccctttgctttctcctttgaacgcctgcggcacggaaagaagaaagaacaagagcaaaagtatataattaacctccctgtgatcgaaatgccatttttaccccatccccccctcgggctcattcttgcgaaaaggtaaatccgcgctcagtccgtggtacctaagtggtgaggagcaagaccgtcgatccgagggagccgcccagcgggactggccagactgaggctacgacgaccgagggtcggggatggccgtgtgtaggcccttccgagcccccggggttcggcgcaacccggggcgcggcccgcgtttaggctccctttcggcggtttttaggtcgcccaacgccacttagggttcggagtgtgaattgtcctttgaaccaggacaagccagaggaaagagtgagaaaaagggggcgtaacggcctccactttattgcttggaaagggaaaaagatacaaagcaattcacagtagtagcccccggccaagcccgcacaagccgaggggttgtgcgggggttggcccgagctcctagaaagcaaaatatcgcgacgctatggatagaagcgacggagatgttcgatattccaggggttaggcaactccgtgccgtcctccgtggttagtcaaacagagccttgccggggaacaccgatcactttgtatggcccttcctacattggcgagagcttgcttagccccagacgcgactacacgtggtgtaggatgaggtcgccaacttgcagtgaccgggcccggacgtggcgctgatggtagcgccgcaggctttgttggtagcgcgccgcacgtagggccgcgcgccttctccgctcttcaagatagtcgaggtcgtcgcggcgaagatcatcctggttggcctcatcgtacagcgcaacgcgaggtgatcccagggaaagctccgaaggcaggaccgcctcggcgccatacactaggaaaaagggcgtttcccccgtggcgcgacttggagtggtccgatttgcccacaacacggcgggcaactcctcgagccacgaatccccgtgtttcttcaggacgttgtacgtcttagtcttgaggcctttgaggatttcggcgttggctcgcttgacttggccgttgctcttggggtgggcgggcgaggcaaagcacaatttgatgcccatgttgtcgcaatagtcgccgaacagctcactagtgaactgggtgccgttatctgtaatgatacggttgggcactctgaatcgagacgtgatgcccctgatgaacttgagggcggaatgcttgtcgatcttgacgaccgggtaagcttcgggccacttggtgaacttgtcgatggcaacgtacaggtgctgatacccgcctcgagccgctttgaatggtccaaggatgtctagcccccagaccgcgaaaggccaagagagtgggatgacctgcaaggcttgggctggctggtgggcttgcttggcgtggaactggcacgccttgcaccgccggacccattcttgggcatcttgcaacgcagtcggccagtaaaaaccttgtcggaaggctttaccgaccaaagtgcgtgaggccgaatgggccccatactcaccctgatgggtgtcggctatgagcttgatgccttgctcccgagaaacacacttcaagagtatcccgttggcggcacaccggtagagggtcccttctacgagcacgtaccgcttggagatgcgcgcgagcttctcagcttctgcgcgatcctcaggaagagtatttttgtcgagatacgcccggatgtcagtcatccaaacgacctgacgaggggggtcggggccgaccctctcgggccccgaggcccgcaggtcgccaagggtcggggtggagggcgtggtgtcggggtccctcggggggttcggtcgcgccgacggctgcgcgagtttttcctcgaaggtccccagggggagtggggcttgtgccgacacgacacgcgacaactcatcagcgactgtgttgtcgcgtcggggcacgtgacggagcttgagtccgtcaaagtggcgttctatgcgccgcacttcgcggacatatgcgtccatttgtgggtcggtgcactggtactctttggatacttgattcacgaccagctgggagtcgcctaggaccaggagacggcggatgcccattccggccgccgccctcaaccccgcgaggagtccttcgtattccgccatgttgttcgtggcttggaagtcgagccgaatgacgtatttgaggacgtcccctcttgacgaagtcagcgtgactccggcacctgcaccttgaaggttgagggagccgtcgaaatgcataacctagtgcccaccacgaatgtcggcgttcgggtcctctccatctccggggagggagggaacgttggacggaacagggtcgtccactagggtccactccacgatgaagtcagccagaacctggcttttgatcgcgtgccgtggttcgaagtgcaggtcgaactcagcaagctcgagggcccactttacgacccgaccggtgccctctcggttgtgcaagatttggccgagagggtaggatgtcactacggaaacccgatgcgcttggaagtagtggcggaattttcttgaggccattaagattgcataaagcatcttttgggcctgtgggtatcgggtcttcgcgtctcggagtgcctcgctgacaaagtagacgggtcgctgcaccttttggtggggccggtccgtgctgtcaggggcagatgatctggggcgcccttgcccgagggcccttggggggtctcgagtcatgtcaggaccataggccttgggattactcgccaaagcctcccctcctcccacggggtcctcgggggtcctcccgggggttgggggcttcgggcaccaggccttcaggggacgaagggccatcgcgagtcaagggggcctccggtccgctctcttcgcgcttgactactagggcggcactcatcgcatggggggtcgcggccaagtagagcagcaacggttcctctggccccagggctaccaagatggggggaggtgaggtaagcttttagctgattgagagcttgctcagcttccttcgtccacataaatggtctggagtgcttgaggagcttgaatagggacagcaccctctctcccagcctcgatataaatcgacttagggcggccatacatccagtgacgtactgcacatccctaagcttgctgggggggcacatcctctctattgcacgtattttctcgggattagcttctatgcctcgggaggagactagaaaaccgaggagtttgcccgccggcacaccaaacacacacttgtcggggttcagtttcacgcgtgtggacctaagactgtcgaaagctcggccaaatcctgcaacaacgtgtcctggtggcgcgtctttaccaccaggtcatcgacatactcctctatattgcgccttatctgattactcaaagtaatacgagtcatacgctgaaaagtagggcctgcattctttaacccaaaaggcatagttgtataacaaaagctgcccacgggagtaatgacggcagttttttcctcatcttccctagccaggcggatctggtgatacccagatgtcacgaccggaaataacccaacgggcattccttacgtgcgtgcattaatccttgtcccaggaggcaaggtacaccaaaagttgatacaattcagagtttaacaagcggaagcgtaattagataacttattacatgggcagcgaaagcccagcacacacaaagacaaacgagaaacagcggaagactagggcgacgaccacaggcacttgacggcaggcacgagctagacaccgaagccttcatcctcctggaactcctcttctggggttgggaaaaattgagcaagactg

SEQ ID NO: 87893 - DNA, 1541 bp, Oryza sativa
aaataattctgattctccacgattcccctccgaatatttttgggtggaaaagcaaacaagacagcacaaaagttcaatggcataattaatttaatcaattatcgaacatactaattcattgcacatggtcgcacgccatacgcctgtttgcagctgcatggttgcaattatttggcctctagctgtttgcatctttcctcccagatcaagcagtgattattgttgtgtaaattacacaacaagctcaaaccaaagcctaatcatcagtccatcacaaatcatcagttaaatatcgaacaagcatagccattcaatcatagtaaacaagagttgacaatccttgtcctagttaaaggcttgaggcactctcccacacacgagcaggattccagcaggaaagtaacaaataatacatgaggatggcgatagcaatataagtaaacaaagggtaagcaaagacccgacgaaaggacacaagaaaatggtccttgtacaagcatcataactacccccagcggttaagagacagacgactgtcactaggatctttagctagtgctcatcctcaggcttggttgcatccctcatttcatcacctccatcgtcctgtacatatagaacagttagcaccagtggcaatagtatggcaagtgttgtgttcataagttttttgcattttcgactagcatatacaccgatctacctgcatatcagaagtccacaaagtgagattgtcgcgaagaagctgcatgatcagggtgctgtccttgtaggattcttccccaagggtatccagttccgaaatagcttcatcgaaggcctacataaaccagaaagtatgatcacatagtgaatgagtgaaatacaacatgagctgcctattatcagtaatttagtttttctgttgtacccaaaaaagtttcacagaaatgtatgaccttggacaactagacttctgaaggcaggaattcaaagcaataataccactagaagatacaatgttgtacatcaatacatgcatatcatcaacagcatgggactatgtcccttatagaattgactccaaaagaacacttgaggagcataagctcattgcaacaaacatatacagctacataattattggcattcatgagcaaacaagtttgtcaggccagacagatgagcggtatggtacacttcttttgttaactaagcaacccatgccatgacttaagcctgcacatagcaagcaggcatatgggccaccactctgcaagataacagcggtcacatcttggatgcatgcggcaatttgagccggcatggatcacagattctcacagctaatacaggatgccaacttgccaagcaaccatgaccagatatccaaagcagctaaagcactacggaatgcaactgtaactgaagaatttcacactctctgaacactgtaggctcagtgaggcatgaatcatacggaagcaagcattacaagtctacaagatctaccttggcatgaaaaaaactctaaatattggaggaccaattggacaaagaaa

SEQ ID NO: 87894 - DNA, 755 bp, Oryza sativa
ccaccactctgcaagataacagcggtcacatcttggatgcatgcggcaatttgagccggcatggatcacagattctcacagctaatacaggatgccaacttgccaagcaaccatgaccagatatccaaagcagctaaagcactacggaatgcaactgtaactgaagaatttcacactctctgaacactgtaggctcagtgaggcatgaatcatacggaagcaagcattacaagtctacaagatctaccttggcatgaaaaaaactctaaatattggaggaccaattggacaaagaaactaataaatcagctggaaccttaccattggcaagcaacaaattgtagatctacacactgttctttgaactgactaactcggaaggtaagcaaatcacctgcttggcgagcgtgcacgcgcggtcgggcgagttgaggatctcgtagtagaacacggagaagttgagcgcaaggcccagtctgatggggtgcgtcggcgacagctccttcatggctatgtcctagagaaaggaaaatccccaagatccaaaattatttttagtcaaattggtcggataggtcagcaagaaaagatgggagatgttcgtggaggaagagtaggggtacctgcgcggcctggtaggcggcgagggtggcgtcggcggcgtccttgcgctcggctccggtcttgaactcggcgaggtagcggtggtagtcgcccttcatcttgaggtagaagaccttggcgtcgacggcggc

SEQ ID NO: 87895 - DNA, 1226 bp, Oryza sativa
ctcctctgtgtttttaagcaaggcctttgagttctccatttcagttcttgcattagtcaactcagattgcgctaatgaaagtttcgcttttgcatctctggcatcagttgtctgttccttcaaagctattgccaaatcatccatggccttcttgcacttctcctcagcttcgacagccaacttgagttcacgctgtaatgaccacgtctctacctcaccaggatcagcaaaggagaaagacattattccccttctcctgagattcctagccggttggctaggattagaagacagtgcactgaaggcttccgagctctttttattatctttgagggaagcaatctcaagcttggcctcctccagagataccttggtttgttcaagctgcttcgtttgggcccccaatgacactagcagtttcttctctgaatcccttgctgcctcctgttcaccttctaactgctctaatctgtgcacaaggtccaacttatcatcacctccattgcttgtcaccttattctcattctttttcttcttgagccctgctatctcatccagagcacgcgccttctcctttttctcattcttcagctcttcctgcagcttgttcaatttctcctgcatctctgatgcctcggtgattgaattggaggctttgtcaccattggaagttgatctgacgctgtcaacaaaaacattgttcatgttgattcatggattggtggaaatcatcaaaacagtaaatctaaaaacaaggaattaaacagaaattccactcaatgaaaaccgagatgtcaaaaactcacaaaatgattccagaacttgaaaaagaaaagttgggaatagacaattactctacctggacctgaaggagaacatcttgtccattcaagaaccctgcagccagcccagaattagccgaccatgccacctgcgttcctccaaagtcgtatactatgaaacccaaaattctatcagtaagatagagaaacagagaatacggtgttactctgaaatggtggtgtccgcataccggaggctacggttgctcctgggtatagaagtagagatcataccgcgtctttcgcgttgccagaggaaggagaagatgaaaaggcttattgaagaaggcaaggaattgaaaccgtccaaacctcgagagccgccttgaagggtaagcagaaaagcacagaagcggtccaagtttgttttcttcagaattttag

SEQ ID NO: 87896 - DNA, 623 bp, Oryza sativa
cccatcacaatttcggaaatctatcatttctcaagtgcaagcacattaaatcacctggttcaaccttcacttcttacctatctttacaaccagcaattctatactttttagtcatcttttcaacatagtacttagttgtctcatgtattttcaaaataatttcagcacgtgccttagcatcattatgaaccctctcactagtaggtaaagacaaaatatcaataggagcacgagggttgaaaccatacactacctgaaatggacttatgttggtagtataatgtgttgcccgattgtatgcaaactccacataaggcaaacattcttcccacatcttcaattttttcttcaaaatagccctcaacatggtacccaaagtacggttgactacctccgtttgtccatctatttgtgggtgacatgttgtagaaaacaatagttttgtacccaacttgttccatagtgtgcgccaaaaatttcttaagaattttgcatcgcgatctgaaacaatagtagagggcataccatgcaagcaaacaatctcatggaaaaacagatcagcaatatgaacagcatcatcacttttatgatatggtatgaaatgtgtcatcttaaaaaaaaga

SEQ ID NO: 87897 - DNA, 2741 bp, Oryza sativa
  unsure (1)..(2741): unsure at all n locations
ctgtgtttagtttcacgctaaaattggaagtttaagaaattgaaacaatgtgacggaaaagttgaaagtttgaagaaaaaaattggaatctaaacagggcccatgtctcttaaatattctatccaacctcaaaactccaatctttagctattcaagagaattcgctgtcattgtttcagtcttacaagcttcaagtgcagacccaacatttttcaacagcaagtgaaaatccaatggtaaaataccacagggtctctctcagttcattggatttcccatctgtaatgtgccacaaactgcaccctattcgatgattatatatatagatgaaatcaccgatggacttatcatcacgaagcaattgaatcagaatatcagatacttctttaatgactccatctgatattctgatcaaagaaaaaaaattcagagcattgtaggtcaggccgagtttagatacaaagtttttcttcaaactttcaacttttcaatcacatcattccaatttcaaccaaacctccaattttagcgtgaactaaacacaccctcagcatggagctatggcagtctggcctttcatctaataggtcatgacaggcctactgtaataagctaagcacatatacagagatatctttaaataccgatacactggagtcacaatgtagtatagcagaaatgttgagccatcggttaatcactacttagaaaaaggcttttcccagatggccaaatcatattttcgcaggcggacaagccatccgcctgcacctcaacgtctgcgaaaatagttgattttcacaggcgggcaacagatccacctgcgaaaatatcttccagcactaaaaaaaagacagccaccgccatttccggcggtagcttcccgttcccaatccattccccatccaatccccatctaatccattcaattcatctagttcatccaaaaatcaccaaatcaattcatccggatcatccaaaatcaccgaatcaattctagcaaagaaagcaaataaaaacattcaaaaaatcacggccgccgcctagccgtcgtccgccgtcgcacagccgtcgctcatcgccgctatggcacgtccgcgccacgccgtcgtccgcggcccgccgtcgtccgcgccgccgctgcacggacgcggcccacccccctccggccagatctgagagggaggggcgggcaggagccgccgccgccgcctcaacaccccacgccgccttgaccctcctcgccgccactgcccaccgccgtgctccccccgccccctccggccagatctaggagggaggggccaggagccgccgaccaccgctctccccccgcccctgccggccagatctgggagggaggggccaggagccacgtcgcctggaccctcctcgccgctgccgccctcctccgccgccgggagcacacgccgccaccgccccgcgcccgatgccgcgcccggccgccggtccgcgcttcaccaccggccgctggcctcccctgtaacgccccgattttcgttcgggtttaaaaatcattaataatacattttctagaaattaaataaaagttaaatcaatttaatcaagtgaaataatgggagaattaaaattttcccttaaaaatcattggccgggaatattttgtaatattctttgtgccctaatgtactctccggaattttccgtgaattttcggagctcgagaaatagttttaaagtcacaaagttcattttatcaattaaaataaaaagaaaagcaataaaatttcctcctctttgtttttaggccgcccggcccaatccccctcctcctctccttggcccgctcgcccctctctccttccccccctctctcgggccggctcccctctcacttggcccgctcgcaaaagtctgttttgcatccctccttctctcccttcgccgacaggtgggaccggcggtcccacccgtcagctcctcctcctacctctcgccggccaaccccaaccgccattgccgtccacgtcgccgcaaaatacggcgccctcccgcacccgggctcgcatccaacgacgtgggcacgatcccctccacgtcctccaccatctcccccactttcccccaaaaaaacggcgccggtttgacctccccacgagctccacgtcgcctcccacttcgacgccggttgccgcccatcccggcctgagccactccctcccgagcctataaaaatactcccccggccatcctctcccttttccccaactttcccgcactccccgcgctctctcccgctctcccctcgttgctcccgtgctctgccgctttccggcgagctccggctgcacgccgccgtcgctgtagccgccgccgcgccgcaccgtttgcaccgtcggctccgccgctctttgccgcacaccggccaccgctccggtttcacaaaactccgcgcaaacaccacattcaccgtgcacccgagccacagctgcctctcgtcacctccagtcgcgcgccaccaccgntcccgtcgctgccgcgctgcgctaccaccgncatcggcatcgncgttccttcgncgcacccccggcccctactccgtttcccctccctgcccctggaacgccgccgccgcgttcaccatctctctccgccggccaccgccgagtctagccgtgtcgctccgcctctccggtcgacgccgacttgtgccgccacctcctccggcttagtcatctagagggccccgccggccctcg

SEQ ID NO: 87898 - DNA, 2024 bp, Oryza sativa
tgactttcccttctgcctcatttaaaacttctgtaccaaacaattggcgttcccctgtctgatcccagaagagcggagtacgacaccttcgtccatacagtgcttcaaacggtgccatctgcagactagcttggtaactgttgttgtaagagaactcagcatacggcaagcttttgtcccatgctccaccaaagtcaagcgcacaggctctcaacatatcctctagtatttgattgactcgctcggtctggccatttgtttgtggatggtaagcagtgctgaaattcaaccgggttcccaattcttcttgtaatttctgctagaactttgaagtgaattggcttcctcgatcagacacgatcttcttaggtacaccatgtaaacacataattcttgccagatagagttctgctaatttcttccctgagtaggtagtgtgcaccggaatgaagtgagccactttggtgagtcggccaacgactacccaaatagaatcatgccccgatgatgtcctgggcaaaccggtgatgaaatccattccgatttcttcccacttctattctggaatctaaagtggctgtagcaaacctgctggcctttggtgttctgcctttactcgttgacagacgtcacatagtgctacgaattcagctatttcccttctcatgctgacccaccagaaattttctttgaggtcttggtacatcttggtactgccgagatgaatggaatattgagtttgatgagcctcggttagtatcaggtcttttaattccttgttttcgggtatacacaatctttctcccatccagattgttccttgttcgtcctcaacaaaacctcgggcttttccaaccctcatgttctttttgagctccgctatttcaggatcacttgcttgagctatgcgaacctgctccaccagtgtgggctgtgcctctaggacagccacgaatccgtgctcaactataccaaggttcaaatgttcaaaatcacgttgaacctcacagcatagttcctctacccatgcgacgttgcagtgactcttcctgctcaaggcgtctgcaaccacattagccttgccgggatgatagtgtattcccatatcataatctttgattagctccaaccatcttcgttgtcggagattcagatcaggttgggtgaagatgtactttagacttttgtgatctgtatatacctcacaacggttaccgatgagatagtgccgccaaatctttaaagcatgaacgactgcggccaattccagatcgtgcgtcgggtagttgccttcatgaggacgcaactgccgtgaagcataagaaaccactttgccatcctgcatcaacacacatcctagcccctggcgagatgcatcacaatagacctagaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttgtctagaaattccataaacaccttggtcatcaaattcatgaagaaggcaggtgcattagtgagtccgaaagacataactgtgcattcgaacaacccgtaccgagtgatgaatgctgtctttggaatatcctcttcgcggatcctcaactggtgatagcctgatcgcaggtctatcttagagaac

SEQ ID NO: 87899 - DNA, 868 bp, Oryza sativa
ttccactaaaaatcctgttaatatattgtgacatgtggaacccaagaaaaaatcccacaaatgcaatttccaattattaattgcatttattaattatggaattagctctaggttaattaagataatttcttcggacaatttatttagccaatttttaaagctaggagagggggaaacttcaaggcgtgacaaacctaccccccttaaacggaatctcgaccccgagattcggaagagctggcgaagaggtgcgggtgggtggccttcaactcatcttctctttcccaagtggcctcttcctctgagtggtggctccactgaactttgcagaatcttattactttgtttctggtccttctctcgctggtttcgtggatacgagtcggcttctccacatacgtcagatcttcctgaatttcgatgtgatccggacttgcctgttccttaggaactctcaaacatttcttcaactgagagacgtggaacacgttgtggatgccaagcatgttggagggaagctcgagctggtaagcaacttcacctctacgttccaagatcctgtatggtcccacaaagcgtggtgccaactttcctttggtttggaagcggtgtactcccctgagcggagtgacacggagatacacataatcccctacttcgaaagcgagctcccttcggtggttgtctgcatagcttttctgccgagattgcgcaattctcaatctttccctgacagctctgactttcccttctgcctcatttaaaacttctgtaccaaacaattggcgttcccctgtctgatcccagaagagcggagtacgacaccttcgtccatacagtgcttcaaacggtgccatctgcagactag

SEQ ID NO: 87900 - DNA, 841 bp, Oryza sativa
gttctatggtgaactcaatctctcggtctggtggcatactcgttaattcttctgggaatacgtcgggatattcacagactatgggcaccgactccaaggaggtgacttgtaaacaggttaggatagaccgacttgcggtaggggtgttaggggtaaagcggacttgctttcctccaggtccttgcaaggtgatggacttttcggcacaatttatctgtcctttgtgcttagccaaccaatccatccctaggatgatgtccaagctttgcgagtctaggactatcggtttggctaggaagtcaacttcctcaattctaaggttaacttccgggcatatttgagttgcccttatattcctcccaggggaatgtactatcattggtacacgtaaattttgggttttccaaccatttcttttcacaaaagcttgtgatatgaaagaatgggaagctcctgaatcaaacagaactatcgcgggttcggagttgacagagaacatacccatcacaacgtctggagcatcctgagcggtttcagcttgaatgtgattcacccggcctcgaccaaagttgttggaagcacgtgaaccttgtccacttgcctgagagctaggacgagacggagctgccgctggagtaggagttctggcagtgctgccattagcatgccctaagttggtgttggtaggattctgagggcactgtctggcatagtgacccatctggttgcaccggaaacactgaactgctgacggtccctatggtgacttgaaagaggtaacactgttgggcgcagtattgccactaggggcacgctgctgtggctgaggtgccggacggtt

SEQ ID NO: 87901 - DNA, 1183 bp, Oryza sativa
atgaatgctgtctttggaatatcctcttcgcggatcctcaactggtgatagcctgatcgcaggtctatcttagagaacacaatagctcctttcaactgatcaaacaggtcatcaatccttggcaaaggatacttgttcttgatggtgacctcattgagtgcgcggtagtcaacgcacatcctcttggttttgtctttcttctccacaaagataaccagagcaccccaaggtgacgtgctcgggcggatgtatcccaaggtaactgttcatcgacttgtttcttgacttccgccaactcgttggctcccattctgtaaggcctcttgtggatcggtgcagttccaggtaccaagtcaatccggaactcgatatccctttttggtggcattgttgtcagatcgtccggaaaaacctctcgatactctctgactatgggaatatcctccagcttcttagtggttttctccactgctacctcttgttcttcaccagcagcctggtttaaactaatccctggcttccgcggtactggagactggaaagttaccacctctccttttgcattggtcaacttgatggtgcggctggcgcaatcaatcactcctctgtgccttgtcaaccaatccattccaagtatgacatctaggtccttggattcgagaagaatgaggttggctggaaaaatcgacccttgaatttcaactgtcacagatgggcagtagtgagttgtggtcatgccacctccaggagtatgcactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacttctggtgctgactgcgcctcctctgcagatgcatgattaacacgggcctgaacgaacttgggtccagcacgtcttggcttcgggcactttccaaccgtgtgtccgggtttgttacaattgaagcagagttcgggtttttctcccaacctcttgggctgttctggcagagctggttgaactgattgagctggaatctttagtgaactcggagtagggttgagactgtgctgctcactgttgttgtgactgccactatggtggttctttgtgaagctacccgggtggta

SEQ ID NO: 87902 - DNA, 853 bp, Oryza sativa
ccccggggtagatgggccgagagggattcggcccatcgaccccgggggaggcaaaatagacttttgcggagggatttgatttggaaggatttggattcggaattgaactcgacgatatatcggggattgagatcttgagatggcacggacactagacgacaagcgaagaaacaaatttcgcaattagggtttttagagataattttcctgctaggcgccacgacggaacgggcgctacagacggttgcgcggttgagagctgcacgcactagccaccacaccatctcgttgcttctttaagttggtcgaacaaatcgtcaatccgtggcagcgggtacttgttctttatagttacttcattcagggctctatagtcgattaccattctctcagagccatcctttttcttaaccagaagcactagggctccccaaggggatgagctaggtcgcacataacccttactctccaattcttcgatttgtcttttaacttctgctaactcattagctgccattcggtagggtctttttgccattggtgcagtgcctggcgccagttctatggtgaactcaatctctcggtctggtggcatactcgttaattcttctgggaatacgtcgggatattcacagactatgggcaccgactccaaggaggtgacttgtaaacaggttaggatagaccgacttgcggtaggggtgttaggggtaaagcggacttgctttcctccaggtccttgcaaggtgatggacttttcggcacaatttatctgtcctttgtgcttagccaaccaatccatccctaggatgatgtccaagctttgcgagtctaggactatcggtttggctag

SEQ ID NO: 87903 - DNA, 594 bp, Oryza sativa
ctccggctttgtcatctcgagggccccgccggccctgggccgcgtctccgtcatggtcgggtgtcgccggaactgccgttcccgccgcctctcgtgccagtcgccgacatcctttccgccgccagccgactccctgtggtcgtatcgccgtcgccgtcctcggtgagaatccccaccgtcccttccccttttttccctcctccgccgctccccgtgcccgttgccgcgacgcgccgctgtcgccggcggtcgtctggccgcacgccgccgcgcgctatcgctttaccaggccggctgtgccgtgcccgtgccccagccgcgccgcctcgtggcggtccgatcggctttgggccgatccgggccgtcggttcccgtggaccggcggtggaccgcctcggtggtcccggtccacggtggaccggcgcccttgtgccgctgaccggtggggcccgcttgccggcgccgcccctcccccttgatgacgtcagcgaggtccattttctttgtaaaaataaataataattgcgcaataattcgataataattatagaaatccattaaaatggctcaaaacttctaaaattcatatctaat

SEQ ID NO: 87904 - DNA, 3863 bp, Oryza sativa
ttgcatgcctgcagtcgactctaagatccccttattaatacacaaaaggtacggaactacaaattgaggaaatgatcatactggaaattcaacaacttcgtttgcttcattagtctcattttcctattgagaaaatgccctttcctactggcgatagcatcacttgacctgcaaaatattggatggtaaaattagcattggagcatctactgcagagttaaaaccagggcacacgatttcaaacacctttaacactcaaaatgcaaattagactgtaccatggctattccattttggcataggttgcacagttatggtataaatgcaaggtagcaattaatttaataaccttgattggctgaaattcagagtggtctgcttcattgaggccgtccctcttcccctgccccttctggaagttccagttttggcaacatcggtagcatctttagagggtcttgtaaatccagatgctttccttccagcattagttgttcttgcaccgagaagcatctccctggtgtcttcatcatcactgaaagagttcaggttactttgagctgtaacagatctacctccagtatcctggtcaagtatcataagagcaacaaacaatcagcaacaatgaaaaaatggcatacaacattaagggcataaggacattgaaaccaccaagttttgagagcttgacgtgaaccgtgaatcttccttggagcggagggacctttccttcacacgttcctaagtagttaaaaatattaaccttttaatcaccccacaacctcataggaacaatagtagattgctccaaatacctgcatgcactcgccaactttgactattatatcttcttcctctattttaaatttatctgcctctgaattcaatttagtctgcaggtttcaacaaaggatttcaattttagatgcatgcaattttatcaggcagcaagcaatcaaataagaactaaaaaaggctacctctgtattctagtctcatttctattaatggaaatggagagctacggccctttgataaaaaaaaagaactaaaaccaacaatagaaaatgtagcaaagcatactctggtttcttcaagattccgctgcaaacaggcataaaacgccatcttgtcatccttgctcacaaaatcatgcaatgcaatgtccaagtcatcaactggaagaatctccattttctggaaacaagatttgtgtcatgaagcttatattgttactctaatatttttttttaaaaaaaagaaggatgtaagaagctatccaaagaatctatagaacaaaatcaggaattccagacccacaaacccaactaagacaattaaatagtccttgtttcacagtaccactgttagtctcaggctattattgtaaaaagctcatatggtgaagtgtaatgggaccagatagagatgtcgctcattaaattattggctgttattcaatagctaccataatgggcctcctagccagaagtacctttcttgccattatatttctgaaaatttaattatatttcagcctaatactgtaggagtcaagaataaacacattaccatccatttagtgcataaggcagtataggaaaaaggcaagatctttgttttacatttatgatcatcatatatacaactaaatggaatcccatcaagaaaaacagatagcagcaattatttctcctaggagaagagcaaaactgcaaaataatacagaatatgtagtttcaagaagtaccaagttattttcggcaaccaaagcttcaatagtttgttggtttagttcctcgggacgaagtttctcagagtcatcaatattgcctactgtatatatacatagacatagtcagttaaacaaaaaagtcagaataacatggcatctgttgctcctcatagcttgatgcattctgccactatgtaaataacttgtgcactgtctttcttaaacataaaggaatacctccagtagtctgacgcttttttgctgattttgagaagataagaatatcctgggggtttgcaaccttacaacaagaagctatcaaataagctcattcaggtaagaattctgagtaagaacctaattagggactcagataccttcccgacatacttctgaccaaatcgttgtggattaattgttgaaaacccagagtaatctacctacagaacaatatgagcactttcattgttcctgtcttgattaatttgtgcggagtacatctcttctgttttttttaccttgattctaattagtggaagtttggtctctggtctactggctgttggctgactactcttcttaataagatttcttacctgaaacaattgagtattatgagattgagggttaacgacttcattcaacaaagaaaactagactgacaacaaacgggcaaataagccaatgttgaaccaattccacaccagcatgccaccatgcttctcaataaaatggaaaagattataacaaatcatggaaaactgaaaactcacaattttatccaaatgttcaagaacagaggcctgatcattgggatcaacatccacttcatcttttaacacaacctatatattaggacagtgagacccaagcactgaaataagcatgaaatgaggggtatcatacctcagcatagtgaaagggcctaacggatctcaaaggtattttggttggcctatactggtttccctgtttaagaataaaaatggaatgagaaaacaccaaactgaagttttgttcaacatgaagaggagagctttcaataggaccttgatttctaacaagagaacatgctttggttttgcttcaccatcaatcagggaggttgcaactgatgagcctggttgagtgatgtgaaaacccatcccaggtacctcctataaacaattgatcatatgacaagtgcatattcacgttattttttaaaaaagaaatcaaataaaatccaagtcattacctggggatcaataaggcattcatgctcatggccccatactataaagtccagaaaacgtggtaagaaatgctcattgattgcgcttttagggtttgtttttatcctgtatgatttcaggtttcaattttcttttcagtaagcggcatgaagattataaaaaaatgaacaagaatattgaaccagtcagatactgacattccactacagtttgtcaccattcattcaccgcccatacctattctgatgaagaacaagaatattgaaccagtcagatactgacattccatcttgagtttcaggtcgcatccattgtacagcatgaggtgtctgaataattgatataaaaatatgatatcaatgttcaaatgatcaagaaagtttcttgctctagtgctgccaagttgcgaattaacttcaaattcttagaaaagtcaatggaaatgcacctgaaacatcctgtttaatcgttcatctctaatgtttccaaggccatagagcgcaacaaaagttgtaccctgaaataacaggaaaaacagaggattaacatgtgagagttcatggtttgcctgcagctgaagtagcgcaccttttttacgagtacaggatagactgctatttcaccaacaccagagccaccaaggtccatcttcccaaaataatttacaagattgcaggctgagagaatatcaattgcagagagattatcctacagagaggggcaagaatgcatgagaaaagctggcacccatcataagcataataaccataataacagaatgtcagaacgagattctcataccacaccagctggatcatcatggtttccatggatagtgaacacaggcaatccaacattgaagtttggatcttcataatttacttggccgaatc

SEQ ID NO: 87905 - DNA, 4083 bp, Oryza sativa
aactagcctctgtttgtttcagcttaaaattattgtaatatatattattaagccagattactgtaagctgaattataataagccgacatagaataagctttgagttgtttgtttctctggattataagctatttgttagctggtagccacccaataatctaaaataagcatctttaaagtggattactagattatagagtggattatcgaaagaaaaagcaatcacaccacatatttccagaagtctaatgaacgaggctccagaagtctaatgagattaaggaggatttgaaagagattaatctcacacctattatggtgtgaaattaaacgaacaaggccgaaatgtgtactaggccggcctaattcagatccccaatagcccataaggcccgcaccatacaagagcccagccctatatctaaagccttctccttccctttgccaccatccgtaccgaccgaaccgaccacgacgagctcgaaccatcgaagccgaagcgcgcacgaagcgaccccccccccccctcctctctctctctctctctttctctctctcgcctcgcgaaacccagcgagccctagccgatggcctcgccggagcgggaggaggaggaggccgcgcgatcgcctccgccgaagcgcccccgccgcgacggtgacgccccgccggaaccccagcctgcccgcgtgggcctcaacccggcggactgcgacctcggtacgcacggttcttcctttgcaggttgcaatcgatcacgcgctctgctcaccactccctcttccgttgctgtgtggcggccagatttcgacgtcggcggcggcgggctccggggggaggcgctgcatgatggcgggttcgcctactgctggtcgggcgcgcgcgccacggtgggcgtgaggggtggcgggaagtactgcttcgggtgcaaggtcgtcgccgagcaggccgtggagatggaggacacggccgcggaccagcagcacctctgccgcgtcggggtctcgaggggcggcgaccccgtgggggccctcggggagaccggccacagcttcgggtttgggggcacggggaaattctcccaccagggcaagtttgtggagtatggcgtcaagtttggggttggggatacggttgtctgcgccgtggaccttgattccaagccgttggcgtcgatcgggttctccaggaatggggagtggcttggcattgccaagcacttcgatgcaagtgacaaagggctgggtttggttgaatctcctgtgagctcaatgcaatgggagtcggcaatctttccacatgtgttgctgaagaatgttgttgtcgagatgcaattcagcaaggaggatggattgcagcttgttgatggttatgagctctggccctcagcttgtgtcgatgggaatgcggtatctggccctgtgtttgcagaacaaaaagagtgtgaaatcatgatgatggttggtctcccagcttcagggaagtcaacatgggcagagaagtgtatcaaggagcacaaggagaagcgctttatccttctcgggactaatcttgcattggtgcaaatgaaggttcctatgcttgtttcacaacttgcatgctctatgatttccactattttcagtttatgactttccttttgcaggtgccaggattgctgcgtaagaataactacggtgaacgctttgaacgtttgatggatcgtgccacaatgattttcaacacattgctgaccagggctgcgaagatccctcgcaactacatcatcgatcagactaatgtttacaaaaatgcccgtagtcgcaaactaaggccatttgcaaactaccgtaaggtaagctgcgaaaggataacagtttcacagtttgccgtgttgttgctgaattaataaatgtcaatgttggatgcgtttgtggggtgtttaatttcatatacttgttgtgcaacagactgctgtggttgtgttcccatcgccaagtgaactcaaggtccgggcagcaaagcgtttcaaggaaatggggaaggggatgtgccagctgatgcagtaaatgagatgacaggtatccagccaaatccatcactgctatctcgaaatgttcattgtctatgttctatgcatcaattacttactatattgccataaacacctattttcagctaatttcgtcttaccactgtccaaggacatgcctgattctaaagagccctttgacgaggttgcttggcattgctgtactccatcttttggttactatcaagtttttccttaggtcattacacttttcaacatgtgcaggtaatctttgtagagctttccagggatgaagcccagagaaacctggatgagatgaaacgtttgctgccaaaagcctcaactcccagctatgccaatttcagtaaccaaaatgtatgttaccattattgctgcttatggatttggtcctatgttttgtcatcatgggttagcttgatcttttgattcatgtacaagtcctaacgtagatgcttacaggtgagctcaacatatagtgggactattgctgggacaatgccatctctgtcaccaggttatcaccgacaaatggacagtccatatggaagtggtgtgcagacaccaagggccttgacacaccaacaggcagcatggggtgttcagggtttccagagtccagcagggattaaccaccatcaagtccacttaagcagctacccaaataccccataccaacatcaacaaatccaatcaaaccatccaagcaccccataccaacatcaagcccaatcgacaagctacccaagtaccccttatcaagatcaaattcactcgagctacccaagtaacccaacccaacatcaaattcatctgaactaccccagtaccccaaaccaataccaaagccattcaacatatccaaataccccatttcccggtcatggaaatagcgtatatgattccaatggtggcccaggtccatacaatcctaatccttacagcatgaacaccgatatgcaacaaagaattcaagctcccattggtgacaggaaccagtcctatgcagttgtgtcaaatgaagcctatgggagatctggctatgaagcggcaaattctgttggaaggcctatcaatacacatcctgccgtgtacaattctggcagtggcaattacatgccctatatgcagcattctcacggtaagtggctagctcaggctctttcttttcagttcattttgttacaagctaattcaacttggtggattacagattcactatacaaactcttaaaattacgaagtgagaaaaataagctctgtaactagaaacttttatagcacatttgagtacattagcactcatcatcatagggttctttgacctattaattggctacttggaattagagattatgttgctacccgtgaagtaaaactacagatctttctttgactgacagtgtgctaacattgaagtaaaactaacacatctttctttgactgacaacagatgtgcacaactctggatcacagtactcagctccagtccccaggcctccttacggagctcctccaccaaactatatgaatccacagacgagcatttggcatatctagcaaggcagctaatttgtggcgataagcgaacactggacatggtaccaagaaaagtagtttaagtagatatgcgcgagtgcgtgacctataggttccagggaacctttggcagttcggctcgcagatttttgtatagttatatgcacgcataaaccattctccgtatgtatccagtttacgacttttgcatgatcaattagtattggtttggccaacgcagagtgttatgtcgtgaacaactttcggacgctcggtcaggtacgcctgaatcatgaaaacgtatattctagtctctgaagaacacctactattgatgatgagaatcccttgtgcccgcatgaatgtcatgttgccaatgtacaaactgacatccagcatttagcagctacaagcacgtaaatccatgaggctaaggaatgtacaaatcacgcgagttggcgttccagtagttcattggaaacttaatttgccag

SEQ ID NO: 87906 - DNA, 2010 bp, Oryza sativa
aaggaaaaagaggaccaatgctccttctaccaatgttgatggagaagtcaccaaagtaaggtagccacagcaaaaccaaaaagatacttggatttggaaaatgactgcaatgcaatgatgaatcataaaaggtatagataggaaaactgcaaaaacaattcaaaagagatgacccagatagctgccatatgctaaatagccctgaagagaaggaaagaaaataatagctaagcagctgcagttaccagtttgtagccgatggcagcacaaataatatttctgttctgaatattacactttgttttgtgtaaacactttcttgcacgacaattcatcaaaagttctgtaagcactaaatttctctctgaggttaaacatgataatccttatgattactacgacatcatgtcataaagtcacatttcctggatgagctaactttgtttatactttatactaacattgcatggcctcataaagggcatgcaaagtgcaaaacaacatttagaaaatatatacgataattatgctttgtgagacatttaaacaataagctttactctgaacatccaataaatatatatatctcaaaacttgctgtgacaccacaagaattttaaatcaaatctacaattatgccctcaattttctcacccaaaaaatcaaaattgaaaaaattacattggtggttgcgagttatgaatgtatataatggacgctgctcaaataacagcctaatccatggcaatcttggctctttctgatgtttacctgtgccagtcacatctgtggttgctgtacttcatcaactacaggtagtataaacggccgcccatgtctaatctgaggatgtaatttcaggacaaagttaatcagttctgttactgtgttcacgtgtggctgttgagtaaggcattgaagcatttccactaggaagttcacaaaaaattctaatgttgatacacattcattagtgcgtgaagcaccgctgaagcagagggtgtgaatagtctacatagttatcccagaagcccttgtacttctccatcccaatttttagccatggcttcatatttccattgtaatgcaacactgcaccttctttgatagtagcgggatccactgttgtgtagcccagtcccaagacatgccatttggggtccaatggctcaaccaagccatagaaagcaagaagaccaggtggtaaagatccaagcttccatagggtatgatcagcattgcgctcttgccagtaatgatatatacctgtcacattcttattcctccacatcacaagatcaagaacattcataccaaatgcccagccacaggcatcaggatcaaaatgagcacggattagaggatgggaatggttaagatacttatggaacctgtgaaatgtctccatgcaagtctctacagctcccataacatttccattgaggttgatggtaaacaattccgacaagtccttttggacaacaatgtcatcatcaagaaatacgaccttacgcaattctggatagatttctgggatatagaacctcaggtggttaagcattgataagtacttagggttcctgaatttgactggtgttccacgattaccactgccagagaagtagtagttctgggtggcagcatcctggagctgtttaagaacaggaacatacgatgaattgagccaagtgaaatcctctaccttttgaatctccacagtggctcctctgtaatcattcagggcgaaccacgccctcatgggagcataattcacctcgtcagtcaccaagtgaaaaacaatcttttcagggcgcattgaatttagagttgtagaattgacgacaacagaaacagcaaggatgttgtccgagaaaacacagtaatggtaaaggctgttatcccttaggttgctctgtactgctgggctcctctcagtaaacttcctctggagctcagttgtcttgaaccattccatggttaaccggactccaaggcagtaaagcccctttg

SEQ ID NO: 87907 - DNA, 1404 bp, Oryza sativa
taatatattgacgcgcaatccttttgcgcgttcgtgaaaaactgagcttcttgtactagtgatgagctctttgttaatcggttccagttcttctccgggacgcacgccattgcctgtgctctgtttgctcttctgaggcctggacacgaggtaagagattagagaacacctggatgaactgagttttcgcattgcttctgctagcttagaaactgggagctgatgaaaatttagaaaatgtgtagctcctggctgtcgctggtcctccctatgacaccttggaggaggtgattgggatcagggggtcggccaatgtgggatcgctcaaggattttggagtggcataccgagaagttccggtttgttgatttcttcaccttacaaacaccaggaatgctttacattgtgctatttgtgagttactgatgtggcttcagttgtagcttgcagcagatggtggccttgattgggatgctcttgcaaatgctgtcagacctgagaccggatgcgccttcatacaaagatcttgtggttattcgtggcgcaagagcctaagcatatcggatatccagcgagctatagatttgataaaggcaagatgatatgttgtgaattcatggaccagcatgttctgtatgtgcattaactaatgcatatggtgatatttgctcatggagtcatgttttggaactcattgcagatgcaaaatccaaactgcatggttatggttgacaattgctatggtgaatttgttgagacgtcagagcctccaatggtggtatgttcatgcttgtagccaccttaagcattagattttagttacctgattgggtactttcatggcagggagcagatttgattgcgggtagtttgataaagaatccaggtgggacaattgcaccttgtggtggctatgtcgcagggaagaaagatttggttgcggcagcagcagctcgcctgtctgcacctggacttggggtagagtttgggtctacacctggacatgtgatgcgggcactgtttcaaggcttgtttcttgctccgcaaatggttggagaagctgtcaaggtaagttatttataaatttccacatctttaaccaataaaatgaaaaaataaaacagcatgcaagatatcaagtgacagtcttataccatccacagggaggcatgcttattgcagaagtcatgtcaaccaagggctatagagttcagccacttccaagggttcctcgccatgatattgtgcaggttggatctacatgtttaaacatcacttcaccagcacaaaaatattcatacagccatgatagtgcggcatatatggctgaaggaaccatccaattagaagtttgattttgagtactgacagaaggccaaccaagccttaaaagagtttagaaca

SEQ ID NO: 87908 - DNA, 681 bp, Oryza sativa
ataataacagaatgtcagaacgagattctcataccacaccagctggatcatcatggtttccatggatagtgaacacaggcaatccaacattgaagtttggatcttcataatttacttggccaatctgtgattgtaccaagaaaattcatgtaagaaaattaaggggaaaatgcatatctgcatacacgtatgatatatcaaacctaaatttcagcaaaagtgacacttttatgaaagattacattgagggatcaccaaatttagagtacactcaagaaaaaaatggcatgatagagtgatataactcatcgtcaaaacctgtttggaaagttgattgtctgatcactgacaacctggaacttcactggctggtcattcaagcagtaacgccgtagaatctcaatggtcttaactaaggttgaacgtgaaggtttgttctcatggaaaaggtcaccaccaagtagcacaaaatcaacctgcaattcagtatgatttccatcatattataattcataattcataaatagaaggttatcccccaacagaatgagcaggccaataaattttgcaacacaagcagaaaagaatggaaaaatgtgcagctcctacaaaccttattctgctctgctaatgagcatatctcttcaaacgcctcaaatgaatcaaacctacgaatctcgt

SEQ ID NO: 87909 - DNA, 1350 bp, Oryza sativa
cttcaaggtgaggcacatgctcttcaaaatttgattatttagtccttatagagattaggagcataaagtttggcacttgacttttgttagtgtctcgtaagacgctggcaatagctaggatgcctgcacttgtatctgatcccagagtaggatgtcttggatcacaaatttattccttggacaaacccacaactttgcatacagtccattgaactcttctttctataggaaagtggtccgtatctttgggatttctaccaaataagcaaataagcaattcatgacaataattttgacaaacgaactgtttacaaaaatggcttcatgagaagaattgttacaaacgaactcaggaagccataatcctcagcaaaaaatatttcgtagagaaacgtggaaaagcatactctaaaatttgatctcaatcgcaaacgagtcctggcaggctggcactctaagcaatatgaattcattatacacaaatatcctccagaatgatgcactgtgagagccatcttggccctatctcttctgaagctacaagctcgtagaactagtgcatcgcttccaagtaagaagtttctaactagtaaaccatacaactcagttctagcccaaatgaactggcaagtcaatggctgaagctagctgtccttgtgaattgtgatgctttggctatctgtccttgggattctttagttcgaagttactctaatcaatgcagcctgctgacctcttcacaactgtgaatatctcgatttctttaaaattttaatactattcatcagttcaaccaaagacgtgcgccatgtttgtttcctgcattaagtcagtaatcccaattatgagttgacaactttcagaactgacaacatcaataccaagcagaattatgaacttcacctgacaattttcatttcaatcaatatcatatacctagcaatcaattataccaaaaaaaaggcaacccattccagaagatgaaagtattatgcacttttggcaacagacagctatataatcttcagaacgtcgctgaggacaagagcccattgtgtccaatgtgttcctccctgcaccgttacatttccagaggaaaggaaccatcagcactagggatggatgatagtagggtgaaagattggtacatgtaactagtctgaagcatgacttcaactaacctgacagaatacagcgtatggatctcttaagggcccatcacatgatagctcacttgtgcttccatctatgaatgtcccatcagcaaaaatgacctgattcaatttgattaaccattcttgtatcatagcacactaatgaaaggtctttttagaacataaaagaaaagaa

SEQ ID NO: 87910 - DNA, 1779 bp, Oryza sativa
tcctgcagccctgtgcacacaggaaagaggacaattatagatggtaagcttgctaagatggggcaaccatgacgacgtccgctcgatttcaaatttctggcaaatctcaaacaagggaaataccttcagtacagggcaattcttaattttcagaacctttaaactggagttcaagttcctgatggaagtgcaggagcatgtgttcaagcttggcaatgcaattaacacaagctcctccagtgaagggattgagagttctgttgcattcctcattttgatcaacacgagctttacaagtaaccctagcctttctaaaggaagtatttgccattttccacatttttctagatgaagtgtttgcagacaggtaagtgaagaaggaagccaagttggggaggtagatccattatacccagatatccgtagatacttgaggccgtgatgtggttcaagaccttcgagcacctcacttgaagcaagttcagagcttatattactgtgatgttgtaagctttgggcaccattggcatcaccaactgacagttcctccccttctgtttctatattcatatcactgccgtattcatcttcatagctttcgtcactgtcatatccattccatgcatccttccaggacaaatgtagcttttctaagtgttgtttgtctttcagttttgccccacatgcctcctcctgagttctaacattttcaagttgagacacactaagttgtacaagcttgttcatggatttcaattgtgtcacctcaaaaccacttaaattattctgaacaataaaattgcctagttcctgaagtgaggtcattttaccaatgttagcaatggaagaacacacttcatcatatgcaacaagatgccgcaggctgagaagattatttatatcattagatatacggggaattccaaatctatagccaatatctagtacttgaagatggtaatacttccttagagatcggggcaaagttctgccggattcttcagtcacaattttcagataccggagatgtgtagaatttaccaaactggagagaaatgaatcagaatcagcataagttgcagtgatctgcagcagtcgcagatgttgtgcttccttgaaagcatctttgaaatatttaaaaaaatgagaatcatattgcccaattaataccagtgacctcaacttactccttgacttaactttcatcaaccttttctcaaacacctcattacgagatatgtttctatatttctccttgcggtatgcagaatcagttactattgacaaatggcgtatacttggggctaactctgtgcactctgagccatctatagttgcatattctgtttgtgaaaccttttgcgctaaatcatgcataagatcgtgcacaacaaaatattctgatgaaaaccgtgtgctttcaacttgctgaaggaaacccgaatttaccaactcagctagatatttccatcctttctgctccaacttctcactggattcttccacaaatccttgagcaatccatatttgtattagttgtgctttgctgaaagaataacccttggggaaaagagaacaataagagacgcattgctgtaaggggttggatagatgatcatagcacaacttcagcgcttgcatgatgccataagcttgttgcagggatttccattcttcactctttataatgctatcccaatgatcgatggtaagattcgttcctaatagtgaacccacagtttttgctgccagtgggttgccttttaactcgctagcaat

SEQ ID NO: 87911 - DNA, 554 bp, Oryza sativa
cgagccgccgccggcgtgccggcgtggactcggatcgacggctagggtttgctcccttgctctgataccatgtcacttttggagagaagatagaaattggggatttcaactattgcaattgacttagctcaaagagcatataaatatgtacgagagaagtagaaatgtctataataccctcaatactcttaacacacacgtgctcctgcacttccatgggggacttgaattccagtttaagggtcctgaagattgaacagtgccctgttctgaaggtctttccactgtttcagaactcccagcaatttaaaatcgagcgaatgtcatggttgtctagtcttaccaagcttaccatcaatgattgtcctcatttgcatgtgcacaatcctcttccgccttcaactattgtttcggaattatttatcgctggagtttcaacacttccaagggtggaggggtcatcccacggaacattaagaattggacgtcatcctaatgatattttcagttttgattccgatgatattttagagctaatgatattggatgataaa

SEQ ID NO: 87912 - DNA, 1064 bp, Oryza sativa
gaagggcgctgtgattttctcctgacatatattcaccggtaagctctgatggaacatttgaagggagaagttttgggcagtcgtatatttttaaagtcttcaaacatctgagttgcctcaaaccatggaatgaaatagacgtcggattttggaaaccatatatttccaatccagttaggaaactcaggttatggaacgacataatgttatcatccaacgttatcagcttatcaggaacatcatcatcattgggaagccaaattgttaatgttccattggatgaccccttcaacgttggaagtgttgaaactttggcgatggataattccaaaacaatagtagaaggtggaagaggattgtgcacatgcaaatgaggacaatcatggatagtaagcttgctaaggtgggacaaccatgatttccgctcaatttcaaatttttggcagtcctcgaacaatggaaagaccttcagcacagggcactttttaaccttcagaacccttaaactgcagtttaagtccctcatggaagtgcaggagcatctctccaaatttggcatgtcaattaacatcagctcctccagcgaaggaactgtcatttctattattttctgcatactctccaacttcatctttttaagaaagggaagacgttccagtgatggaatcattttccattgtccacaacactctagacggagagtctgtaaagaggtaagtgaagtggcaagccatgttggaggggtagcaccattgtacgaatatatctctaggtgcttaagatttgtatgtggttcaagaccctcaagcactgctcttgcattttcacgttcatcccatggcacgttagtccccaaatgacccaatttatgtaaattagtccacgaaaggcgcagcttttctaagttctgtttgtctcttagttttgcaccacaagcctcagctctagttgtgacattttcaagttgagacacaccgagctgtacaagctggttcatggactggagttgtgctatctcccagccgctagaattttgaacaccaaagttatgtagttcctgaaga

SEQ ID NO: 87913 - DNA, 686 bp, Oryza sativa
gacgagcggcggttcggtggtgagacctggggcagtgtccatgcgtgttcggggggctagccgagctaccacgcgagctagggagggagaggacgagcaagaagggagaacggagggtggcactaccaagccgagacgggcgcagtgacgagcggccgacggctcgggagcgagctctccggcctctggccggggaaggggaagaagagggatggccggagtcctcgtctcgtgtccacgcacgcaccggcctccgacgcgtgcgacggcgaagagacgaaggcaagaggtgggagcggcggcaaggcgtcaacaatggcgcaggtgtttcgagcgaggcggagacgaaacgagaggggagggcgcgggctttataggcgagggggagaggtcggtttggaggagggaaaccgacattggcggtcaagggagctcggctggtgttcacgggcggcagcggcggtttcgtgggcagtgcgaaggcggcgacggtgtggatgtgttgggcagcgaaggcggtggatcgagcggtggaaaatcgaaccgcgggagcgggaggattagcgcgggctggcgcggtcaaggtgggggcggcgagctggcgctggcgtctgcgtctctgcctccgagcgctagcggccaaggagtggaggcatggcgtcgttgcttgggagggaaaaagagaa

SEQ ID NO: 87914 - DNA, 2772 bp, Oryza sativa
agctcttcggccgccgcctcgtcgtcgagtacacgcgcccttccctccccggcccacgcaggtaaaagaattcaccgtcgtgttaattcccatcgaaaacgcacggtaaaactaatttggctgtggttggcaggcgcgggcacgtgtcgcaccagcccttggccccgacgccgccgaggctgcaggcggcttggcggccggcgccggcgccgtcgcagtctgcgcagccgtcgtcgtctggctccggcaaggcgagggaaggcgtggtgcttctgcgcaggagctccgggaaaggtagctcgggtagccagtccaagggcggtggcaatgctggccacgagcggaagagcaagggcggcaagagcgccgcggcggcgtgttcgacggcggcttcagcatcgtcgtctaccgcaacggcgcccagcaagcaaagccagaaaggcggcggcggcggctgctgccgtggcggtagctggagaggccaaaaaagcgggtgggaggctcgctttctgttcaaagaacccgaggacgaggcctgcggcggcggcgacgctggccgctccgagacgcatgagccggcgagctgcaaggacacgagaaccaccgtgatgatcaggaacatcccaaacaagtacaggtcactccgctagcttccacgttgttgacgaaatgctatatttcatgggcgccgcgagcccagaattgcctgcctcgcattgcgagcttggcactgatgcctgagcttgtcgtctgttgcttgttcgcagccagaagctgctgctcaacatgctggacaaccactgcatcctctccaaccagcagatcgaggcgagctgcgaagacgaagcccagccattctcctcctacgatttcctctacctccccatagatttcaagtgagtcagctcccgatatgctgtatttatattttatggtgcccaatgcaagaacactgcggcacacactgtccacgcccaatgacaatgacggcctccatgcttcatttccgactgagaattcagtcctagaaaactaattaattttatgattcttgaggggaattgtgcaatggaattgcattgccgtgtgaaggaaggacaaaggtatatgaaaggggcttggaaatgtactgggagatgaatgggtagttgggagctctagctgctggtagtgatgtgtgagcttgtggatcgagttatctttgggctgggtagtactagcatgttactgcactgtactgctagtctgcaacacatatggacgcctactctggtgccatggctgtaatagcccaaatggaaaggaaattggcagtccaagggagatcacaccagatccttctcgttttgatgcatcaaatccttttgttgcatgcaatcctctgatcatgagcatctgttcacatgtctacctttcttgcgcacctgcctctaggatctcctgcctgccttgctctctttcttgcttgcttgcgctgtcttgacctgcacttccatagcaaagtccaacgcaaaaaggaggggctagacgtcatggagtagcggtgaaaaggtgcatcaatgcaaaagcgttttcaattttgacatgtagtaatatatttcttttcctgagaaaaaggtatggtgaccaatgcataattaagcactttcttttcactggagtaccaacttttatctttgcacgaaccaagttgagaaaagacctatcaaatgccccaatgactagcgtgcattgtggaatcaaaaggtagctccacaacaaaaatatgatagaaatattgttgtgcaagtttatagttccccgagcttctgacttcgaaggcctcaattccaagaatatttgtgttcttgaccttgacaagtcgtttgttatcattcataactcatttttggtcacccggttctttatcgcttctctacttgttgagaagtttttaaattcaggcattaaattatcttttcggctgtgctaacctgctaaaatatgaggccatgcagcaacaagtgcaacgtgggctatggcttcgtcaacctcacctcgccggaggctgccgtgcggctgtacaaggcgttccacaagcaaccgtgggaggtgttcaactcgcgcaagatttgccaagtgacatacgcacgcgtgcaagtacgagcgccgttaaatctctcccaattgtgctgataaatctagaccgatcatcatgtgtggcaagtgctaaacccgtgcatgcgcgcagggcctggacgcgctcaaggagcacttcaagaactccaagttcccgtgcgacagcgacgagtacctgcccgtggtgttctcgccgccgcgggacggcaagctgctcacggagccggtgccgctggtcggccgctcgccggcaccgtcgtcggcgtccggggcgtcgtcgccgcccaagagctgcgccgcgagcgtcgacccactcgcgcaggagctcatgacagcgccgtcttcctccggcgacggcgcctcctccgcctcctcgtccaatgcccacgccgacgaggatgacgtccatggcgaaaccggtggtgaccgtggcgacgacgcggggctcgatctggagctacagcgcctaggctacactgactagctggcgtctggcggctttgcttcgagaggtggtggcaatgatggtggctacggctgctgcatgcaagcaagggaagtgaagtgaacaggtgatttcatttatggctttaagcagagataggagtaggaaagaactcgagaaaagaagcgatttgatgttattttgagagg

SEQ ID NO: 87915 - DNA, 694 bp, Oryza sativa
taggaaataacgcaattttccttcaatccaaagaaaatagtggaatcccatgaatgaacaaatatcagggcccctttaatttggaggaaaaacatagaaattttagaggatttcaatcatataggaaaatttcctatgaagctctttgaaacaaatgattgaatcatatccaatcctttgaaattcctatggaatgaacaatcctatagagatttttggaggaaatttagcaagagctccaacctcttgctaactttcctttgagtctatctctctcatccaattcctgtgtttttcctgtggttcaatcaaacggtcattcctgtgtttttcctgtgttttgcaatcctctgttttaaacttatattcctatcaaaattctacgtttttcctattcctacgttgtctccatcctgcgattcaaaggggccctcagaatgtgcactacctgcctctccggtcctttcaccccaatatctctttcctcctgaataaacgcctgatatgtttcgatcaagtgtttctgttggtatagccgctgattggccttgaatggactcgtgagctgtgcttattgtgactgaactctggagacttggagttgacccccaatttgttcatcggatgtgcatggaacatggggctactctactcattgcacgtccatccccaattccccatggatcaagcaagg

SEQ ID NO: 87916 - DNA, 725 bp, Oryza sativa
gttcctcatcggtaccaatccctacgcctccaccagctgttagattctagggttttagcgattttttttctccgtgtaacacgctcgtttatctctctgtttctcttcctagggctgcccttgctgctcaagtccaccgagatccaccgctcgccgctgccgtccgacgcaatcgccgccctatcccgccgcctccactccaacccgccctcgttcccctgcggcctccatgcggtcttcctccgctccggccgcgacccctccgaggcctccgtcgcaaatcgcatcgagcgggaaatctccacccaactcgtcgatctccctgacgcttccaccgccggtaaaatctccgtgtcagtcaccgttgagtccgctggtggctgctctagtagcagcaaagtcgcctcgccttggcgatgtggtgctgtgactaccgcggacttggggcgcggcgatgaggtgtttgatgaattgcttgactcggcattgggtgatggaggcggggatgggatgagggtttacactgttgtcttcgtggacagtgacgatttgaagagaattgtcattgggaaacaccggcatgcttgggtggtcgggaaggttgatgaggctgaggttgtgtccatcattgggaaggtattcgtcaagtatttcatgaatggtggtgtcgaggagggcgaagcaagcactgtgaaaagagaggttcatgccagttggatcaaatg

SEQ ID NO: 87917 - DNA, 1590 bp, Oryza sativa
taaggggtagtaactggtgtgacttttaaaaactatagcattagaaacacgagaatgataaggtatgtagtggacggttgtagaggagtataatggtaacgtttgacgggacttatagaaattataaaaatgaagcctaacaggacgataaactctatagtttagatccaatttttaaaggttccaaggagaataaatagaaacagtggtagatcaagtggtagatcaagcaaactaataaagaataatatgatagaagtaaggggtagcaactggtgtgacttttaaaaactataaaattagaaacacgaggatgataaggtttggtttttcaaaatcttaagacatcgaaataactatttaataaattttaagtaaaatcatattaaaaatatataattttatatgggtgctagccgtgcaattgcacgggccacccagctagtttttaataatttaaggggggtaaaatgagaaaacaaatagtttaaatgttaagtgaacaagttcgggtaagtaaaatggaccgttttttcaagtaaaaagcagcttgacatgagtaatttacacttccccgcaaaaaatgagtaatttacgctagcaaacctatacagagggttcaggacaagaagtttgttttggcacatgattttctgggaatagaccaattgcgttgcatgaaaatatgacattactcggaaaattttgcagttctcgaatacagccggtcgaatctacacagggctgataactaataaactagtagtatatataaacccccaaaaaggcagtatcgctaacagtagtagcgaacattctgaaatctgaactctgaatcacttatagctcagctaaggtgagcaacatcaccctcatcagggaacttgaacgtatcagctgcaccaaacttcttcctcccctcctcccactcatcttcgtcctccaagctgttgcgctcgtcgtcgtcgtggttgctacagcacatcggcgacgaggggtcgttgacgctcttcgacttgcacgggtcgctggcgagcatggtgacctgacggaggtgagagatctcgacgaccacggtgtcatcgtctttgggaagaggctgcttccatggctccccatcgatcctcatgaacgtgtgctcggctgctcctttgtggaactcgaaccggattctatgggcctgaaaaatgtgaaatgtgtgactgcatcagcaatgctagctgaaatgtagggagttcaggaaatgggttgagaacagatgcatcacctgtgctagacgagttccatggccattaggggcaagcaagacaagaccgtgccaggcatcgcgaaagccgacaacctcgataaggccgtcgtcgacaaatggtgcagtcaggtctctctgcatattgccatgaaaacttataaattctttgcccatggcaaagccattaggagtgaaacgacaacagaagaggcaagtgctctacttacatcttgtactttcctggtgccaggtgttccccaaggattcagtcctccagaaaaacttggcagattcagacagacgattgatcgaatgctgaaacaatagagggaatatatgtt

SEQ ID NO: 87918 - DNA, 1496 bp, Oryza sativa
cacgttcgctgtggaggctaaaaattcccacattaatcggaggaaaggagaaaaatattaaccgttagatcatagtatatctagattttagcacctcagatctaatagataaagatatcagagttgtacagctaatagaaatctttccacggaagcttaaagaaacatactagaaataggaatcggagtaaaaaggagaaacgtacttaggaatcagagtaaaaaaagagttcgagatcaatacgactaaataaacggcctgtacatatatgtgaaaccaaccaatctgaaaaggaaaagtttatttctaaccgggatatttaaattcgttttgtctatatgaagtatttgaactttttctcatattaaaattaatgtattgatccacagcttgcgttccttaaaaacgaactcatgtccatgtaaaaattagaacaatactgcctccttaattaatacggagaaaaaaaagaagagtctaagtagaaatacaatataaaaataactgaaattcggaattaaaaatatacaatattgaaagaggagtctagataggaacctaatacatgattaattaaaattcggaataaaaataaaataaattttgaaaatagaaagagtaaaaaataaaagttcgagtagaaatacaatttaaaaataactgaaatttggaattaaaaataaagaatattgaaagaagagtccatacaagaatccaatacaaaattaattaaaattcggaataaaaaattgaaattaaaaaaaagaaaagaaaataagagttcaagtaggaatataatttaacattaacttaaattcggaatttaaatataagcattatttcatgactacatataagaacccaatagtagattaattaaaattcggaataaaaaataatataaatccaaaattaggaaaattaaaaatagagttaaagtaggaatatagttttgaaacaactgaaattgaaaataaaaaaaataaaaatatcaaaagaacacaattcaaaaaataaaataaattctaaaattagaaaaataaaaataagatttcaactgggaatacaatttataaataactaaaattagtgataaaaaactattgaaagaaaataccatctaaaacaaatgacaagattatttaagtaacagacctctagaggagcagagtggtggctgttgatgagacatctaaaactattaataaaacaccaaatagaatcctaatgacgattaaaaggaaagacgactggcaggtcgtgaagcaatcgattcaaggcggttggcgatgacttcaagaaagtaaaaaaataaaccccaatgataatcatatttgatttttaaaatcttaattacaataaaaatgacaggcggcgggagggtcgtataggagtacaatggcagacccgccgatggttggtgggtcttttacaaagtaaaaaaatgaattccaacgatagttatgttaaattttataatcccaattacaataaa

SEQ ID NO: 87919 - DNA, 1219 bp, Oryza sativa
cgacgaggggtcgttgacgctcttcgacttgcacgggtcgctggcgagcatggtgacctgacggaggtgagagatctcgacgaccacggtgtcatcgtccttgggaagaggctgcttccatggctccccatcgatcctcatgaacgtgtgctcggctgctcctttgtggaactcgaaccggattctatgggcctgaaaaatgtgaaatgtgtgactgcatcagcaatgctagctgaaatgtagggagttcaggaaatgggttgagaacagatgcatcacctgtgctagacgagttccatggccattaggggcaagcaagacaagaccgtgccaggcatcgcgaaagccgacaacctcgataaggccgtcgtcgacaaatggtgcagtcaggtctctctgcatattggcatgaaaacttataaattctttgcccatggcaaagccattaggagtgaaacgacaacagaagaggcaagtgctctacttacatcttgtactttcctggtgccaggtgttccccaaggattcagtcctccagaaaaacttggcagattcagacagacgattgatcgaatgctgaaacaatagagggaatatatgttgattttcatagctacattctgtggtgatgataacattctagaaatgtgtctaagaaacttggagatggaaaatggggttgggattttggaagaaccagacattttagatgaagcaaaatggaaattgccttgtacaaatacactgcaaaggaagcaaggatttatttacctgcgaggaatcttaagctcttcccattggccaccaggtcttttcatgatccgcacctttgcaagttgagcaatgttcctgaaaatgggagctgtacacgtcatgcatatccgacgtaaaggcatataatagctaagcgtggtacttgaaatgctaacaccgatcaatgaggataatttgatcaatatcaggggcatcatggttgcattagtgacaggctacctcgaggatgggtgagttagtgaagcagcaaaccatccttgtttaagtccaagcttagcatatgtactctgcatcaaagaaatgcatcacaacattcagcataaacaaaatgaaatgtgccacaagacttgccctacagaaacgagaagaacctgatttgttagctggttcttgaacttctcgggtcgacctaggcatgcctcttcctctcagagtgaaattcgta

SEQ ID NO: 87920 - DNA, 559 bp, Oryza sativa
ttggaaggaggcaaagaagttgctgtcaaaagactcggtacaggttccacacagggggtagagcattttacaaatgaagtggttcttattgccaaattgcagcacaaaaatctagtcaggcttcttggttgctgcattcatggagaagagaagcttcttatttatgaatacttaccaaacagaagcctggattacttcctttttggtatgtaataattatatattctctttttacctttttcacttttggtgggagaggccgagagggttcccaaagcctgaacaacaataagtttcctttcataatgtccgtcgtagatgattcaaaaaagtctatgcttgattggcgaacacggttcaacataatcaaaggagtagctagaggacttgtttatctccaccaagactcaaggatgacaataattcacagagatctcaaagccagcaacattttattggatgagcagatgagccccaaaatatcagattttggtatggcgagaatctttggtagcaaccagcatcaagcaaacactaagcatgtagtcgggacatagtg

SEQ ID NO: 87921 - DNA, 5918 bp, Oryza sativa
caggcggtagatcgggccagtccatttggccgcccacgtggctgccgcgtggccaccgtgtcggcgccacgtcagcgccacgtggtgtgccactccttccccggcctgtcgacccggtccaccgtggaccgccccccctcgcgtcactgccttgtggggcccgcatgtcggcgccgccctctctctccccgggattttaattattgcgcaataaatcaattaaggatttttctgtttatagtaaaaacacaatgaatcttctaaaatttatatctaattcatccgagctccgtttaagcccattcaagtctcagaaaatcaagaaaaatacatagaatccattaaaaatggttttgttctctatttcagtagtcttatagcctgtttgtattgtttgctttgtatgtcgcttagattccggctctcccgacgctctggtgtactttgaaatagtcgccgaggttcctccagcagcagagcaaggcaagtcatgcttgtcacttgaacatgttgatcctatattgcaaatgctctaccgttttcccttaaatactgcattgttttataatgttactatgggatgtttgactactgttacagccatactattttgtaccatgcttctttgttagcttgggatataaacatgactagagattggactagggattgcttagccttgcttagttcaactagcacacaatggggaaaatcacattaatgcttagacttcaggttctagtgttggtgttggattaaggccgccgtcctggtgttagtcaattaaaatatacatatggtgggctgtgggtgcatggttttgatggtcgcgcccatggtacttaaggaccggttcgcgggaaaccctgaaagaattcctcgtacttgccacaagccagcgtgggcaacggctgggcttgtagtgtagctttcctttagctgatgcatctaggcaagggtgggcgtgatggagtttggatgggccctgcgacggcctatgcagcttccggattcacctaggcacgagaggggactgcccgctgccttgcgaggagtgggggtgaaacctgaggtgtggtgtacttggttagagggggttatgcgaagggtcctgtcacggcctctatctggtatgtcgtggtggcatgtcagcgcacgggaacgtgtcgtgggactgtgtcttgtggatacagttgtacacctctgatcagagtaaaactattcggatagccgtgcccgcggttatgggcggtcaaccagattcactgtgattagtctcaccctagtctagtctattagaattaattagttcaggtggatggttgggcctgttgcaacgtggagtagcgttggacaatggatggttaatattgattaattattacaactgttttactgctttcaactactgtttataaatgctcgctttatgcaaaagaacctctctagctatcctttggtaataccctgcatcataccctctattccggtatgactcgctgagtacggtggttgtactcagtcttgctctatttttcccaaaccccagagtttgagtacgcgtcagatggcggtttctccgaggagtaggcttcgtccgtgccgtcgaggatgcctgtggagtggtgttcccgctgcgatccaagtcaaggcttagctccagttatcttttaattttccgctgcatttatgtaagacttttataatgtttgtaagacgtggatctgtatgtcaactttgtcgtttgtgtaccccggccagtcctggacggtggttttaatgcacattctgcttggaattctattcgggaatttctgggcgtgacgactggccatcgcagccatcgccggcatggccaccgccgaggtcgcctcgccggaaacggccgtgcggcatggatctgggcgggaggagcaacccccaccgtcgacgtcctggtgccccactccttctagcgccgtcgggggagaaaagggccccgccgccgccatccttgcagccaggcagcttgccggcgggctgctcaggctgcggcgaggtggaggagaggggggagggagggaggccggcggtggcgcgtggaggtcgcccgcgtcgccctagggctggagcccgcgtcgccctagggctggagcgacgcgtcaagaggtttagtttaagaagggattagttaatgcgccggagtaactaaacaatgggttttgagcttaatctccaatcattttcccttgggcgcgcgcacgatgggcggccatggggggcctgtctctgtctgtcacgacttaacctcctccctgccttgtcctcatcggcgcttctccccctttaaaatcttcgctctcttgccagtctcgtcgcgcagagcaaccagagaccagcagaggaagagagattgtgagacagagaaagatcaggagaggaagtagtagctgaaatggtgaagattccgagcccgaggaggctgttcaggagcaggtccaagagcatcggcggcgccggcggcggcgtcggcgcggacatctgcgcgatggtcgcggagcacgagaagatcgagtgggaggtgcggccgggcgggatgctggtgcagaagcggcgggcgccggaggagcaggacgacggcagcagcagcatgtccgcccactccggcgcggacgccatcgtcgtcagggtctccaccgggtggcaatggcacgacgtctccatcgactccaccgccaccttcggtgcgtcccacattgcattgcctcgattgccattctcctcagctgatcatactagaaaggaaataaactgagctgttctttgccatgatcgatgcaggtgatctgaaggtgatgctgtcgctggtgaccgggctgtggccgagggaccagaggctgctgtacaaggggaaggagagagacgacggcgatcacctgcacatggtcggagtccaggacaaggacaaggtgctgctgctggaagacccggccgtcaaggagaggaagctccggtcgaccaccctggcgcagctcatgggagtgccctgccattccttcatcgaagtctagaaattaaattaaacccgccattttgacttgttcttttttggtctgcttgcaagagtgacaccacgcaaagatccttttttgtttccagctcaatcgtctaactgcattgttcggagtcactgttccatttctcgagttcgagggtagtctggattcagccgattgaatcgaatcgtctgcaccaatagtccaatacgacacaaagacataatgtaaattaatgtaattagataatgtcagtgtgtgttgtgtattatttcagctgtaatacttcttaccccatgtatattctcctactgcaatttgcaatacagattatatgatgcacccccgtcttcttgttgaccagtttgtcagctactgcacaactagcctctcggtcgtacgttccccatctttctctctctctcatcaactcgtactgatcgtacaataatccgtggtagttgaacggcattgttggttgctcgattacttttttcccaacacaatgtactgttgcatacctgctattcaagtggcagttaaccgacccaggtcgcagcaggtttacggctaccaaacatgtaacgccagcctgcactgaactgcctaacctggaccgaagaaatactattgcacaccgtaatcagtagtagaactgagcactgactaaaattgctcgcggaggcaatcgctgatactctgatagcacggataagatgggcatttgcaaaattcagtttcaacgtactggtactgcttcttctactgtaccctgagctcccttttcaggctgttattttctcacattttctcttggattaacatgccagtgttaaaagtaacatttagccttttgatcattgatcaagtagcagtacatgatgctggaccgtggacaggggcatgaatgaaatattgaaatctaacccgtaatccaccgaactgtacgcgcgggacctggaaaaaacagatgagacgacgctatcaaccagcggtccacctgtccccctgaactcgtgccgcgaagagaggagcgacttgaatgctgatctcaccggcggctcgacctctcggccaaatccgtccccgcgcgcgcatgtgccggcactgaccgtgatcagcgcgacgcggggtcgtggcagcgacggccgcctcctggtccggtggtcgtcgacccgtccactgcgcccattaaaacccgaggtggtcggcagcgaggcgggcggaagaaaaaacgacggcaacttggctatctcattctcgcaacgtgcgtgcgtgcgtgcgggcgggcgtcgcggcttatccgatcaggaggaggcccgcggatttggccccaggtcggcagcggcatgtggccatgtgcgagtgccgaacggtgcgtgcaccggggggcggggcggtacgtagctgagctacctgccgggcgctgctgatggctgggctggtgcggtggtggtgccggtttatcggttcggtgcggtgctgtgcgtgcgttcggtcggcggaacgtgcgcgggctcttcagtcttcaccgttttgggcactcgcgttgattacggggctaatcaaatctcgcgtagacgacgtcgtagccgtggccaccgctagccgaccggacgatgcagcattgtttctgcccagctgaagcgcaccagagtttgaagggggcacccgatttttaatagacgatgttgttaatttttttacacacatttgactattatttttattaatttttttctacaaatataatgaaaaatgaaagtcatgtttttacaataaaataaataatgatttatgtaatcatttaatagatataaatggttaaaagtgtgttaaaaagtcaatgcattatctataaatagatagatggcagtaattagttaatatgcaattaaatttagcgtataaaacttgtactaataaattcatcacactttaaattactttcagacaatattagttttatagatggtagaatattttatgttaataattgtggcaaagtttaggtcctgttgcccatatttctaataattcaaaatggtttattagaaaataattaatttatggataaaacttttatatatgtatttttagcgacttaaaaacaagtaattataaaaaaggaaattaggttgaaaatatcttaaattaactttaaaattagatttgaaaattcaaattttggctttgtatttagcttattagggaaaccgatggggctcttagtattaaagactttctaaaataaaaatatatgttataaaaaaattgaataggaggaatacttctctctctctctttcattttcaactatagaaattggatactttgttttgttgggcctaaatggtaagatgggctttaagccgggacacttcgagacaggccatacttggacctaacgtagtgacgttgccaccggggcccagcgtatccggacctgtaacagataaacttcttgggccaggccttcgagcacgctccgctcctccgctgcttggtcaccgacccctcggaacgccgttcatctgagaaaggatggcggtcctggcggagatcgccggcgacgagtccccgccgccgcttcctccttccgaaggcggcgaagcttccggagccccgtccacgtcttctccctccggatgccgacggcggcggcaagccttcgccgcgcacgtcgaagcccggcaggaagcgccttcggtcctcaccgccctccgtcctcctctcgttccctcatcggtaccaatcccaacgcctccaccagctgctagattctagggttttagcgattttttttctccgtgtaacacgctcgtttatctctctgtttctcttcatagggctgcccttgctgctcaagtccaccgagatcca

SEQ ID NO: 87922 - DNA, 775 bp, Oryza sativa
gccaccgtgctgatcggcatgagctcaccggaggggccgtcgaccagctgggcttcgtccgtgatctccggcgaggcggcgaacgccgacgtgttcgcggcgacgaactgctccagcatccgctgcacgcagtcgacgtcgtagagcgtctcgacggcgtagccggtgttggggatcaggaggtcctccagcgccgcctcctcgagctggttcccggccatcctctccagcgcgtcgcggcacgccgcgccggcgttcaggatcgtggcggtgcggaggagcccgagcaggaacctcgtcgtggcgacgcccctctcgacggggagcagcgcgacgatctcctccaggagcgccctctgctccacgtccgagagcacggtccccgacgcgccgccgccgccgacgtaaccggagtggcgggtcagaccggagaggtggcgcttggcgtagtgcgtcagcgagccggcgatgttctcggggctcatgcccttggacctcatcgccgtgatgagcctcttgtacaccggcagcttcagcgacgacgcctgcttgtaccaccagtccgggcccggcgacctcggcttgccggcggtggcgatgccgtccacatcaccgtcttctcgaggcccctcgccgtgtagtactccaccatcgggcaacccaagagggtcgggtcggcgcaagccttgctcgccagcgcgttgatgcaacgcggaacgacaggagctcctcgcgagcgggaggagcgcgccggtcgaacgaccgcagcgcgcgc

SEQ ID NO: 87923 - DNA, 1229 bp, Oryza sativa
ctacagactgagcacaaagcttcccagatagaactgcaccctccatcgaagccaaatatttctgctttgtgtagtcaccagctagatagaacccttcaatcggtgatctttgcagaggtcggcaaggttcacagtccgggatagtcttgtaaacagatctgtaacagtgagacagaaaagaaaggaacgtgagagaagtgtgcatccaactattagacctacctatgatatatcagatagggggcgctcttgcaaaatgtcctcaccttggtgtcttcacaacatgatacttcagatctttgctttactctgatcagcagcaatttcatcaggaaatagcttggctagctcttgcatagttgcttcgatgatttcagtgtcactccgtccaacccattcctctgcaggagcaaagaccaactccagcattgaacggtttggatcatagtattcctgtaaagagttcaaaacaaaaggaaagaaaaccgttcagtaggcatccatgtctttaatttcctgagctattatggtccataaaatctagactctagagccaagtgacatgttgcctaaatgaatctgaaataaaatatatctactttccaagtttaataattaatactggattccttctgtaacacatgcacttttgggccttttgttacagctactaaaataaatatcatgtgatgcttgaagatggtaaacccaagaacaaatacacaagagcaataatacatgacagatagttactatttcgtaacatataatgtctcctagttagtaccttgcaagttactgacatgtccgcataaacacttaaaagtgaactcctgaaagaaaagggaacaagatcaatacatgggacatatgatatttggtattaatcaagaatgtatacaaaatcaggatagaatgtgcccaatttgggcaatacaaatcgttttagttcataaaccagtcatagcacagagcaaatgcatgaggcagtgaaaggacagcaaaactgatgaggaattagaagagacacctgctgaaaagaaggtggtcatatgtgttcttcagttttctatcaaacctgaaatgttcaaaccaacagaaatactaatatgagtcataaggagaaccacaaactcgatgatgagtaatttccgacttggaaccaaataattcaaccaccaaccatatatgaacatttataacaggaactcccaccaacttctccagct

SEQ ID NO: 87924 - DNA, 1226 bp, Oryza sativa
atcattctttgcattgttactgcattcgcgcgggctgaaatgctggatccaggggcttgcgggcaggcagtattttctcccgatccgtgagcaagcactggtccgatcaaaattgagtttctcccacaccccaccacggagaaccttgaatccgttgccagcatcattttgttcgtgattgtagagttgctcaacgaaaaaagcctccattgagcttatataatgcatgtgccgctcatctgtccaccctgacgacatcatgtccaggattcgattgccctgtcaaagaaaaagagacaaccattttatttttcagagttcaggtatttgttacaacgtcagataaaagagggcctgaactagtgaaattcatgtcaaaaatatcagagtagtgttgattgcatggcttaaagttatactccacgagcagagtaattatgtgtcttcactgccccatgggcggattatattactatttcgacaagacagacattttttgaacgattgcatgacaaattcagataaaccattaactgtacaagactaaccccttttactaaagaaaaagagctaatggcaataattcaaggaaccatgcattcggtatgacagaatcatgagcccaacaattgctacctgaaattaagaacaaaccccatggtaaaaagaaaaaactttctgttctaatacctgagcaatgccgcctgcagctggctccgccttgatcggtcgattgactgacacatcacccatttgattcttctcaatgaaccaaggaacccacaaggggaggaaaatccgaagaaattgccaaaaatcttctcgaaccgtatcagaaaccagcccaaaatttcctctcttgaaatatgtacagctacagagaagtagggggaggtctagggatctggaagcaaatcggcgaacaaaccaaagtaaatctcctcgcgaccggatgattacgaagagggaaaacaaaaaaaaacaaacaaacacggacaagatttcaacttcaagaaacaaacaagagaaacaaaaatcacacctctcgctcgatttcacccgcagatcgaacaacccgcctccctcgcagcgagaaagaagagagaacgcatccaagacttggtctgagcggctcgatctatggacagacaagaggagctgaagaagaggaggagagagagaagcaggagagagaggagaatggaattgcaacggaagaagcaaag

SEQ ID NO: 87925 - DNA, 548 bp, Oryza sativa
acctttccaccagtaaactgtgccctgtatacacgtccaaaagtaccttccccaacaaggttgtccatgctaaagctttctgttgccatctgtagatctgcaactgaataaacagttgcctttataggtgccacattggttttcttcaagacaggcttgtttgataaatcatcatcatcgaaagacttgtggcgttcaatcttggggggtggcttcagactaaatgaagcaggggatggcaaagactctacatctattgtagtagactcttcaataggcttcatgtctgcacattttcagaagcaaattttcagataattgtacaaaatatataacaaaactaaagtatgatgatcagcaggcatcaggcaaacagacctttaacttcgtttgaagggaacgaagtgaatggctggtgctgttcaaaatgttcttccaatgccgctctgcggtttcttcttcttatcacaaagaatgcaacgactgctccaactaccagcaatgatatgataatgcctgctacacctccaccacctatcccagagctt

SEQ ID NO: 87926 - DNA, 1523 bp, Oryza sativa
gattttaatagctgtgagatttgtagtttctgaaacagatttatcaaagagccaacgaagaagaatgccggaccatctttgagtttcttcaagtgacaacggaacttcaccagcatagagcaaactcagtgccactgctaatgattccttcatcctgctctgagcattctcattttctatcttttttgcgatactacgaagaagatgaagacccttctgtctgatcacaaattttgactcattacaccttatcatggataataggaaagttgatagtgacatttgagccaatgccatgtcaccattctcagcagcccgagaagctgtcaaaagaagacttgagcaccagtcagggacagaaggagccaaagtcaagctctggtcttccaaaagagctcgcgccaccatggctccatgccacttgacagttctttcaggtgctttcagtgcagttgtgacagtatgtccatcactgtcaagttcttgaatacgagaacggtttaaatcagatgcaatagcccaattagcaagagcccaagtagcaaaagggtacagctacatgctccctctgcaaatcatcccagaggcctggagcagcagcagaacttagcttctccactagtggagaatcagtagcagtttcttgcatcaatattctactattcgaagctccaacaataccatcatccgagtgcccacctccaatgagtttatttctctagagaatcccaagacagtagtcccaccaagtaccttaatccctattccttttaatccactgtcaccatcatcactgttattatcatcatggtcatcaaaatgcatccccccttgctcaatgacttcgatggctgccgcaatatctcttgtatcagcatctgaaggcaataaaggctgaaatgatgaataatccgcattatcgcagttggaagtgatgatgtccataagtgcagcaacaagcatgctccttcctttagaatggtctgagacattgaatgaagagtattccgagttctgtattaacaggagggcaatatattaggtacaaacaactcatattgtgttaaagtccaaggaaaccagaactggaaaatctaaatggtttaatagacctacattgctagattaagatgcgcatgaaacataatactacatgtataggggaaaaaaagaagagataagctgaagaaaaagcactgccagcaagcaaaaaaagaaattgcctataggagagctgagatcaccaagccatcaaggaaaataaattatatttaccaactccaaggtcttgataatccattagacataactgcattattgcataactggcatgcaggtgcataacataactcattcccccatgagatcttttatcttaacatcaatagcatatattaagagtttgcaatctgaaaacctgaagggccaaaggttccatgctcacaaagacatgggatgaaaacataaaaatgccagaaacctcagagcacacgaggatgcaaattttgttttccacctataat

SEQ ID NO: 87927 - DNA, 629 bp, Oryza sativa
tactccaatgtctgcgcgcggttgaaaatacgaattcgttcatttgcatcgaactcgggggctgctgtcatggttatggataccacatacctaatagtagttgactaaatctcggcaggacccaccacataccatgtcctatacgaaaaccgacttcagatatggagggagttccgaataaggaaagacaactagagttttacatggaaacgacaaggactactcagattgtatccatattggtttccctagttctacttggacaaggggacacctatgggtataaatacaagcctccctaggaggacaggggggacacccaccatgagacgatcaacacgatcaccacgatcgggacgaccacctcatcaacgcccaacacaatcaacatacaagcctacatacgccaagacacgctgccagatatcgactttagggataggcatggctattcccctacggtatctccggataccggcaggagatacgaaagcgctatctctgatctcgccggcaccgattcgaggaggaagtctaccctgttggtgaaaacgagtcagactttcagtccaacatgttgataacagttagataggctgcccacatattgtactggtgtgattatggtg

SEQ ID NO: 87928 - DNA, 642 bp, Oryza sativa
aactattttcagtttaatttgttatttttgttgtaacatgtagaagttgaatttgattttgcatgttgtcgatgggtgataccccgtaggccggatatagaggttattggggtacgctggtacaaggatctatgtaatacgacatcaagcagacaaaagacaaagattatactggttcaggctccttgataggtaatagccctaatccagttgatgtgggattatatgatggaaaacacaggttacaaagggaacaatggaaatcgacggatccggcgagatcatagtcgagttggttcgactagatccctagcggtttggctccttgtaggctccgacttcatatgctgtgagggttgtgttggctctgagattcgatgcctcaggccctccccggggggtcccttttatatcacaggttaggcggtttccaagtagaactcggaaacatcgaactttacacgatacattgatgacccagtcttgtccgagtatgactccttccatttgtaaactccgtgaggggtttccttaatatatgcggagagtatcagaataggagtgggtatcccataccgatatgagacgtatatcaaagggtaaagggtatacctaacccgtaaccctgacacatgtttgtgg

SEQ ID NO: 87929 - DNA, 518 bp, Oryza sativa
aaatattgccaagaattgatgacctgtttgatcagctaaaaggagctaaggtgttttccaagatagacctacgatcaggctatcatcagttgagaattcgggaagaggatattcccaagacagccttcaccactcggtatgggttgtttgagtgcacggttatgtcctttggactcaccaatgcaccggctttcttcatgaacttgatgaacaaagtgtttatggagtttcttgacaagtttgtcgtggtattcattgacgacatacttatttattcaaaatcagaagaggaacatgagcagcatctccgcctggtactcgagatattgaaggagcaccaactatatgccaagtttagcaagtgtgacttctggttatcggaggtcaaatttctgggtcacatcatttctgctcaaggcgtggcagtggatccatcaaatgtggagtcagttacaaagtggaccccaccaaagacagtttctcagatccggagttttcttggacttgcgggctattac

SEQ ID NO: 87930 - DNA, 723 bp, Oryza sativa
cggtgagcacgatgtcggcggcgcccctcgcggcgtccgtcgcgtcggagacggcgatgccgatgtcggccttcttcagcgccggcgcgtcgttcacgccgtcgccggtcatcccgcacacgtggccgccccccccttgaatcatcctcacgatctcgtacttgtgctccgggaacacgccggcgaacccgtccgccttctccacgagctcctccaccggaacagccgcgccgccgccgtcgccgtggcggccgaacagcgacgccgacgggtacatgttggtgcccatcccaagacggcgggcggtcttcttcgcgatggccaggtgatcgcctgcaatgatcaagaagcttcttggcgttgctccattgacgatcaagaagcagtacgatcatcgcgtgattataccggtgatcatcttcacgcagacgccaagatcaagcgctcggcggatggtgtcggcgctgtcgtgccgcggcgggtcgaacagcggcaggaggccgcagaacacccatggtccgcccatggccgtgcttcgatttccctggcacctccttcactcaagccatcagatcagatgaactcaaccatcagacagatattcattagcaacaagtaaactgaactgaactgaacttgatggtgctacgactacctggtaagcgacggcgagtgaacggaggcctctctctgcaaatctgtcgatgattagctgcacctttt

SEQ ID NO: 87931 - DNA, 695 bp, Oryza sativa
aatcccttcctgtcacaaaaagaacaggggacatagtgttcactggctcaacatgcaagcatggggagattgaagctgttgtcattgcaactgggatacactctttctttggcaaggcagctcatctagtggattccactgagggtgttgggcattttcagaaggtgattcatcgatcttcaaactgtaataagaatctcacaagtggatgtgctgtaagctatttctgactactgaattttcaggttcttacctccatagccaacttctgtatctgttcaatcgccatcggtgcgattgttgaggttataatcatgttcccaatccagcaccggtcataccgggatgggatcaacaatgttcttgttcttctgatcggagggataccgatcgcaatgcctactgttctgtcagtcccacttgcaataggttctcatcacctgtctcaacaggtgtgccaagatattgttatcatgtttctgcaattaacagacagcatatcacatatcattgttacaaaaatacggtagtaatttgccgaaaagcgatggcggaggaagccatgctttgaaagtcggcaaatgcagggggtcccttccgttacctcttgcaggtcgtggtaggcaaatctagcacgagatatccccattagatccccagcttccaataccggtcccgtgcttgtttttcttttc

SEQ ID NO: 87932 - DNA, 764 bp, Oryza sativa
cctgaaagatagccatgaccagaagaaatttaaactgttgtgattcttgcagttaattgaacggtttaattggcgcctacctggttacataggagatgggtatgatagggaatcgttttgccatgttgacgacgttgttaatgggcacatagcagcaatggagaagggcagaccgggggaaagatatctccttactggagaaaacttatcattcaaacagattttcgatatggctgctaacattacaaatacgaaggcacccctattccatgtacctctctggttgattgaaatatatgggtggatttcagtttttatttctcacatcactggaaatctcccacttatcagttaccctgtatgtccagtattcttccttatttaagtttaccatctccagataggtcatgctgttgtgcttactagattctcaatgtggattgcagacagtacgtgttcttagacatcaatgggcatattcatgtgataaagccaagagggagctgggctacagtccaagaaacttaactgaaggtctatcagagatgctcttatggctcaaggatgaaaaattgatcaagttttagcactcaccccttgtgctaacttgtgctgcattccacaccatgtaaactgagatctgatttaaacctattaactgtaagatgtacatgtttggtgtggtgttaatgttgtatcatatcagtaataacttgagatgtaacatggtagtactggttccatggaagaaaggaaaaacatgt

SEQ ID NO: 87933 - DNA, 1086 bp, Oryza sativa
  unsure (1)..(1086): unsure at all n locations
gcatgttgttcaagcagtttgatttctgtaacacctgcgtcgtttcctttttaatgctgctatctgctaatcatttgttttttggaatgtgaaaaatttcagatgagccttggcctgaggctatggtcgtatgtccgagaggaggcttctcatggaagggtaccatcggctgttcttatgctatttatatttcattacttaatggaatttccttttatctaaaattataccaaacatctatgaatataaattgtgtgtggtgataaaatggggtctgctatgcttgcagaaagctccaattgatccgtttaccaaagagaaatgtaagccgtctgcttcgcagggcgtaccgcttggtgggatggggtgtgtccgcctgaattgatgttttaacctccaataatctcatgtttatgcttgtctatttgcactatggatgctgtaattttgataccaatacactggttttgcaggagtggtagcatttcaagaggtttcaggggagagttcaagaattggcatatcattcctggtttatgtgagacttccccggtcatggagaaccagttttcagtaatgctttcttcttctttctgctgttgctggttaatcaacttggtttatggtgatgcataattgaattttggaccattagctagcttatctgaaggattttcttctgactgctgaaaatgctcctagcccctcactagtcactagtattatttttggggaaagtcttatgacatctacccttcactggtgtctcacatactcatattatggcaattcactaaatatgcgtcanaaagaatcttttaagtgctatctttgttgtgccggctgtgctcaagtgtgaaatcaactgttgagtggagtgtttttggggacctttgttgagataaaaaggcacgactgtttccactgtttaatgtttgtggagggacgagttccatctgctgcctgggaccctttttgatgagtgtggtaatcagtaagcaagttcttggtcaattcgccagttattacccacttatttttcctatcgatgtatataaacttccatggatgtgggacacccaatca

SEQ ID NO: 87934 - DNA, 976 bp, Oryza sativa
ccgtgatcaaggacattgcacaagttcatggatactcgaatgactctagttacatatactattcccagagtctcaagatctttgagggcagcgcgagtattcgagaaagccgtgatgcagaaaggagtgtggcagattctgataaagttgacgatgcatcaatagagagcagaaacgttgatcgagatgcagaaatcgatggcttcttcagctcaaaattagtggagacaggaactgccaggagtgaagacaatgtaccggataggaatatggagaggttcatgacaagatccactggccgccgattgcataagctggaagaagtccccgaaggagatgaggatgaggaagaggaaggtgcagatccagtagttctgattcctgatgatacaactaaatctgacaccgtactggagaaacttcatcctgttgttactcatgatcataatgataaagcgggatccaagatgaaaagggatcctcctgcaaaaactgctccaggtacttctgttattcaatctgctgccacaatgtgtcataagttggtccgagaagggtctcaagcaatcagcattactgaaactgatcaagatctgagcctcgattcatttcgaagcaaagaacatgcatctagtaagcagaaagttgacacatctggttctgtcatagaaaaagtaaaggaaggaagatataaatctgcaaatatcaatgaccgtaagcacattgagagagttcatgactctgcaaataagatgtcaactacttctgtggagaaaagcattcccgaaacagtcaaacctatgaaagcaacaaagaataattctaaagcaacagactatcatggaactgagaataagtcacctgatagtttggcttgttccaggccaacaataagccagatagaaaaggatgtttctgatgctgataaggctgcaaatcatccatccagcgcgatcacagagaatcgtctacccaa

SEQ ID NO: 87935 - DNA, 912 bp, Oryza sativa
tcttgaacttgtcccagacaaggatcaaggcgcttccagaaaccatttgcaatctgtggagcctaaaattcttgttgctaagagagtgcaaggcattgcatgtgttgccaaaagggatagagcatctgaaggggctcagagaccttgatcttacaggtactgtgatcaaagacgcggcattcagagtaggccatctcagaaacctcacatcattccgatgcttctccgtgacgagcaaagaggcgcgtaccgtacaggataccgcacaggataggagtgggtggcctctggatgagctcaagaacttgtgtcagctaaggacactccatgttaagaggcttgagaaggccactagtcagtccaaggcagctgaagtagctcttcatgccaagacaggactcagagagcttgaactgtcgtgcagcggcaccgtcaagacattacagataccgacagtggtccgaaatatagaggatatcttccaagagctgaaaccgccacgaggcctcgagtcgctgaagattgcaaactactttgggacaaagttcccgacatggctgtcatcgacctgcctgccaaatctcctccgactgaatataaccggatgcaatttctgccaatcttttcctctattaggtcgtctgccagagttgagatctttgtgcattgccgattcttcagcgctgaaggatatcgatgctcagcttatggacacagacaactcccatcaggtaccatttccaaagctggaagacctgcacctgcaaggtttgcataatctggagacgtggacgagcattgaggcaggggcgttgccatctctgcaggctctgcagcttgaaagctgccccaagctgagatgcttaccagatggcctcaggcatgtgacatccatgactgagctgcgcattg

SEQ ID NO: 87936 - DNA, 677 bp, Oryza sativa
tcaccagttgcattgtttgatcagagactattttcagctatcttgaggaatgatgtggggtggtttgatcaagaggagaacaattcaagcctcgtggcggcacgcctttccacagacgcagccgatgtgaagtcggccatagcggaacggatatcagtcatcctgcagaacatgacctcacttctcgtgtccttcgttgtgggcttcatcatcgaatggcgggtggccgtcctcattcttgtcaccttccctctccttgtccttgccaactttgcccaggtaaaacaactctcaactcacaatattttcgttaacatggaggtgtcattctattatgtgccttttacgttctaacctggattagacaacgtgctaggaatctttggtggaataggagaattaccctttcacattaaaccgaatagtactttgcacgacgaactcactgagctcactgcaccgttgcgacgccgttttcggcgcagacaaccgtttgctgctcaattactccctccggagataggatgccagattaaatccatcagcattgctatggtaggatccgtggcccatgccactgccactgcttctgccgccgcagctgccataaattactgtgcgcggcatgtgcaaccctgccaagatgctccttggcctcctctctgcaaaggcaaagc

SEQ ID NO: 87937 - DNA, 1787 bp, Oryza sativa
gagactcatttccatcatactaacttttctgaatttggaaaggcattttgagggcaatcagttaagtggaccaatcagcccatcgctgggaacactcaccaatctcaaggagctgtaagtatcctaaccctctttttgttgcatgtccaaacagctgataactcttagtacttgcctcatgcatttgctcctgcgaaagacagatacctgaacaacaacaatctcacggccagataccagagagcctgaaaaacaaacctgaacttgacatgaggtatgattggggaacaaagtcttcacattttggatccattttatatgctgatggtattgcttttgcataaaaaaaaaatatatatatatatatatacaggactgaggggaacaaacttaattgaggctggaaaggaaggaatatctgagatgatcatttccaatctaatgttacatttatgtacagaaagatacagtttgatggatgaagggagaagagcgaaggcttcaaaaactgtaggatgatattcatgtttaatgctgtatgtgagttgaaagattgatgtgatatttagcatcatccttttgatccattttgtgttattagtatttgttgtacatgctgcattagatggcattagtgtaggataattgttaggtcaaagaagcagttcataatctaaccaatctaaacgccaaaagttgtaccatgttccatcaaaacttaattaggacagaaacatgcagtagccagacacataaacagcagatactccaaatctgtcagctaataaactcccgagtgtcgaattggcagtaattgtggacacaccaattacaaacaacataagagtggcaaattgttccttctcccaacatagatatgggctacatgatagatgctctgcaaactagcagagtaacagattaagtgcctaatggtaatactaacagatgaggcctaaacctacccaaaatgcaatttttcgtctgccgatgtgttagtagtgccgtctttgttgatgtcacttggttacctcatttccatcatcaacagtagctcggataatatgcacctggacaaaaatcaattttcaaggattattcacattattcatatataaaacatgcttaagttacaggtacaaatttattcagacatattgttcagttcagtaaaaattaataccttgaaggttgtaggcttgaccaactgaaatactgtcgcatctccatccaacaatccatggtccaaagcaaagccagcccagccaccacttaggccattcttgtaggcaaggtaattggtatcaaattgctcgtctttctcatccaacaaagtgacaatggcatcatgttttggcaggtaagtctcgcagaaatgcctcggtaagcccttttgatcatgccaccaaacaagtattagtaccacatgacaacagttccccttaaagaagggttgcagggatgggaatgtgatagtgcagtactcaccaaccaaaatcctcggaccacatgtgaatgtagcattggcttcacgaaggagggaaattcagggtcaagttgtgattccagttcctctgcttttcttgctgcctcgagcctagcttccatggaaattgatccacgggttgccaagtagatactgtcaattgcttttcgtggagacctgcagaagaaatcggacaacgggatgtagttttgcaccttttgctacttagtgggaggcaatacaggttcatacgctcatgtggtaatgttattgttatcacataatgacataccttttcatc

SEQ ID NO: 87938 - DNA, 643 bp, Oryza sativa
ccatgctgaaagaaaattatggaatcacaagctgctatatgtacctatgaattgaatccttagttttttttttgttcaactcattgattgttcttacttcttcttccccctccctgtaaatataatgttcatcctaatcatcaacagagctgcagcaaatggcgataaaattaattaactaaccgatcgcttaattaatccatgcacgcaagcaagcacatgcaatatcgattgattatattggttcttgagagatcgatcgaggaattaattggggaatttgatggatcgatcacaagttcatcatgtccttgacgaagccgtacttctccatgaaggggttggcgagctccttgggagggtagtggtcgatgcagtccttccagacgccggcgtcggagacgggcttctcgacggtccagacgcagctgttgcacttgaagccggcgccgaaggtgagcatgaggacgcggtcgccggggcggaggcggcgcttggcctccatgtagccgagcacgtaccagacgctgctcgccgacgtgttcccgaacctgtgcagcgtcatccgcgacggctcgaggtcgtgctccgtcagggtgagccccttgccgacgccgtcgatcaccgcggcgccgccggtgtg

SEQ ID NO: 87939 - DNA, 549 bp, Oryza sativa
gttcccgctcgacctcaactacaacggaaccgacctgtcgaaactagatttcggcaataataaaagggggtggctatcaagctaggaaagtgtatgggtttggagacaaaggatttatacaggttcaggccttcttacaaaagaagtaataccctactcctgtccggggatgaatccgccgagtgtgttattgattgtatgatttggagaaaatccaacctccgcccctagaggcacccggaccccccttatatatgggaaagagtccgtgttacaaaagataatctatattcctaacggaatatgtaaatacagataaaatacagtcgtgaccgactaagtctcaaggtgtttccttgatgtacaagttaagaaacaaacccaggatacacataagatattctatctatattcggtatcctatatccagtccaaatatcatcgccgtgtagatatgggatatccataatctccacagtagcccccgagacctttgcagtcaaccatcatagccttctcaaagataataatccgagtgcttcaaaactt

SEQ ID NO: 87940 - DNA, 681 bp, Oryza sativa
attcctgcaccccaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacacccggctccgcatttggcaaaaaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcatttaattactttttccctttaatttccccctttttttttttccccaaaaggcccctatggtttttttttcccctttttccccctgatgtgagacatctattaacctaagccctaaactctcttttgtaattgccaatcatcatcaacaaaatgaacaactacgctaagataatc

SEQ ID NO: 87941 - DNA, 1678 bp, Oryza sativa
tgccatctatcgaataacagcaaaattatagtgacatttctccaaatagacgaatagtaataaaatatttcaaaatcataaaagttataatggcatggttccaattaatcctaaacattaccagcctataatgagctagtagcccatataagtgcaatttgttggctgaagagtttggtggttgagttgatatctacaagctagctaggaaatcatgaaattttatcgttctaaccaattttaaatgcaaatttctaattacgttatgtccgctttcatatttataaaaagttcatatttctcaaaattattggttggttatgaatctacttttgactaagacgttttatacttcttttagatatttaggctgtgttcggctggctaagttcccaactggaacagtgcgcataaaaaacagagcgatccatttgcacgtgggtaattaaatattagttatttttttaaaaaaatggatcaatatgcaattttcgtatagaactctttacaagaaacacaccgtttagcagttcgaaaagcgtgcacgcggaaaaggaaggagaggtgttgggaacctggatgcccgaacacggccttagtgtatcaagaatttgaaattcttaattaagacaaattcaccatctaaggacaagaaaattgttatagtatgtgtagcagtgttcttaattgtatacttgctctccctaaagttaactgtctttttgggatgtgtgcagtaccatgtttaaactttgacaattaatataatatcactttgaatattttgaattcaacttttttaaaattgtatgaatagatttctgtatcaaaaatggcttcaaaatattataactttgctacactttaccatacctttttattttatactagtagtgattactatcagaaaaattcttttggtgacttgatcaaaaacatgctgcaaatggcataggtatgggaattgaacatattatattggtcacgctttgattcatacccctgatcgtacattacatcttaaaaatattcttcatgttacccaagccaaaatgaatcttatttatgcttctcgtctagctgaagataatcatgcttttcttgagattcaccctaaatattttttgttaaggattgggtcacgaagaacacaattcttaaagggtggcatcaaaggggcctctgatgacgctctctctcgtggcccgatcttctggtgaggggataactctcgctttgatcgagtgcgacgtttgtgacgtggctaccaattagaacatgtccagaatgccgtgcaatcgctaaaccacaaacgatgttgtaccaaccgtggcgcgcggttgatgatccctgcaatgcaaatgagagaaccctgcaagaacaagataagatgcaatctaaatattgcgaataggtaattaagcacaaagaaatggttgcgattgaagtggtagatccaatcgacccgtcaaatcaacacaccgaatattgggggctctgaatctatagtcgccgactagtagagcgaggactagagacaaggtgaatagcacttagcaaaattcaactaaacaaaaccccattgtttttcaggatgtacaaagctatttatagagaaaaataaagctagggttaagtactaattcgtggaggtggagggagaaacttccgagatggg

SEQ ID NO: 87942 - DNA, 662 bp, Oryza sativa
ttctcttcgttcaaatccagcgcccgaacgcgagaagtcgagaaagaagcggcagcgacacgggcgccgcccacaaccaatgcatcgccgcggcggcgtgcctcacgggtcccgccccccaacagctgcgccgccgcctctcaccggtgagtctcctccccagccgccgcctatcctcagcgaaaccctaggcaccgagccggccgcatcgacgcgtacgaccgtgctgtgtccgccggtgaggtgctgacggcgcaccccaaccacgtgcttagccggcagtgctcgtcgcagcagggggcgatgggccggatacacatcgtgtcgccggagtcgaagctggagtgcggcgagatctacttcctcatcccggccgcctccgtccccgacgccaagagaaggacgagcaccggcggcgccgccggccacgggcaccacgtccgcagcaagtcggagggcaacgccgccgtcgccgattggttgggcagccagtgcagcgcgtcgccggagacgacaaggatgatgagggtgcagaagcaacaccaccaccaacaccggcggcgcatgagcaccgggagccatgcctcgccgtggcagccgcacctctcgtgcatcactgaggacccctgagcttagctttcatttttttttcttctcttctc

SEQ ID NO: 87943 - DNA, 589 bp, Oryza sativa
gtgtattcacgttgggctcttgtgtgttcaagatcatccgaatgatagaccatcgatgtcatctgttgtttttatgttagaaaatgaaagcacgctgcttcctgcaccaaagcagcctgtgtattttgaaatgaagaaccacggaacacaagaagcgacagaagaaagtgtgtactctgtgaatacaatgagtaccacaacactggagggacgctagactaagaggtcaagctttactatacatgatctcctcgcctgctcttcgtctctgtcgcgtggggccagcggccgacgacggcgcggggctggcgggaggtgggcgacgaccgaccggagatagagaaggagaggagaggggctgacgggtggggcccacgttactttccacgctggcacggtacagtggcacgtcacatatgcaaaaatagcaaatagttaagaaattacctctctccaatggcaaattattaagtgcaatatttggataattggcaaacctcaaaatggcaaatagttaaattcgggtcaagattggatcggtaccctatctgcctctttttatgggccgaaaccgccgaatccctcgccg

SEQ ID NO: 87944 - DNA, 581 bp, Oryza sativa
ttttcctcctttctttcggatgggccgtggcccatctcctcctttcctccccctcctccctgctgggccggccgcaggccgaggcccagccggccgcccgcctccctccctcccggggtcgccgacaggtggggcccacctgtcggacccgtctcccacctcccgccttcccgctcgcgccgtcccgccgaaaccgctgccgccgcacccacttcctccgctttccccgcgcccacgccacgtcgccgcgcccacgccacgtcgccgccctctccccgcgtctcccggccgcgccagcgcacgagaggggcgggattcgattttgaatctccccccaccttctctctctcctcccccacgtcgccggcgaaatcggagcgcctcccggccacgtccgcctccccctccgcctataaaatgctccccatgccctcctctctcgtttttcgctctcaccgctccatcccgtgccccctaccgagctcgcaccgccgccacttacgccgccgcccgtcgccgcactccggccgtgtgccgccgtcgctagagccgccgccgcactaagccaccgccaccactag

SEQ ID NO: 87945 - DNA, 697 bp, Oryza sativa
  unsure (1)..(697): unsure at all n locations
aattcctgcaccccctctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattgnggttgtgtcattttattngnccnnccctaccgagatccatcggtgtcgaacaatagagcccacttctccttaggctcattctcaatccactgagagaaatttctgatggccgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagaaagccttcttttaaagaagaaatncccccccaatttttaaaaaaaagggggaaaaaatttggggcttgttttttccttttttttgggaaaattgcttgtagaaatttgcacccatgtgacgcatgcaccaccgactccgaacatcaggccacttagctggaagtcccttctcatcccaaccgtt

SEQ ID NO: 87946 - DNA, 679 bp, Oryza sativa
  unsure (1)..(679): unsure at all n locations
ttcctgcaccccgttttttactattacattgatttcctgaaaaatcctttggtacttattactaaaactgttaagcagtggttacatgtctcctgaatatgcaatggatggcgccttttcagtcaagtccgacacatatagctatggtgttatactcttggagattgtaagtggtctgaagattagcttacctcggctgatggactttcccaacctattagcttatnngtaagtaccncnattnngggcgaatgctctatgtccataaaaattcaaaataactataccgcttttatatggactgatctatttcactgtttaggcatggagcttatggaaggatgacaaggccatggatttggtggattcatccattgctgagagttgctcaaaaatggaagttttactatgtatccacatagggctgttgtgcgtgcaagataatccaaataataggccacccatgtcttctgttgttttcatgttagagaatgaagctgcagcgctttccagcctttccaattacaaaccccccctttggggttttggggtttttaaattttttttgccaaccaaattttaaggggggcctctggagcaaacaatcaggaggaaataccagcagctctaataataacatgagcctcacggtattagaaggacggtagatttacttttt

SEQ ID NO: 87947 - DNA, 582 bp, Oryza sativa
atggatctcggtatggcataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgataacaacatagtgtttggcaacgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaagaaagaagcaatctttcatacatggagtgaggagatatatgggttcgggatctcaggatcttacacaacgctgagtgcccaagttttttatattccagatccatctaagttaa

SEQ ID NO: 87948 - DNA, 1066 bp, Oryza sativa
ccttgtttcagtttccatgcttattgttgttgcatgataatatttttggtacttgtttttccctaacatttatatgtgcagactggcaaactgagggaagaaactaaggaagacatttctattgcgaaggccattgcaattgttatggagagaaatccacacttgaggtttgtaccatccaatttctgcccatgtgcataggttatcctgatcttttggtcattttgcctgacctgtccttgttcacaacaggcaagaagggattgctcatgatgttcttcagtggtatttgtgccgcatggaaggttggtttgctactgatgcggacgcaatctctcttcagggttgggaccaggtaggactttggttcctgatatcagctacaattgccaatattttgctcatgatgtactcatgctagtttgattgctatgtctcatgttcgtactgtgctgtgggtgcaggaggtactgcttcctggtggccatggtctcatggttcgtggatatcgtccagtaataaatactctggcaaaaggcctagatatacgccttggccacaggtatgcatatccatttagtttttccttctcactttaaaagcaaaattcatggttccatccaccattccttattgctaatccacattattttcttttctttagggttgttgagattgttcgccacaggaatagggtggaggttactgtaagcagtggtaaaacatttgttgcggatgctgcagtcattgctgtccccttaggtgttcttaaagcaaacaccattaaatttgaacctaggctgccagagtggaaggaggaagcaataagagaactctcagttggagtcgagaacaaaataattctccacttcagcgaggttttctggcctaatgtggagttccttggagtagtttcatccaccacatatggctgcagctatttcctcaacctccacaaggctactggccatcctgttctagtttacatgcctgcgggtcggcttgcatgtgacattgaaaagctgtcagatgaggctgctgcccaatttgccttctctcagctgaa

SEQ ID NO: 87949 - DNA, 587 bp, Oryza sativa
catgtgtcccagcaaatcttttggaaatgaaagaatgcgaggcacctgaatcaaagagaactgttgctggatatgagttcactggaaacgtgcccaacacgacctctggtgctgcctgtgcttcctctgcagacacatgattggcgcgggcctggatgaacctgggtccagtgcgattcagcttcggacacttgccagcaaagtggccgtgcttgccacagttgaagcagggtcctggctttcctacagcccccttcttgggttgttctgactgaactgacacagttggcggatctgactgagctggtgccattagtgggggtggagtcgagttgtggttgcgctgcttactgttgttgtgactgccaccgttgtaatcgttgtcgaagttactcgggtgatagggacggtgctgacagacgatcagggtggaaggcccacctagctgtcccgtcatgaagcgaggcttctgattgctcccctgaggaaagctgatctgagctggctttctttttcggtccattttgttgcgttgctcttcctgacgaatagccctggacacaagcttatcaaagtcctcataaact

SEQ ID NO: 87950 - DNA, 508 bp, Oryza sativa
aattcgagctcggtacccatccgcagaatttcaaattgttgaagctgacaagctacgaaagaaactgcacaatacaatattggtaattgtttcagcatactagcacttcttactaaaaacaatttctctattttactgacagaagaaatttttgagtaaatactgaaattttttcatcttgctattgctacttgttactgattagcctttctatttgcaggagcttaaaggaaacatcagagtgttttgtagggtccgaccacttttgcaagacaacgattctagtggtgcagaagaagcccttatttcatatccaacatcagttgaatctgccgggcgtggtattgatttgatgaaccaaggtaaaatcatattcattgttgaagctaaacagaaactatgtttcccccactaagttttcagtggtaaagttaatcggagacttcattttattgttttgtgttgatgtaggtcagagattttccttctcatatgacaaagttttcga

SEQ ID NO: 87951 - DNA, 525 bp, Oryza sativa
gtgacactatagaatactcaagcttgccgttcgccttgggaacgaccaccgggttcgccagccactccggatggatgacctcgcggatgaatccggcctccagaagtcacgccacctcctcgcggatgaaggcttgacgttccggggcctggcgccgcactttctgccggaccggccttgcgcccggccgtacggcgagacggtgctcaatcacctccctggggaccccgggcatatccgccggtctccatgcgaagacgtcagcgtttgcccgcaggaaagagacgagcgcgtcttcctatttgccatccaagagaccaccgatccgtgtggtcttggacgggccgtcgcccaggacaacctccttgactgggacctcatcgcacgtgactatccgctgcctcggggcggcgggggcggatgtgccaagcctctcgtcgccaccctcgggcttggacacgacggcgaggcggtccgcgcgctgctccatacaagcgagcgcgactttgaggtcgccatggacag

SEQ ID NO: 87952 - DNA, 1315 bp, Oryza sativa
ccaagtgtaacaagcgttactttgctaacccaatgagtacatttctgctatagacagatgcgctaggctctctagtgttagttgatttgtgcatatcgtcactctcaaacgatttatattacagactagttgtacactttgtgattcgttattacaggactgtttatgctgttggtaatcagatttactacaagcccatcaacatagctacggctgtgtttagtttccttcaaacttctaacttttccgtaacataaaatgtttggacacatgcatggagcattaaatgtggaagaaaaaaaaccaattgcacagtttgtatgtaaattgcgagatgaatttttgagcctaattaaacatttgctaataacgaattaattaggcttaatagattcgtctcgcagtttacaggcagaatctgtaatttgttttattattagtctacgtttaatactttaaatacgtgttcgtatacgagagaactaaacaggcatatgataccctacagaggtatctatttttggtcgaatggagggagtagattccagtacagcgagaggtgtggaattgactaaagtcagggttgctccagtctacacgcacgaccggttcacatcgaaattgactcgttgggtgccccggttgtccgggagatgaataatgtcacatacggagaagctgtcagctgtagtcatcgccgaagaacgttctggttaattgcttgcaagtactgtactacctccgtctccatctaatcctaggttatataacatttttggatggaggaagtattatcttagcatgaacacaactgcacaaggcacaaggcacatattatcttagcatgagcacaaagcacatatacctggtcatacatggcatgccgtagtcatgcccttcaagtccaaactgaaagttaatgaaaagcttcggaagattttcagctaaaaatttttctcctgtcattctagctggttgaggtgcacgctttcgatctatgtggacttgcttagctatgtaatctctttctactctcaatttcaaaataaattaacccagtacgagatataatatatcctattgccatgtaaagagatctcgtactaggttaacttatttgggacgaagggattattacagtacatttcagtgtgttacattgatcacacgtggactcggatcaatcaacgccccacatcggtggatgaaatagtaaccatacacaagtatgcttagaaaaatttggcagctctaaaagagtgatacatacacgcgaagaaccagactttgaacatgttcccacctaaattggact

SEQ ID NO: 87953 - DNA, 521 bp, Oryza sativa
tcgagctcggtacccttatattcaggcgctgcagtgaacactgcaccagtaatagcagactgggatgacaaagacagttcaagattcaattcaggcttatacaaagccctcctagaatcacaggcccggttatcaagcctggaagtaccttctttgcccaaagtaaaatgattcaaatccaaatcaatagaagaaccatcatcactacccttagcagaagatatggtgcagccagtacccatgctttgcttgctagattttgagcttgatgagttgcccagccctagtgacaagccatcaaactttgtcgtggtccctctaggcaggttgtatgaactgcaatgagctagcacatcaatttgactagaagctgtaggatgactgactgtgaagatgacagggaacttgcccacataggcattgggatttgaggaatttaagaacgctgaccgcccaagtagggggtccatagctagagattttctcagaaaacaaaacacagccaatttttttgccaagta

SEQ ID NO: 87954 - DNA, 582 bp, Oryza sativa
catggctagggaggatgaggaaaaaactgcgttcattacccccataggaacttattgttatacgacaatgcccttcgggttaaagaatgcaggtcctacttttcaacgtactactcgaatttctttgggtagccaattaggacgtaatgttgaggcttatgtcgatgacttggttgtaaagacgcgcaaccaggaaacgttactttcagatctagcggaaacttttgagagcctccgctccgcccgcataaaactgaaccccgataagtgcgtgttcggtgtacctacgggcaagcttctcgggttcttggtctctgcccgaggcatcgaggccaaccccgagaagatacgagctatagagcggatgcgcccccccagcaagcttagggatgtgcaatgcgtcaccggttgcatggtcgccctaagtcggttcatatcgaggctgggagagaaggcgttacccttatttaagctcctcaaacgctccgggccgtttacttggacggaggaggctgaacgtgccctcactcagttgaaggtgtatctcagctctcccccagttctggtcgccccagagccaaa

SEQ ID NO: 87955 - DNA, 535 bp, Oryza sativa
ttgaactctttccaaagaacagcaacaaaaataaattcatcgtcctcttcgtcatctgggctggagaggttgtagcgaccgacgacgacgatgtcggcggttgagaggaagacggcgtgcgtcaccggcggcaacggctacatcgcatctgcgctcatcaagatatgctgttggagaagggatatgctgtcaagacgacggtcagaaaccccggtgaggttctcctcctcattttttcactctctaagttcatgttttttgcagtgtttcttccattcagttcaggtgtgaaatcataggccagctagtaccatatgagctttttagcgagtgttttcgcttaaccaattagcaaatggcaggcttagccgcacatgaggacaaaatcttatccttttccaacttccagctgatagttacatatatacatatcgtgacatatgatggatcgaattattatgagactttatatgatctcaaaaagatggtgtgaattttcagagttcagtttcacctctcaaagattctactaatt

SEQ ID NO: 87956 - DNA, 582 bp, Oryza sativa
ctccttgccggactcagagtggcagctggactggggatccgccgcctcctggtgttaggcgattcccagctggtcgttaaccaagtctgtaaggagtaccggtgctctgactcgcagatggacgcctacgtgcgccaagtacggcgtatggagcgccattttgacgggattgagcttcggcacgttcccagacgggataacatgatggccgacgagctctcacggctcgcgtcctcgcgagcccagaccccaccgggcgcctttgaagaaaggcttgcccagccgtcggcgcgacccgaccccttaggggagacggatgcgcctaaccggcccccgaggcccgtcggagtccaggcctcgggacccgaggggagtgctcccagctcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcactcctcgggaacaaggcgttgtgcttctt

SEQ ID NO: 87957 - DNA, 623 bp, Oryza sativa
tggcagttacggaattcaccatcgccgaaatgcagcgcgcgttagactcatccgccgggaaagcgagggccctccgcttggggggcgagatagggcccggcatgttttgggatgaagtctcccatttggatcgcgccggtcgcaaggcgggcctttggaaaggccagacaatgaagtactccaccaacaagggaggcttcgttcagcacctttcgaagatggccggggttttccagaagttcccgaggagttcgagaagaccgtcaagtcatcctcgagggacttcgcccaagaagcgttggagctcgtcttggcgagttaccaggcaagggaccccaatttttttccgtgaatggcgctgaatgagttccttcttggaattgaagaaagcgcgggggggaaggtcgggaatgccgcggacaaattggtcaaaagtttgaagggttgggcccttgggttggggttggccccaaattcgaagaagaaggggaagccaacgggtgaaaaggcaagtaagaagagggcgggcgaccggggggaatggaattaagccccagggccccggttatttttaggttttttctttttttttattttaaggctttcaggctttttttttgtat

SEQ ID NO: 87958 - DNA, 827 bp, Oryza sativa
aacatacccttgatcttctttcggaagcatagcttcccaaatggaattagtgtagtcatttccaagttcatggaacaagtccattatcactggctcccataccttgacatctaatcgcaaggatcgaacctacatcaaataagtacatcaaaagcaatccttaaatatggaccacactactgctaaatctgaaaatcaaatgatatttgaaatctacaaatcacaaagtcacaagagagtgtattgcaaaattaatgttcttagctctgaccatcttatatgcattagaaaatacaattgaaaggtacaacaagaaacacaaatgagcaaaaatctaaaataaaatagttaatctttccatcaaattatcattaaggtattatatcaagtacatatagcattatcacaagaaactgtgactgataactacatggagttggtaatagatgcataagtatcaggatatgtgaaaatggttttggtagattgttcatgaaaaaaaaaacactttcatacaattatgtttttaatatttctataaatatatagtcagaaaataatgataaaacatgtgaattagatactgtgaattgcctaggttggtaccacagcctggatctcattttaagagtcgaaggttaacagaggttggagtcgatattcttatgatcttatccaagctttctgcttctaatttgatttattaccaccaatccaccattcctttttactcgatgttttggacattgacaaagtttacaacattacattaagccccaatcatttcagtaatgattaatggcaatagcataagcattaaactttaa

SEQ ID NO: 87959 - DNA, 547 bp, Oryza sativa
actatagggcgaattcgagctcggtaccctcacaatgttgttctaaatagatttgttttatccatcacattagacagatctatcggctcatcgagtattagattatcgtatataatctcgtgctgtatcggttaggttcgacctactatattgttgttgataatataaatcttgttgaactgataggttcatgctttatcggggtgctagccgataagttatctggatgttgcatcggcttataaggattacatataagttgggtttagccaatcgcaacaaatgttacactgtttaatctaatcttgtggattttacgacatcggacctgcagccgatgtatgctttaaccgtcggatcagtgcttattctatcatgtcaatgtcagccgattggtttatactggattaaattgttgctttcttgcattatcatcagccgattgcctttatgtcaatatctacattggacatatagccgattgctcaaaatcctatcgctatcggctggtatcggcatcggttggaattaatacatcggcttgtca

SEQ ID NO: 87960 - DNA, 1026 bp, Oryza sativa
ccagaacttgaagaagcaatctcatttgcacgaaaacaccttgaattgatgagtcaagacagtgttctcaaccctccattagctgagcaagtcaagcgtgcacttagcctaccactgccaaggactttcaagagagttgagactatttgctacatgtcggagtacgaacgagaggcaggaaatatcccaattcttcttgaactcgcgaagctagattttaacctcctgcaacatatccacttggaggaactcaaagcaatttctgagtatgcctatctatcaatctctttgagaattctccactggataaataatatgcggctctgtgcatcgtagatataacggctatgtgcatccattatctaaaaatataattaatatgttttttaataataatggaatgaactaaataacttaattattatgtgcaactgaattaacagtatcgatgtgtttttgcaaataaattattatgatagcatgaatatattgtcagtagtaatgcaggttattatataatctctgttttttttataatacctgtcattttagcgttgaattttatttgaagtaaatccacatccattattttggtcttatcacatatccaatacccacaagctagccgttaaaataaaacttagcaccttaattgtgaatataattaatggtcttgtcacacttttgaaataattaatttcagatggtggaaagatctttatggatatatggagctacgttacattagggatcgtacgatagaggcatacgcttggtcctacatgatgttctacgaagaagactttgcattcaccagaatgtttgttgccaaaataattgcactggatactgtgatggatgatacgtatgatgctcatgccaccgttgaggaatgccggcagctaaacacagccatacaaaggttggataagttcagtttgttttattgataacacatatatgataagtgaagacaaacagtaatatcttagcctacaaatattcaaaataagatatccaaatttg

SEQ ID NO: 87961 - DNA, 2184 bp, Oryza sativa
cagtagattctcccaccatgatacgcaaagcaaaataagactgtcagtgtaatcgtctattggctaaactgaaggagctgactttcatgggtgttgccaccaccagaggagcctcaggggagtcggttgttgcaaatttctcgtgcatgaaacggctgtcaacaatggattcgtctttcaggacaactttgtaacaatagcagctcttgagcccttcctgatcgcggtagcactcatggttgctgtccttcacctgctgaaagttccaaatgacactaaatttgccaactgtcgcaacaagatgcttttcttgcttcccattctctgttacctgggaaaatcagaacatatagaggaacatacataaggacatatacttaacaaattgaataattatgcagcatgtaggcattaatttagcaagaaagttaacatggcaaatgccaaatgccaaatggacataacagaactgcaggatgaaactttttataatgcacgattgacgtaagtgaaacaactgattgccactagaacaaaatcaacatgattgacgcaagtgaaacaactgatttactgcaattacttcatacactcttatgacaaggtcacaggttgatccgttaaaaacagagctagggcctaaggtgcagggttctttactttagttctactcattagccccttgacaagctgagaattggaacttcaagcaaccaaatgttccaaacaagcagtcaataagcttgtttttaatttaacaagcttatgtaaatattgaacatacttgctaccaatgaattaactgaaaacatatttattagccgtactaccctaaactgggatggatcataactttaccagtttctcccaaaaggtacagcatgattatttcaagatattaatgtgtcaattaacatacataggagatagagacatagagtgaacacattttcctggtcagattgtattataggcacagcaaattactgacaagcagccattttggatatgaaacgcttgcactgactgatcataagtgaaaacaaacttttactatagacaagatagataagtgtagatggtttgctagcatgcacatatgaagcaacattctgtttggctttactagattacaaaataggaacattcactaccgtgtgttctatctcaattatgaaaaacaatatgctgtacaaaataggaaattcacacttacccaagagaactgcccgccatggaatttgttctcggaccctgccaaaattgaatccaatggggagagcttcagcaatcttggtgctgcaatcctatttcccatacgcccactgaatcctgtcttctctttaccatccttgtccttaaagatggtacagatcaagatcaaatatgtatcagtagtgcccagaatccacttcccatcataagtaacatcaacatgtgtgattggtgatccaagccctgggaatgctgtcttcgccatccgcatcgaactcttggaatagagcctaatcttgccatccacagaaccaaccacaatcgaaccatcccctgtacttgcaaagcattggaaattggtgccccttgagaactgatggccctgcgaccattgcagcaccggtgactcagatgagctcccaattgtttgcaccctgcccctggaatccctcatatcccaccggcatagccggttgtcatccaatcctaagaaggttgatccagagggttccagctgcgcgcccttactgtcgttggcgatgtctcgcattgtgatgtcagttccatccttctcaaacctccactgagccacaaccttgccagtctctatatcaacatgatggacgccattggaatggcgagtgccagtctctccagggctcatcagaagcatattcgtctcgccacgcataagcagagccttctgcggtgtcatgtacgcgttcccaccaccacggccatcagatatcctcacagagacgcccttgccgtgcacgccatgccggaaattcttgaccacctgtatccctgaccctccaaccaagaagctgttgtcaagcgcgcccagcgcgaggctctggatgctgccgtccccggcctcctcctcgaactcctcgagcaggtctctcgccggggtcgcaacgggaggggtgaaggagtcctctgcgtcggcccagacggcgtccgtcg

SEQ ID NO: 87962 - DNA, 18197 bp, Oryza sativa
gtgttcactggcagctgtagagggcaattctcggtcaatttgaatatttacaatcatcaactgtagatgatcttgttcaaatatagcttcctttcaatcattcaatgacatcaaggtttcgtttgaatttatgtctttaaactcattccaatataacatgtaattttaaccagctagtgtttattatgagtgcaccatgaaaccaaacaggtttgggatgctatccacaccatctaaactatttcattagagttgccagcagtgaaccaaatggcaccttagttggttcggaattccatctcctgattgctgccattcaactcaacaattatttgatttctcacgatattagttgccactatattccctagcattaaccggcgatctgtgttacatgcatataataacatggatttacaaaagtatgttttgtgatgcaggtgtctctgttcaaaaggctgcttcaaatggtgaggaatttgagagcagaatcagatcgtatgcatgcattggcatgtatttgtcggactgctctttgtgttgatctttttgcaaaagagagtgttagaagaggtcagaagcctgttccaggaacagatgtgatctcactatttgaggatgcaaatgtgaagggtgatctaaacagcataacgagcaagagcttgttcagagaggagctagtcgcttccctagtcgaaagttgtttccagctatcactccccctacctgagcagaagaattctggcacagagagcagagttataggagcattagcttatggaactggatatggtgcattgaattggacagaacctgctttggatgtggtggaagtttgcaggccttgtgttctttgggactgtggtgggcgtacctatgcaattgattgctatctgaagttgcttgtacggctttgccatatatatgatactagaggtggtgtaaagacaatcaaagctggtgcatctcaagatcagattctaaatgagacaaggcttagaaatttgcagctacagcttatcaaggatcttcgtgaggttatgctcttagttaatcttaacttttaaaatctaaacacgatggcatgtttgttttacatgaacccacatagttctttatatttgttgaatgttgatgcttcgttcatccaccaaataaataaaacagtggtttatctattttatactatctttatggcaacccattagtttttctctgttgcactgaactcctatataatattacagtacatgattttgtttcttggcatgcatcattgttatgcttgtccttgtcttttccggcctcatggatctgactattgcaaaaacttgtgctctaaagtacatttcccataaacttctctcgttcaataactaaaaagcatacactttgacaaggctttactttagtttagattatattatggctgtctttgctgggctttccttttgctcttcttccccctttcttttttcaaatatttataaactagaactgcatcatctgtaaaagattcttttcctagttggtaataatcataaagtgccgatgttgacatgacttctactctatattctacttttattgcaggttcatacaccaagaatttcaggacgattgatatgggcaatttctgaacattttgatcttgaaggtctggatcctcttttagctgatgacccagaggatccattgaatatcatcatatctaacatgcataagattctattcaagatcgattcatctacaactacctcaagtaggatacaagatgtgcagtctgtcctcatatgcgctcaacgtttgggatcgagaaatgcaagagcaggccagctcctcactaaagaattggaggagttcagggcaagtacttcagctgattctgtcaccaagcatcagtcgcgttatgtcttgcaaataataaaatatctaacgaaccatcctgataacaggtgagtgtattctgaaactcgagtaactaattctttcacaaagggtcaccatttatttagatatatactgtcataaatgttgtacaacagagaaaaaaatctctactggaacatgcattaggaaattatgaaatgtctaactttccaatatttattcaggtgggttggtgtaggtgatgctacaggggattatccatttagccaccacaaacttactgttcagtttttagaggcatctgcagcacaagataggaaattggaaggattagttcacaaggccatcgaagagctttggaggccaaatcccactcagttgactctcctacaaatgaaggggattggtgctttgcacaaagagcttccaaaaacactttctttgactggcagcagtgatccatgctatattgaggcatatcatctggcagatccaactgatgggagaatcaccttacatctaaaggtatggcctgatcgatgcatctttcccttgtttgcttaacagtatattcattttattgtacttttctgttttggtctctgttaaatgctgtttagggacaatttagctcttaacgtggagatagttatcttggggggctggggtaaaattgccagcagttttttgccaacactgtaaatactatattattaaaaaataggaaccaatattcttatgcaacctattggccacagttttctcattttaaggccatattatgtgtggccttatcatgatggatcttcagtgttagctccagcactgtgcaattgtatttttgtatttgttacctggtagcaggtaggttgattttagaagttaaaacaaccatgtgtggttccacatatatttcttttctctgaactatagaattttttgacctggaattgtattatcatgttgtttgactagtttatgttgttgcagattttaaatttgactgagctggaactccacagggttgatatcagagttggtctctctggagcactgtattatatggatggattctcccgcacagttcggcacctacgtaatcttgtttcccaggtgcttatactaatctaaatgtgcctattttgctgatgttcttagtataaactatacaattacccatcaataatttaaaactagtgtagtgccccttgtgttgctagggatctgaaatatataacatcaccataaattctgaacttaaacaaattaaaataattatcctcgagtataaaatttcacacgcataattcacatattagatcaaccaactcttattttaatccaccttatgtggaaaatgcctttccattctgcaggatccagtccaaagtagtgtaactgttggagtttcgcactttgagagatgctccctctgggttcaagtcttgtattacccattttatggaagtggagggtctgcagactatgaaggagattatgcagaggaggactcacaaacagttaggcagaaacgctcacttaggccggagcttggtgagccagttgttttgcggtgccagccctacaagatcccccttgctgaacttctcttgccatatgagtgctccccagttgagtatttccggctatggccaagcttgccagccatggtggagtgcactggcacatacacatatgaaggtagtggtttcaaggccactgctgctcagcagtacgacagctctcctttcctcagtgggttgaagtcgatttcttctaagcccttccatcaagtctgctctcatttcatccgaacagtagccgggttccaggtaagcattttgaataatctgtgtcacttgagtcatgttaccatcctctttattctttcatatacataactatcaaaattcttgggttataactcatttgatctcctacagttatgttatgccgcgaagacatggtttggtgggtttgtgggcatgatgatctttggcgcaagcgaggtcagccggaatgttgatcttggcgatgacacggccacaatgatctgcaaattcgtcgtgcgtgcctccgatgaatccatcacaagagagatccaatcagacctccagggctggctggatgacatcaccgacggcgccgtggaatacatgccggaggaagaggtgaagagcgcggcggctgagcggctgaaggtttccatggagagaatagccctgctcaaggcggccaagccgaaggtgccaccggcgaaaaccaaggaagaagaggaagaggagaagaaggagcaagaggacctggacgagtttgggaaccccaagggcccctcgacgctttccaagctgacggcggaggaggccgagcaccgtgcgctccaggccgccgtgctgcaggagtggcaccagctgtgcaaggagaaagccttgaaagcacagtgaggcttttggttttatgttgtgattttgagtgccatttttgttcttttaacccccattttgtgtatgtattagccctgctgattaatttcactccatgtactactgccgatttgttcattgtattcattgttcacagataacatttgtaacatagatccaagctttggtgtgaaaatacatttttttccccggtgaccacactatattcctggtccatttttcgacgaaaatctacaaagaaggtgtgcataacataattcctaatgtttgactgacaggtggggtctggtgaattctacctgtctattccaatgacatgtggggtctcttgcaatggccccacaagccagtctctctcttcgcggtctgcgtgttcccacccctccaccctcgagtcccccgaccaggcgatcaccccgtgggcggcggcgccgccgtcctcaggccgccggccgccgcgtgcggtcgagctgccttgccatggcaaggccgcagccttgctgatagcgaacggaggaaaacgaccaggctgtatgcccgcatggtgttcgaaggggtcgggagcgatggctcggggtcgggggcggtggctgctgccgacgcggctgctgaacgtctgcctcgccgcgctctgccgcggggggagcctcgccgccgcggaatccgtcctcgtcgacgccatccgcctcggcctgccacccgacgtcgtcacctacaacaccctcctcgccgcccactgccgcgccgcgggccttcgaggctggccctcgtcgtcatgggacggatgcgggaggccggggtggagcccgacgccgtcacctacaactccctcatcgcgggggccgcgcgccgcgggctcccgatacacgccctcgacctgttcgacgaaatgctccgttcggggatcgcccccgactcctggagttacaaccccctcatgcactgcctgttccggtccggccacccggaggatgcctaccgggtgtttgctgatatggctgagaaaggcattgcgccgtgcgacaccacctacaacactctcctcgacgggatgttcagggccggttatgcgatgaacgcatacaggatgttcaggtacctgcagagggcggggctccccgtgagcattgtgacttacaacaccatgattaacgggctgtgcagttcaggcaaggtgggctatgcccggatggtccttagggagcttgggaggactgatcatgccccaaatattatcacttacacggcagttatgaaatgctgctttaagtatggtaggtttgagcaggggttggacaccttcttgtcattgctggacagagggtacatttcggatgtctacccttactgcacagtgatcagtgctttggttaagaagggccggttgggagaagctaataattattgtgacctcatgctacaaaatggatctaggcttgacagtgtgtgctacaacacgctgattcacatgcgatgccaagaagggaagctggatgacgcatttgagcttgtgagcatgatggaagatggcggcctggagagtgatgagtacacattcgcaattttggtcaacgggctgtgcaagatgggacatatcgaggctgcagaaaagcagctattttacatggagatcaagggcatgcaatctaatgttgtggcatacaattgcttggttgatgcgctctgcaaatttcaagaggtggatgcagctatcagattactgcagtgtatgaaactaaaggatgattttacttacacatcactagtccatggtctatgtagggtgggtagataccatatggcatcaaaattcttgcgaatctgcttgcatgaaggtaataatgttcttgcatctgcaaagcgtgctgtcattgctgggcttcgtagctcagggtttaaaaatgatttgaggaaagtccgggtagcattaaatatggctaagctgttacgaccataatccaaggaaaatggcctgaaagatcaattcgcaagagaaatgactggataatcctgcatggagtttaaggatgaatatcttgtcggtggctcagtgcatcattctatagaagtaaaatgggtatactctttttctggagaaactgtaggatggtgatcttgcaatatgcaatcagccttttcactgtcagtctgtcaaacccaagcggaacaaaattaaacatcatgggaagctgcagacatcaccactagttggcgaacggtatcggctcagtatgtgcacaaagccaccactaactggtgtatgccttgccttggattttgttgggaaggtaattgtggatttatattttatattcaagtcttctgcttaaattagttattaccttatcgttgtgtcacagtaaatcatgctaagtttaccctcttttgggtggttgttgcagattgattgggtttagttatctgttgctccagaccagacgatacagagcaagcaattaaaaagaagtacaaaaagctgcagattggtacagaaaaacccatttgtacatcatttttttgtctgttctttaattcttatgaagcagtggaaaaaaaaatctctttgggtgataccatatgtcacagttttaacatattgagcaagttttatattccaatgaaaaacatagcaagaggacagatatgtttgtggtatgcggcagtgctacctatccttgaaattttccattggacagccatttgttggagctctgcatgtcagtggctgctgagttcgagccgtcaattgaaacaagtcggcaacctcttcgtgatggagcatcgtagattggtttgcaaggtgacatgaattttttgaactcaattgaggtcaggtttgctttgggttgaagaattggggtgatttgggtagatcaggagatgtttggttgattggattggttctgggacgtatagtttgctaacataggtgggtctggaaacagtctagttttttaggcattagcaggtctagtccaaatatgaagttattgtgacattctaccaattcttttccctacctttgaaggacatcttgagtgggataactttaatttacagaacatggtaaatttaggttcaagatggatttacaaaagtattttctgtgacccagggagtcttcatacgactgcttcgagtggcaagaaacttgagagcagaacaagatcaaatccatgcattggcatgtactccatttgtaggaatgcttttttttttgccgattcatactttggaagcccattcgaggaacaggtgtgatatcacctttgaggatgcaggtgtgatgatacaagctgaaaaccactactgacgagcggccgaagatttacatggagaacgtagctcaaggcagcaaaactgaaggaacctttgatagcgacaagaggagaataatgagcggagagagtccaatttcatgtgtaattctttcgacatgaattttgcaaaaggagtccaatttggctttgatttgggagaaacgaattcgtacattcggaactacgcgaacatgcatgtcagatgaaggcggggccgtcctttctgttaacagacagtaaatttcaagatgtcaaatatacgagtttcaacacaaatcctacagagtttctgctacaggaaagtgattttcaccgttgtacagagtttctgctacggcattggtatattctatccttttttaaaaaaaattaattaaaaattgatactagcaacctactccagtcctgatccgagtttgtgtctaatccagtagtattgttatattttggatcgaaaaagagtagattttctgaatatagcttattttcagctggtatcttatccatacagaccaccaaattatcaaaatcttcggaatctgaaaaaaccccaacccaaacaaagcatctcgtgtccctatctttcgggtcatttgaaactggagcgaataacctctcgactccaatttccacacaacccaccaaaaagtctccgccacttcaccccgatcgccgccgccgccgccgccgctcgattccccgatggccgcggagccggaggagcgcctcgacgtcctcaccgccggcggcgagaagacaggcgcctccaaggccaggcacgccgcagctaccccctacccagcttactcccgccgccgcttcggttggattccattcgatcggatcgcgtgactccgccgccgcggtttgctcggttttttttttcattgcaggtcggaggtgcacagggacggcgactaccaccgggcggtgcacgtgtggatctacagcgagagcaccggggagctgctgctgcagcgccgcgcggactgcaaggacacgtggcccggccagtgggacatctccagcgccggccacatctccgccggcgactcctctctctcctccgcgcagtgagctcgctaccccttgctcccttgatagaatttcggaatgcgattatctgaattctgcttggggaatcgtagtggcgattttgcctagcagcgtggagaagcacttgtcactctgctttaagtttactatgcacatgggcatgacactcattgcttatatctgcgggagttgtagtctctgagatattgcggttcatctgatcgatgcaactgctgaaacttgattgaattaacttacgtgatgaatgggttgcacacgtgctattatcacatagtgtttgagacgctgttcatattttattttagtttattccacaggttcactgacttgcttgcatttgttgggttggctattactctattgcgtgattctttgctaggctaggtaaaaagggtaatattaaaatgatgcattctaattggtaatagcatttgacatggatcatcaggcgggagctcgatgaagaactaggcatcaaacttccatctgatgctttcgagctgttatttgtttttcttcaggaatggttagtacctctatctcttagtccatcatcttattgtgagtttgcaaactacgatagaaaacgattacttttatcttttttgaccgggtattaaatactattctatccctcatcagtttaagattgtatagcagcatattctgatcataactgcagcggatcttttacaatttcaaacagtacttactgagaggcttgctaagtgctaatatttcatatttcatcactttatgttcacatgaaatttcacactatcagtatctgcataaagggacgttatataatgttatcctctgattctttgctgcagtgttatcaacaatggcacatacaccaacaatgagtacaatgatgtttatcttgtgactactttaactccaattccacttgaggcattcactctccaagtgaggatacaatgattagtaatactttgcattatgtttttttcacttgctcttgcatattcatggttgtcaacatcaacaagtgtgtattacaagaaaaatctgtacttatgttcctggcaccaaaggaaatatatctgagcaagtaaatttatcaacatgacaaaaggaacactatcagaattgtccagtatataaatatttatgatgtaatttctttgttttactagttgtatggtttgtttcataatcaactgtagaagttttaattataggaaagtgaagtatctgcggttaggtatatgcatcttgacgagtacaagagctgccttgcaaaagaaagcggagaatatgtgccttacgatgtgaatgggacatatggccaactatttagtattattgaagaaaggtaagcatccaaattatttgtccagtcatgtttttgtcaatttgtggcctcgattgtcgaagggataattatattcactttggaagaactgaaatgacttttttctgtgatcgatatgaaatttactactaccaacagtctgtggtaacaaaggtgctggtgacaattaaaccatgtccaagctctcatttgacctccaggtttaggtttaaacattgggaagctggagtgagtatttgtctctaggttgacacagtaggttcttaggagttaggatttattgtatagttttttttttaactcatcagagttttaagttgaaaaaaaggatgtggtgtcattgagcaagtcattcgatgggtaagtctctaaacaaaaacttagcatttggtgaatcagggacttttactgtatgttttgagcagcatctgctcctgttaacaacccaccagaattagaactttcaaataactgtttctttgtcttcatctcttgccagttaccactttgaagcaattcaacatatcattcccttggcaatccctgttgcaccacgttttttgtcaaaattatcttgcttcaacctttcatgccatgtttataggtacaaagacaatatcgaatcccgcagtttaaccttgcaaaagcaaatcaaccgttatgctcccatccatttggaaccagaggtaagctgtctatattttttgtcagtcaccctgtagctctggttatttattttccatttcatatttgattatttatgtaactattcttgcctatttggcagccaccaatattcaataccaacaaaattatatgtatgggaaaagggaaacattcacttcatttatgcacatagctactaggtatgccatatgcaatatgcattggatgtatagcacatgaaagctaggtgcgcattgcacaaaaaaaaaagagtactgtttgtatcattatggtggtctgatagttggaaggaatgatatattgtgtcaaattgtctactattgggtagcacctaccagtttcctcaccttttcttggattaatccattcaagattattatttcttagaatattgtatgatacatatactatctataatctgttcatcataaaattctgtgtcataaaagaaagcaacagtttgatttcacacactaggatcataatatttagtttgaacattaggacggaaacaggaaatttgattcatcattcctataatatagtactcacatgcttttttttgtccctggcacgcttgacatttcaatctttggctttgcagttgactagtctatcagaaggagacagggaagccttgggatatattcttaaagcatcaatagttattgatgacatcttttatgagcaggtacatctttcaactttcttcatttttttttgaaacacatattttttattcttattcgttggatatgtcgtttacaattagttagcaaagattatcttcagtgataattattatttttactgcattgcaacttcttactaccctggttctcgattaggtttggaatagcaactgcacgctgagagactggctgaaagcacgtgctaactactcttcttttgataagttgaagtggttgtattattccattaataagagtccatggtaatttattttctattgaagtttcttcacgcatgttgactactttaggtttatttgtacattggatattttgttggttgcatggtgacttgcctatgagttaagatcatgatcttctgaagtctgcatttagtatttgtcttgtgttgccacgttgacgcatataagtttacatgtgttgtgtggatggatatagtttgtatcctaatttttgtgtatctacatctttatgagaaaattaaatgttttgtattgaagaatgcatactttctcagatgttctgtgcagaacttcagtactccatgcatgaaaatgttctttcataccactgttatttaaccattaccgaacaattggtttcatttattaaatttcttttttggtattcatttttttcattcctaaatttaatccttccaaaccaaatattcctggatttccggcctgtttggattaaaaaataatgaaatttgtcctgcccttatggactctaatgaatatgtacttgtgaaagatatagcaaggagcatatttatctatgattagggtgtttatgagcacaaatccattttttattcctactttgtatgcttgtttcgaactcatattatctaattagataatgtataactactatgtattttttagcatcttgatagatgttattatttgatattttcccataacaggtcctgccttgatgaaaataaggcttttctatcgactgcagattctgctgtgaaattactcacagatgccaccaaatcagtttcaggatggaaggggattgagtatcgtgctgcatttcctcgagataatcctcccggggcaaacttttatcctcctgatatggacaaaatggtaagattgtgcttagtcacttttctgcttcccagtgctcaaagtatccagtacaaatttcatatgcagtagtacggttgcttactgagtactgtataagtacgtttgatgtgtacttggtaccgtagtgactgaagcagggccaatttgcatatgttttgtatgtctgtaggagtttgaattatggaaaaatggactgcctgaaaaggagcaaaaatatgcaactggattttttactgtcataaaacggcatgatgccttgttgccttcaatactagcgcagtcagatggatcaaatcaaaccaagacatcagatgatcttttcgttgttccatactctgaggagtacaaatcatcccttgagaaagctgctgagcttcttcataaagcatctgaatgttctgattctccaaggtaagctagtacttcctccgtttcacaatgtaagtcatcctagcatttcccacattcatactgatgttaatgaatctagatagatatatatgtctagattcattaacatcaatatgaatatgggaaatgctagaatgacttacattgtgaaacggagggagtagtaatataccagcttttagtttctgaatttagaacttatatgcttttatcttcatgtagcctcaagaatttgctcaaaaccaaggcaaatgctttcctttcaaatgattactatgaatctgatatagcttggatggagctggttagtgtcctaactctcagttttagttcattattttctctttaaatttacaaatgtactggttttctcactagcttgattccttcgttcttggagaaattgttcttgaatgttttaaggcaatttgcaatcttttttttttggaaaaagagaacagtaggtgagttccctactgtagaatgtattgtcaataacacaaataatacaaggtcaagagttttatggtgaataatgtgtggtttatgagcactgcagtatatagtgtagaatatttgttgggtgtatattcataaaattggctgtatttgtcagatttaacagcaatgtttggcatgtacaaatcaggatttgctcatataacctctgtatttggcatttctatctttataggactccaacttggatgtcactattggcccatacgagacatatgaagatggtctttttagttataaggtatttgtctctctttcgagatctacaaagaattttctccttgggatcctttcctacctgttcttgtcatctacctatttgctggtcaagtatttagcatggaatttgcatcaaacaccacatattattttgaaacttcagtaagcttgctcgttatcacatataatgcaggtttgcaacattgttgagtgtgtgcctatttcctgtgttcaattgttatttgtgtttattaactaaatgcccgcgtgcttgctactgataaaaatgaatcatacacatggagcaaattaaatgaacatatgccctctccttttttttttcaatgaaggcaccctcaatacttttatcacagggagtacttctaaaactaactttaatactacatatacatgtgacgttggtcatcttagaccctttccgaatttaagtttgtactttagagaccaagaaaatgatagtatatgaagggacttatatgtaatattggcttcaggaagtatttggtaaaaaatatagtggggtggcagattcactgctacagcccaccagcaccattgacttcctttaataggagtataggtcttttgatggtcatgatattattttattctagtagctatgattttctcttcatacctcaatgctggggctgcccatattatttgggttaaatactaggattttaattcagttaggcaccaccttatccccaatgaagaaagtatggcctataatagtataggaatagagtaggcgacattaccatttagattagggcatgtgtttaaacatgtgtacaggatgtgcacatgcacttttatatcttgaatcaagtttatctacatactaagtttatgcatagagttcaataaaatatatcatttgtttttactagtattttctactattttaaaggcaacctttgaagcatttgttggtgtacgggatgacattgccacttctcaagttaaactcttcggtgatcaactccgggtaactctaatttattttctgtagaaaagtaccaacttttgatttacatgaaatttgatcttaaattcaggatttagagaagcatcttccactggacaacatttacaaatccgacaatgtatctgctgctccaattcgcgttatcaatcttctgtacaactctggggtatgtcccttttgtaacatttctttaatttttggggttcatttaatgctttattttattactgtgaatttgtgatctccctagtcatttgttaaatttctgtttcgatttgaactcattggtacttaaagttttgatatttgtagacacagaaaacttgcttgttttccctttttgcttggtggtagatgggcatcgtcaaaaagaagcttatgcccttaaatccctgagaagcaagtattcagccttttcgtaatatctaatgacaattgatgacacaccatgatttcatgacttttcgtaatatctaatgacaattgatgacacaccatgatttcatgagaggattgctttcttccttttgtttttatgatcaaaggagaaggttgtttactttgtgcttttcttactactgccccagttgcatgttggccaaagaattattgcttagattacttcagcttgagtttgtcactataattggctaaaccattctttgagatcttgagacaattgataggctgagagcgcgtgcagggcttgtgtatgtattgcagatgatttgttgtgccaacagcttcatgatgaactaaacagggactattgttgcaggatgtgaaaggcccacaaactattgcttttaatttgcccaatgatgagcggattgtgaatgaacgagggacctcgatggttatgcttaagaacatttcagaagctaagtatgttcttttaccgattattgtctataaattttaaattggtgactcaggtgatccacactatcagtggcaagtggcaacaaaagtatgggagttcctttttggatgattctaaattttctttacttttcaggtttaagcatatcttaaagcctatagctaatgcttgcatcagagaggaacaggaagattatgttgattttgagccttattatacacatattgtttgccatgaatgctgccatggaattggtcctcattccataacccttccaactggtaaaagatcaacagttagaatggtacgtaactttgtatattcatagaaataaacataaaccaatgcatgaaccttaggtgcactataaacatgtgctttgtttccctcaaaatttgccaccaccttcaaccatttttttacgtaatgtcactaccaaatttcttgtcagattattgacaaatatataaaaataaccaaatttataagtatggatgttgctatagaaaatgcagcatattcacttagcaatggaaaataactttgctaatactcaggtacatgtaggaaaaaaaagatgtgcttatttatctgtcttcacactttaaatttgaaatgctggttatttctctgttatctgatttatagatgacctcttcatgaaaaaacaggaacttcaagaatttcattcagcattggaggaggccaaagctgatatagttggtctatgggcactgaattttcttattaaaaaggtcagttgctttcatcaactatcaagctaccatggcacttagcttagtcgagaccaggcagtcaaatcctgctattgctgtatatgcataagcaaattttcatttggctatatcctcgtttgtgccgtcattactacttagggaaaaacagaaacagtttttccaaactgcatgaactgcacattgcatgagcaccaactgcatgcaattttgcattgactgggttgtgcaaaaccacttaacccggttttgaatagccctactaataatagcacatctgcttctgctctaccagggtttacttcctaagagcctatcagaatccatgtatgtctcattcctggctggatgcttccgatcgatccgctttggactagaagaagctcatgggtgaggctttattttccctgttagcaaactgaattatgtttctggaaaaaaagggaacgcaagtacttctcaattctcatagaatctgtactgtcctgagctctttatataaatcactgttactatgtgtgcagaaaagggcaagctttgcagtttaactggttgtatgagaaaggggcttttgtcttgcattctgatggaaaattctcagttgatttcacaaaggtatttctctcttttttttccttaacattatcattgtcatgctgtcaattctcattagaactttgtgccatgaaaggttgaggacgctgtcgagagtctcagtagagagatcctgacaatacaagcaaagggcgataagcctgctgcccagtctcttctgcagtcccatgcaagcttgacgcaaccactgcgtgtggcgctggacaaaatagaacacatgcaggtagctttcaaatttaccggttcatactaaaagaaaattgtaaactatttttcatggcttctctccgagtgtttgattgggttttattttccttgtttatattaacatgttcttgattattttaggtgcctgttgatatcactcctatattcggcacagcaaataagctgcttgcaaacgatcagtagggtgctcggtttagcaagctacgtgcttcagtggaactctgcaagaaaacgtattttgttcgatcctaagatactccatgacaagaaaagcgaaacgggaagttaggaataaatggacaagttatccataaacaataatgttcatgtcttatttttatatttattacgtctttgattgcgagaagaccccttgtaatatttcaggattatcatcagactgctgttgttctatggtgcatgagatgaccggggaaatcacgtgaaactacactggatagcagtaatacactgatcgttctgtccacaagctaaaagcccgagaaatcacattcaaacttattttgctttctaaaacattcaaacttatttgttctctttttgaaaaaaaattcggtgaacttattttgctttctaaaacattcaaactttcaactgaaaatgagtgcgacgtggactttctaaaaacatgaaactttcgattcaaattttaaacttccaattcaaaatttcaaaactttcaagtcaaatttaatacttttaactaaaaatttcaaaactttcaacttaaatttccgaaaatttcaactcagaatttcgaaaactttcttatcaaatttgaaaacttccaagtcaaaatttaaaagtctcatatcaaaattgaaaaattctcacatcaaaatttaaaacttttaatatcacaatgaaaacttccatatcaaaattgaaaatttcaacccaaatttcgaaatctttcaactacgaacttaaaactttcaactattttttaaaa

SEQ ID NO: 87963 - DNA, 2322 bp, Oryza sativa
ctatcattaacctcacttgcagccacagcgtgatcaagagattgctttgggggtagtaccttaactgggattggatcaagcatgccttgtccagaaacacctagacccattccctctcggtaccccatttttgccatcattttggaggcaacgcccctggtatggtgctcccactttgcaaagatcgcagtctctgtctgaacaccacttaaatttttggattccaaaaggcctagaccctgatgaacagattcatcctcttgatctccatcctcactaaaatcagatccttcatcacttgagcttccttcaccatcttcatcgctctcatcagcatattctgagattgaaagagaatcactgggaagccttgcagagctcccgtcatcttgaaaaacaacctggccaactttcagatcgtcatcccatgactcaagttcagctcgtctccaaaggccagaatgatgcccagaagcagccagtatgctggatcctaccaaggactgctgccatctagtcggagtgaattgcttcagggacagaataggaattacaatacctgaggataatttttggattagtcacacatgatactttatgtgcaaggggcagaaccaactgggacatcttatatgtgtaggaaaacacaaagatataaatccatgaaaatcaatacaatattcacaaaaaatgcaacatctgaaggagcaatccatcatatgaagttcacaccattttgtggtgtcatcattgcttcaggtgaaaggcaacggaacaagagatcaatggtttgaaggggtttaatccttagaagggtgcaaaataagcatttacataccatgggacaagcggcagttactaccaaaccgacatcgttgctggagaaaaaacttgcacatctgcactatgggcagattgattagttaatttgttggtaacaatgaaccttatgttctggacattacattccattaaccaacagaaaatatggttgatggtgaagggtacccacctgtgacctgttaacattttccccgtcccatttattcatgaatttactgtggtggtgcgatgcaagaggatagagggacacactcaggctttgctacaaggtttatttgggagcagatggacgtatggcttcattgcaaaataaaggactggtatatgcacaatgcacacatggttttaatgaaaagcaaatcatgtactgtcacattactttggagagaagttcagcaactgctcacacagaatagcctagaatcaatacagaaataacttgattatacaaccgctagaatgctgtatagctctgcagcccagcaaggacttgtattgcaaaagtaggaatttgtttcctaaagttattccgtcattccaaggacattcaacaaaataattgcacaggtcatatctcctatgtgctggagttataatatctcatgaaggagagaagttggaaaaacagtaaatactggcaaataaacacccatttcctaccggcggtaacatagcaagttacaaacataccagcacgtagagggttatgtttagggtttaccaggaaacatggagctactattcaaaggaaaaaataatggaaaaacgatagatcaagtggcgtgactcaccgacatgttttcagacgtaggagtcagaaatgagatccttgcatcacttgagccttcaagtcctataacacatccattataccagcgcccatccttatgcctgaatctacacttagatccaactgaaaattcctgtggctccaatggttctggctcaacatcatcgggtggatcaacagctacttcaggtgcttcagatgttggctcttggttaggaaatatctcatcaatttgctttactagtctagagcgtttcaaatggagaagtccctcctctgcatccttaattgcagcaagaagttcttcatggaccttcaaaacagtacatattgtaagttagcatttgcacaatagaagcatgaaatacataagtacagaactattgaagacaatggtataagggttgagattccccaaaaagaagctgactgctttctctgaatatttgttcgatatttttctctggagatattttggacaaggaaacctactatttggatattcacatctcaggaatccaaaatgcataagctaatcatctcacctacaggttacatcagtgagctatgatgtgaatatcactcaactcttgtcataccaaacttaaacatgttgagtcgatatctaatctaaacatactaaatactaatgtacaaaagttcccacccatcttcggctgatttggcca

SEQ ID NO: 87964 - DNA, 649 bp, Oryza sativa
gcagccctacaacagcaaattaatttaattaaatttaacatagaatatattttgataatatgtttgttttgtagtgaaaatgttattctatttttctacagatttggttaaacttaaaaaaaattgactaagaaaaaaatcaaacaacttataatatgaaacggagggagtaatactcagggacattcatcgtctgctgagcaccctcctccctctgttacatacggcatatatcaacaatatcaattgctagttattctataggatacaagtatcatgttccaaacttctatcctatcgaaattagtacacaggaagacatgtggttgccattatcttagcaaacgcaaaacaacttaaccacccagataagattacgcactttcatttactattattagccaataaatccatacacaccttacgatcatttgcttgatcagcatgtccatcttgtgaaaaatatgccaaaatcaagttccccagaaaggccccaatatcgtaacccattagaccatagaaagcaaattctggatcaatcacttgagtagaatctggtgtcaccatgatggaactagtgtggagatctccatgaagaaaagcttatactctctcaataaacctgcatatgcaaatcatgtccatcatc

SEQ ID NO: 87965 - DNA, 717 bp, Oryza sativa
acaactagtacatctgatcagtgaatttcagaacactgattacttgtaaggatccaatggaaggatgcaagaatgttcgtgtttgcatccttccctcttattgcgatgtgatatcagattgttgtcagcaatgcgtcaggctgagatttgcggcacaaattggtaggccgttttccgtttattgaccaacagttacaaagtttggaatcatgcgatctgaacgacaaaacgctgacaaagttggtgatcgctgatcagttcagttgccaccacctccgccgccgccgccttcttcagctgccacagccgaaggcaacgccgccgccggcggcctgaagcccggcaggtcgcaggggatgtgcggcacgaaggggcagtgctgcggcgggtcggcgtagaagcgggcgcactcgagcgccggccgctggtgggggaagttggggatgcagttgaggcgcacgtcgagcaccttgctccggacgagctcgaggcaatggcggcggccgacggagtggaagtagttgtcggagagggagaggttctgcagcttcccggtcttggccagcgcgcaagcacgtcggggatgtggccgtacagctggttcccggcgaggttgagctcctcgacgagccccaggcagccgagggagagcgggatgggtccggtgatgtcgttgccgccggcgtcgaacacggtgagcccctcccccaatccgat

SEQ ID NO: 87966 - DNA, 689 bp, Oryza sativa
ctgcagccctgtgtgagcatcgatggctttgaggatgtacctcaaaatgatgagaaatcacttcagaaggcggttgctcaccaaccagtcagtgttgctattgaggctggtggccgcgagttccagctctatcattcggtaaatgaacttgcagatatcaccccatgcatataggaggttttggtcgtaacaactattgatttttacattacagggcgtcttcagcggtaggtgtggcacaagccttgaccatggtgtggttgccgtcggttatggcactgacaatggcaaagactactggattgtccgcaactcttggggcccgaagtggggtgagtctggatacgttcgcatggagcgcaatatcaatgtgaccacggggaagtgtggcattgccatgatggcatcataccctaccaagagcggagcaaacccacccaagccatctccgactcctccaactcctccaacaccacctcccccatccgcccctgaccatgtctgcgatgataacttctcttgcccagcgggcagcacctgctgctgcgcattcggcttcaggaatctctgcttggtttggggctgttgcccagttgaaggtgcaacctgctgcaaggatcatgccagctgctgcccgcctgactaccctgtctgcaacacccgggctggaacctgctcagcggtaatct

SEQ ID NO: 87967 - DNA, 2103 bp, Oryza sativa
gtatttacctaaaaaaaaattactgtcagtacataagaattacgttaatatcataaaataataatgtaccataaataattacctggtggcagcctagggaactgatcaggatacttccttattggacttagcagaacccggtggtcgtgcactgaccccgaccatccagttacatcaaaaattacacggtcgctccagtctgacatgaccaacacaatttgggtagtttcacctacccggttatggtactaatttgctaggtgtgcagggacgacaacttgcacttttgttcatctatggctccaatagagttttcaatttttttttacctatcattatagcggacacatggatgggtagtactggaagttgggtccaccggccgaactatatcacctgccatacgggctatcgctcgaagcaatggtaaaaatatttggaaatagttgacccgatctttcgaacctattgtttgctctcctattagcttcaccccctgacatagttcacaggaaaatgctaccgcttccgcttccagtgcgctaacctcataagacactaagttgtacttgaactgaaggatgtcactagcctaggtaaaatcacctaatcaggtcacatacagaacatgctcctgcaccgagcaatattttgtaatgtatgcatcacccactgttggccagtcagtaggggcacgcgacgtggtgcccttttgcggtcgtacaagtccagatgtaatgaatccttcgatgaaatcctcaatgtattcttcgatatcatcgtcggatatctcccccatcgaacatttagaatcatcgctgctcctagtgctcattgcttcagaactgcacagatatgattcatacagacacataagtaatccaaaatcaattgttgagctaacacatataacattgtgaactggacgtttcaataaatctaaaatgcaaatgtgaactagactcatgacataaaattgttacaacatgacaatcgcagcacaacgtttgggaataaacgaactacacaaatccaaatttaactagacgaaatacacatctctgcggcaatactcgcacgtgatcagaaggtagtagtgccgcgagaaactactggcagatattggtgaggtaaacctattggagctccactgcagagaagcaaggaatgggaagctagcagaagattagcgatagcgcggttcctcatctacgacgcttctcattgcacgcatgtcctctgcctatcgcttcctcatcatggaaaaggcgatcctttctcattgggtgtaccgcctcccatagatagaggatacaatctaaaatagttgaatctttagttgttttatatttggattcttacattgtaatatacaacttgaattatatctggattcttacattgtaatatacaacttgaattttatgggattttgatcgtagagtttaatttttttcattcaaataagctggatacgttgttgaatataaaaacacctttttttcatgtgttgtaatccaaataagtaaataagaccaatcaaaaaaatttcattaatgctttctttgtatgaagtaatcttggggcaattgtttatttgatcctattttaaagtctaacttccaatttaaccctacttttttagtttgcttatatgacctcgttttttccaatcaaaaataaaaggttgacgaccctatttcgtgaagacatgataacggtgttaactaaggggcgaattgtcctggttgcccttgctcatatgacccaaatgtatcaaagttttttttgtttgttttgactttttaacataatttaacgagcataactttgatatattagagataactttgataaatttggattcaatttgacagatttggctcaatttgataaatttgactttaatttaaaaaaatgacataattatggcagatatacaaaatttggacaacttttctcctatttgtccatcccaaatccaagtgatattcatatccaacataaaatttctgtccaaaagcatgtccatcactatgtgacaacacatacaagtcccaacatcacaccaacgaccaccacagccatgctgggcttgggatg

SEQ ID NO: 87968 - DNA, 650 bp, Oryza sativa
atattcctctatcattatatttgccaaagatatgaaaaatagcagtagttggacatggaaaatcagacttagcaaataatttctccttcaaattatcgagctcacaaaaatcatcaaactgaacatagccaaagtatttaaagaagatagcaatttacgttcctcaacttcattagcaatgtgaacagcatgcttaatatcaacacacaaacaaacactagaaatagcatgttcattcactagttgtggcatgaatataagtgaagcattatcacacaactcttctttatcacaaggaacggcgagtaaatcaacttgtgacaaaggaattccagcatttgattccactaacggttgctctactttagtatgaaaagtggacaaatttacttcgttaacaatgcactcaccatgattaattttattaccatttactttacctttgatgtcctcttcagatgatggaggtgcctcgactttgagtgtgaacaatgggattggcggctctttcatgtctctctcctctattttactttcagcattgcaagcaagttgtaacaaatgagaaagagatgtatatctttgacaatcaagcatgtcctgaatttctttgttaagcccacataaaaaccttaattctttagcttctt

SEQ ID NO: 87969 - DNA, 1896 bp, Oryza sativa
ctcctctcctccacttgtgcaaactctttcttcatcccaattcaattccttgattctccacccacaactcacctatggctggcaagtccttgatcccatacattggctcctcctccaattctacctacaatctcaatggagagccaacaccggcgaatcaattgatcccggtggaacactatatgatggaaggggtaaacgcactgtggacacagcctctcgcaacagtgccgggctccctgcaaatttggagcccgccggcgagctccctagttcggccgaaccctcctcggccccattcggcagcgcgatccctctcccctcgtcatgtcatcaagaccaaaatccggggggattcgcctgcgcgacagccgacaccgggagagctcggtcttttgaaggccgctccgcctcccgccgagcgatatgtgggcaccctattcaccaaggcaggggatgaggtgctccacaagtacaccacacccaccgctactccatccactccaaaggaggagcgattcggcatcatgggagtgcgaactaccagcggtgggtatggcaaaggtttactccggcctttgatggcatcggagaaggagggggcagcggaatcccgtagccctccacctatgaaggtgaagcgtcacttgacgccccctccaatcgtgaggactcccagccaattccaagaggatgaagtaaagtcaccggagccctcagtccaaaagctcgccgctcaagtaaagaaactccgcaaggagaatatagagcttagggatcgcaacgcggagctaggggttgaactcgctgaaattagaaataatgttgatacccttagctgtggtttgtgcgctaaaatcaagcgtgcattcatagagatggggaaggaaaataaatattatgctaattagatgtctcctttcccataaataaaatggtagtaggtgcttggtttttatttttccaatcatgtaaagcacttactatgaataatgtggctcattggtgttaaccccaatggttgccaaagttgttttttgttttatgtttaataaagttcaggttttgaataagtgtgggggagatattctagcttctgacgtgcatatactctgaaaaattgctgaatctctgaacacctggaagcactcaactctgcagaaaactgcagagggattgagcaccagagtggttcggccgaaccaccaggttcgaccgaaccaaagctggcctcaatccctctcaactttcataggtaagctggtgagcacgtctattatctgtatatctccaccatggtatagtactagagctggaaattcaaaaaacaattggtccaagcataagtaaaagataaaatttccaattaatgaaaattttcatatgattgatcttgtatattcattattctcagctgaatttgtgcttgtgaacaaccctccatgtttagggaaccttatacatccaagtgattgctatatgtgagatgattaaagatgaaaggaattcttgcaactcttgttatgactcttgggaatttgttttcaaaataacatgtttaaaaaaagctcaatcctccaattgacttcatgttatacctaccaaggccatatgcaagagtatctttgataaaccttattatgcatatgactgcttggcattatattgagctttgtcaaattgatgtgactcgtgttagatatctttcatactctcacgatcaaggggtcaattccactttcatttccacatacatgataaagctaagcttctacactggaagttggcttcccacaaaaattccattcaaataaactcgtactttagactatgctttcttctcctagaaaaaaatccttggcaaaaagaaaatgagaaaaggagggaaaggcatgg

SEQ ID NO: 87970 - DNA, 697 bp, Oryza sativa
attcctgcagccctctcgtgtttcttcctggcacgcgatctttccacacacagcgagagcttgagatctcaccctaagcgcccggccgaaccggcaaagggggcctgcgcggtctcccggtgaggagccacgagctccgtcatctggcgcgccaggtaggggtctcagcgtgtgctttctgagctctcagactcttccgtgtgccccaagtttttcttgttcagcctaatggccgagcaaggaaaaacgcacgacatctcgccgagtgtgagcggcgacgacggggagccgaatccacgccgtcgagctcgtactcctccacctcctccgcgccaaagtcctaagcagggggaggcgcttgagagggtcgacaaatccgcggcgtcaccagccgcaggtgatgcaggagaacggcgagatggggagcgtcgcctcctcgtctacggcgacggcagcacgcctcagggcgcgcttcaggctgctggcgcgctcctacgacacccgcctgtcgtccatgacccggagtctccagcccaacgatggctggaagacgtggccaacttggtcatgacggctcagcagcgcttgggtgctggtggacggtccgccaccaccaagacctccggcgccgctaccaccggctccatgtcgtcaaggcggaaggcgcggcgagcggcggcggctgcacctcattcgg

SEQ ID NO: 87971 - DNA, 649 bp, Oryza sativa
atcagatacgcgaggctgctagtcgactaacgaacgcaggggtagcctcttctcagggcacattccgacccgacagagagaaggatgagctgtcactcgccctacagactcccgagcatccaggacgaacacgagggaaaggcgtgattccctagaatattggatttaaggaggacatccacacgtacaggagtcggatgaggagcaagagagataccgaggcgaagattgcagatcttgagtacaggatatcgagctacgagttcagcatgcaagaggaggtggcaaggaaggtggatgaacgtatggccgcacatcggtcccaagatccccagccgtacattcatcctgcaatggtcagcccatcaggcaatcgtagcagctgcgcctcaacggggcaggtcggatcacagagcatggacgccatgcaaacccaggacgaaaccacctgccccattgatgagatcacgcagcggacaccatgtgagctgcatattcccttcaagaacttatcaatcaaggtatgctcgtagtttgatgatttttgactagtacatcccgcaagttgctccttaggttgattaccaatagataacctctcatcacttgaaggtggcgttgggaatggccatctcaacggaccctttcg

SEQ ID NO: 87972 - DNA, 1052 bp, Oryza sativa
tggtttaattaaaagagaaggggaggagaacagttctactttttccaatatttttaaagggcttttatgggtaaccatttggcataacctagggtcaaggaggctttgataccaacttgtcacgcccggaatttctatccaaaattccaaacgcttacatgtgtgtgaaccctctccagaaatcagccgaggcacacaataacaaattgataatagagtacaattattactctaataataagcgaataaaatgtcattacagaggtagatagttcctctcaatcaataaagatctaagcagcggaaaataaaataaacggcgcaaacggttccactccacaggcagtttgacaagggctacacctaatcctccacaccataagcatcattgtaaaacttttcctttgatgaatgatggcaaggtgagtttatgacatactcagcaagtcacgcagcaaatatgcaagtgcacaggataccaaaggatggcatagtagggttcaatttgcataaacagcatttaataaacatttcaaaatttaataaaacagttaagtaatattaatcaatattaaaccaacgctatacaacataccctgttgcataggcccaaccattctgaacaaccatcccggctgcacagttctatctccaaaccaggaatataccattccaaaccaggagctaaccaaattattaccagttatagcatcttttattatgatgagaggtgtgagactaatcacgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacaataccctttgcacaacacaatccactacagcgcacctttcctggatcataatcacccccttataaacaaggcatggactcccagcgacccccgtgggcttatctccgccacttctcagtctggtgctccgcaatgaaccatgctataca

SEQ ID NO: 87973 - DNA, 601 bp, Oryza sativa
acggatccagcctcattgtgaaattccatcttattgagccgcaattgaagcaacaaggtgttgcatcacctgtcatggtcctttgggcttgtaacttcgtttgggaccccggcccaagtggggcccatgtggggtgcgccccaatccggtggagcacgaccctaggatcctcatggtcattctcccacccctataagtagctagataccccttcagggttgctggggttttgataaattgtaagtttagccattgctacttcgcttgcagcgcgcgtgtcggctagaccgtccgtctgcttgttcggaaccccactttatcatgtatcaattcatatttgtgcgtcttgtctatctagcaattcagttgctttctatcttgttcttgcttgttctcgattgcgtgcaggaatagggttgatctgcatcgacaagatcaacaacccatggagagctgtattgatcgctaaggcgcaacagaacgtcttgtacggttgtagtcggatcgtcaacgtttctcccaaatcgtagttatcacaactcaccgaaagatcgggccaacaacagccttgagtgtcgagaggaactcagggttcatcacg

SEQ ID NO: 87974 - DNA, 1392 bp, Oryza sativa
tgaaactaagaatttctactcgaaaggcagtaatacgagtaactggaaagaaggcaagacagaatctgtctcacaacttttcctagctaccgtttacacatccaacggtagaggtgtaccattgctttgctctctcttgaagagagaacgggaacaatttccaccgcacagtttcttgtctcatgccacgaatcttaaggcatgatcaaacttgttcaaagtctcgcagatgatggtagggattttctagatcaaagccagaaaaaggattttccctaaccgtactaattagttcaggacgaatttcatagccagttgtataaatgggcttcgatgaaggaggtggctcatagaattcgccccgaggagcagacatctcaaaacgaggttgctccatggtcgagaagagtttgacaggaatacttctctaggatagcaggggtgaaggtagactaaaaaagtaaaaaggatacaaggatgaactgggttcggaaatgatcagcaaccgttccccggcaacggcactaggaatgcttgttggtatttaatacggttacagataaaatctgcaaccgcacggatataccgaggtagcacttcccctacggagtattccaagggtatcgaatccaaatgaacgtgtatggtcagatcttcctccggttcatccaaggacacaaagtaaatgataggccaggataagaggatttactagtgagagacagtatctagggaaagcttaactttaatcctaatgcaatacttcagcactggcaacccgctgttcccagatgtcgctctagtacgtacccggaaagggaggacttaagtgatctcaagggctgtcaccacctctacacctacctcaaacgtaccgtgggatacgcagcaattaccggataacaattacttaaataccacgtctaagcaattaatatctactttagtgtttataactcatcaaagcaatcactatattttagttgattatagtgaacaataatcccgtatgctatttaggaactaaccaagagataattctcacaagataaatctaaattattcaagaagaatattatattgaattcagagtaataaatagaataaaagaaataggagaagattaccgacaactccggaattcttccgacttcttctactctactctcttcctattctagtgtacaatatagtacaatagagcctcttataattcagctcaagcttggaagtgtgtgtgagagtgaatgaagtgaggtccttttatagggcagttatgacggttgtgagaaggggaaatgtccgaactgcaccgcaaccgtcattgggagaacttctggagcatccacgccaaacccaggatgaacggtgatcagggggttcggccgaacc

SEQ ID NO: 87975 - DNA, 1364 bp, Oryza sativa
aagggcgcatccttggctagcaaattagtcagcggcctggctattgtagaaaagtccttgatgaaccttctataaaagccggcatgtcctaagaaactgcagattcctttgatgttcacaggaggaggaagctgatctataacatcgattttagtacgatcaacttcgattcctcgttcggacactcgatgcccaagaactatccctttacagaccatgaagtgtcacttttcccaattaagcaccaggtacttttcttggcatcgttgtaagaatttgtctaaattctgcagacaatgaccgaaagtctttccatagaccgagaagtcatccatgaagacttccatgatgtcttcgatcatgtctgagaaaatagacatcatacatctttggaaagatgtaggagcattacacagtccgaaggacatcctacggtatgcataggtgccatacggacatgtgaacgtagtcttactctggtcctccagatggataggaatttaatgatacccgtaatacccatcaaggaaacagaaaaacgaatgatttgccagctgttccaacatttcatcaatgaagggtagcgggaaatgatccttttttgtagccttgttaagttttctgtaatcgatgcacatcctccatccggttacggttcgttgcggaataagttcgttttgagcatttgcaacgactgtcattcctcccttcttcggcacaactggactaggctaacccactcactatatggtacgggtaaattgatcccggcatgcaggagtttcaagacctctttctttacaacctcttgcatttcattattgagccgtcgttgaggttccctggagggagtactcttggggtcaataggaatacgatgggtgcaaagcgcgagattaatccccctaagatcttgaagtgagtagccaagtacagaacgatgcttttccaatacggtaggaagacgttgacgctcgtctttagagagcttgtcacttattataacaggggcctctctgtcattgtgtaggaaagcatatcgtaggcctagaggtagaggtttaagctcaagcggaggttgaggtggcggttccatgattggcaggtcgagagtctcaccgggatctgcttcttccttgatgaaatcggggacctcatcttccagaagggcctcgggagactcatgaggaggaactgcggtaacctcttccactaactcaatttctgggagaaggtcggtcaaggtgatccttgcccgtgaaaatggaattgagaattcattctctcccagtgttattttgaggctacctaaatgaagtgtgttgataagaagttgctcaatgggtagcctgattaggatgtca

SEQ ID NO: 87976 - DNA, 771 bp, Oryza sativa
atggtaaggagtggccacgttgtgtttggcttccatttctcgtaggaggtctctgaaggttttgtcaatgaagtgaaaacctcggtcgcttatgaccattctgcgggtaccaaatcttgggaagatggtttctgtgaacatcttcttggcgtgcctcgcatccgcggcgctgcacggcatagcctcaacccacttggagacatagtcgactgccaccagaatgtactcgcagttacgagacttagggaaaggtcccatgaagtctataccccaaacatcgaatatctcaacttgcaaattgtatgtaaggggcattgcatcgcgagcagtgattcctccttgcctctggcagcttgtgcatcttctgatgaattcttttgagtcttcgtacattgtcggccagaagaaaccactttgccagattttggcctgggtgcggaatgcacgtaatggcctccatagggtgaggcgtggcatcgttctataatcttaagtccttcatcagttggcacacatcttcgtagtaagccatcggagcatacccgatataggtagggctcatcccatatatgacggtgactttcatacttcagttttcgttgattttcccctggtggtatgcacttggataccatgtagtttactatgttagcatatcacgtgttggagtcgcgaaccgtcatcagcatgtcatctctcaagagatcatttatcggttgttcctgcatgttagtgatgtgcaatctggacaaatgatctgctacataattt

SEQ ID NO: 87977 - DNA, 6164 bp, Oryza sativa
ggccggacgacgatgatggttgaagcggcggcgctccggtgcgtgctccagggcgttgtcgacgtggcttgcgttcccggcgatgcactgcacgagaggggtttaggtcaaaagaggaaatgctcggcattgtgtggagagatgggaacgcgaaagagatggaggtgaccttgactcaaacggagatggcgaaggtcgtcgtcactacgaccggcggcgaggttgaggatgacggagagccagagaacctctccctcggcttcttcagctccaaagtgatgtgtggagaatggcgacgcgtctgggaggagtagagagcgagaaaagggaaaccgagatcgacgacacgttgcggccacgcgtcggctcgctcaatctctccctctctcggctggaacagtggaggaagtgatggacagagtcaaggcaagcttaagaggctgtcaagtgggtccaggtcgtggcaaactaggctagggtgagagggttgggtaagattctgggtaaacttgatttttagattaatttcggaattattttctcctctaactttgaaactacataattcaatgtgtggaccaaattaattagtgttgattttactggaggtaaatgattacacctagattccattttctttggttgcactcaaaaataatgggtggactgctcacagaaattaaacaaagatgggctattagaaagctagattgaatttttaggaggcttaaacagagaaggaaaattctagaaaaattacatttattcatgataactaatctagtatttgaataaattattttccatgttcacttatgtgcagttaaatgtacttttggatgaaatatggttttagccgattaaaatttaatttgatttcttttagttgtctgtttcgaccgattaatttgagatatcaacttgagtgttaacacgttaccaaattacggaggataagtttgtgctaatcattgtccacataaatttttccatgattttatcttgcacaaaatattttagagaattaagatgacctttgtttgtatatgtgttcccacttcataattgcatctaatattattatagggattacattaaacttcttttagactgagaagatgatatttgagtttaatattaagtccacatgttatcactcaagattactataggtttgtttagtgaaataattcttttagattatgctcatgggagctattatggaatacaagtccaaaactccaaatgcacaaagaactcgagggttaagtttgcttggcctggagcaatttgggatgggtgaccgaccgggaagaatttcccgggtgcacacgagtgaggacaaaatgtgcagaaaagacatgtgttggtctgtgagggcagtcatgacctatgaaagctatcagatgtaagtgggcccggcttgggggaaggcgggacgtgacaaaatggtatcagagccgactctcgcggtttcacgggcgcgtgtgtcgcagttgcgcaggcatggtgcgcatggctggtgtaggccgggaatggttacacagcatggcacatgcgctggcactggacacatggacgtggccaagagaggacgttcctagcctagggttgatcgacgggggcgtcgatctatcttaagggggtgagggtgtaacatcccgacatagggcttaataggattaatagaatactcatatcaacaagttgcaacttctttttcggaagccaatctccaaagaactccagggttaagcgtgcttggcctgtagcaatttgggatgggtgaccgacctagaaattcttcccgggtgcacacgagtgaggacaaagtgtgcagaaaagatatgtgtgtgcttggcctggagcaatttgggatgggtgaccgactgggaaattcttcccgggtgcacacgagtgaggacaaagtgtgcagaaaagatatgtgttggtctgtgatggcagtctatgacctatgaaagctatcagatgtaagcgggcccggcctgggggaaggcgggacgttacaggtatgccttctactattgtttcagatcgtgatgcaaaattcttaagttattttgggcgcacgctatggaacaagttgggtacaatgctattgttttttacaacatgtcacccacaaacagatggacaaacggaagtagtcaaccgcactttgggtaccatgttgagggctattttgaagaaaaatttgaagatgtgggaagaatgtttgcctcatgtggagtttgcatacaatcgggcaacacattctactaccaaggtaagtccttttcaggtagtgtatggtttcaacactcgtgctccaattgatattttgcctttacctactagtgagagggttcataatgatgctaaggcatgcgctgaatttattctgaaaatgcatgagtcaaccaagctcaacattgaaaagatgactgaaaagtatagaattgttggtagtaaaggtaggcaagaggttaagcttgaaccgggtgatttagtttggttgcacttgagaaaggatagatttccagaattgagaaagtctaagttgatgcctcgtgctgatggtccttttaaaattgttgagaagattaatgataatgcatataaacttgagttgactcccgagtttggggttagtcccacgtttaacatatcagatttgaagccatacttgggagaagaggatgagcttgagtcgaggacgacttcaattcaagagggggaggatgatgcggacatcactaactcgcatacatacaacaatcctccaacggtcatttaaggaccgataacaagagctcgtgcgcgacaattaaatttagaggtgagctcgttcctatgttcttctttgtatgaattcgagaatatattgctacctaatgattatattgtgattaggaacaatggaggggacaaggagacacttggagaaggacttagagccatggaggatcattgaggacgtccaagtcaaggtggaggcccaaaccaattcgacctcgggtgcaattcggtgtgcaggaccagtttgcactaaaacgggcgcccaggtcgcatacgtgctcagattgggacgttctttataacatttccaatggttttgctcccacgtccaaattctttccgagtcaatgggaatcgaccgaacaatttgacgcccagaatctgtcccggtgctgcatcaccgtattttggcctttgggccgtgtatcgtgttggaacccattagggttgcgttgagagggggttgcacgaccctaaactctatatatcagtactgtcaccatctttaggtttttgggttttgtttagattattctgtcgagaacagtttcgctgctagatcggtttgtaagaccccaactcgtgagcttaatcattcatctgcaattttggttgttttctatctcgttcttgtttgggttcttcgattggcaaacagggattagccttctcagtgaggtcatccgcgtttcgacacgggtgataaccagaggagacgtggtgctgcgattgcggggctcaagagagtgcgcgttcaagaagccgggtcgatttgtgtcgcgactccgccaaaatcgttttttatcaaaaacctttcagaagatcgggaaacctagtgcacatcatgacgactcctgaacgacaccaacctcgaccttgccagtgatcgggagagacaagcctactacatgctgagcgaccgggagtatgctcacacgcaagaatactcaccggagttgctgaaaaagataggtatggatgttgaattttgttctatttggaaagctattggttggcagagatttactgtggtagatgagcctggttctcgtttgcttactttgtaatttctgtgcacttcgaaagaaatagaagatggtatttctttttgctttttacgtaaggagttcatgctcacatggaaaggcttgagtacacttcttggttttcacgattcctgtaagatcgatctcgagaaaggaatttctgggttcgagaaaaattggttttgggaagatatttttggtgctccaatttgcaagaaacctagaacgaatgatatccataatcctacacttaggctcatgcacaaatggattgctatgactttgtttcctagaggtgatataagaccctttaggggggatgaattaattatcatgtttgccatggttagaaaaatcaaaattgatcctgtaaaatgtatgataaggcaatggtcagaaagtataaagttctctgctcctgttgagtgcacttctctgattactcggatagcaaaagggctaggggtcgttagcgaccaaattgcttttatctcagccgctcgtccgtgtattgatgaggcttatctagtgtaagggcatattctgaaacatggagcagatggatctttgatatactttttccatggttgcacaaatgaaatcccattgcgaaatgcgggatatcatttgtacaactaccatgaactaaccattcccctgcagaccatagaagaatctcgtgcaggtggaacatacagggagacgcgcaacatgacaaggaacgaacgagaaagttcatcatactcgacacccgtgaagatgtatgaggcaggttgggcaccaactggggatgcacccgggtggacccaagctccacgccatagcatcggagtctcaacctggcaagcgccagttaggaccggtggcatgcgcctcatgacatccaatggggggacaatcaacctcccagatcaagtggtgtgcctccatctccaagtgaatggggctcgagttcctctcgttgggacttgggtgaaatcactaggagaatggacacccttgatatgcagacgggggagatccagtacaacctcacggaacacatagctcagacgcaagaatggcaacaatctgctgatgctcagttcgccaacatcaacaacatgatgcagcaacagcacgatgaccttcaagcatacttccgttttcagggattcaatccttatcaaggaccctgagcgaaagccaaacttggggggagacatcgctccccctactaaggtaacttgtatcacattgcatatttctctttctaattgcatatttgctttctaattgcatcttataaaacttgaaaacaacataaaaatttgaaaaatagaaaataccaaaaagataggataggtttgagtcatgctaggtaagacaagctagttctctttattgaaatgatgaatagttgctctgttttatatctctgctatatgggttcttggtaaatactctctcaaaggttaaatataagtagccaacaattatccgggaacctgaggtaaatgggctgcacttgctgatctaagtttaggttgttgcgagatatgagatagtaaataagagttacgatgatcttgatactagtttgacttgaattccggatgttttgtaaaattgaaagttcctcatttgatataaattcctaccaaagccaaaaatgtgctaccttgattaaaccatatacattttggttatttgccattccattgaactttgtcaaactcttgtgacttgtgtagatacttctcatgctcactgatcaagatcatacacccacatatatgcacatgctaaactcctacattgggagctaagcaatattccattccatttccatattaccaccaaaataaattctccatgctttcatgtgctttcttctcctaaaaaaaagaagaaggagggaaagacatggttatgaaaagaaataataaaatataataaagttatgctccatcaagcatgagcatgattgaaaatatatatatatatatagccatgccctctcctaatcaataaaagaaggatttttgggagaagaaagtaagcacaaaggagaagcattttccttttatttttcgtcatataccatttccaccatataccacacacacattatgcacgatcttgatcttgagtatgtttagttatctgctctagtctaagtttttgacttagtaataaatgtgaatacaagtatgatgtgaccatggctactatggatacgaccattgctcacatcatgaatcaacaagaagacatcaagatcaagtcctccatgtgctgcaatctgattcggccacgtgttacattggtgacttcaaa

SEQ ID NO: 87978 - DNA, 815 bp, Oryza sativa
aatagaatttcaaggagtaccatttctggccaatcttatcttgttagaatccaaagacttgaatgtcatcttaggaatggactgtttagccagatataaaggtgtgatagcctgtgttaacaaaaaagtatttctccccagtgatgatggtcgagttgtaactgttcatgcattgtcttctgagtctttagggtcaagactgaaccaaataactttggaagagattcctatagtccaggagtaacctaatgtgttcccagacgatttacctggtatgccgcccaaaagggatatagagttcagaatagatttggtaccaggaacaactccgatccataagagaccttatagaatggcagccaatgagttggcagaagtcaaaaggcaagtagacaatttgcttcagaaaggatacatcagaccgagttcatctccatggggagctccggttatttttgtggaaaagaaagatcatacccagaggatgtgtgtggactatcgtgcactaaatgatgtgactatcaagaataagtatccgctgccccgaattgatgatttgtttgatcagcttaaaggtgccaccgttttctccaagatagatcttcgatcagggtatcaccagttgagaattaaagaggaagatatacctaagacggcttttaccactaggtatggattgttcgaatgtactgttatgtcttttggacttaccaatgcccccgctttcttcatgaacttgatgaataaggtgtttatggaatacctagacaagttcgtggtggtctttattgatgacattcttatctactcccgaa

SEQ ID NO: 87979 - DNA, 585 bp, Oryza sativa
ggccgacactgagtatcgctaccatccccgtcaaccacagggaagtgaccgtggcagctaccttaagactgaaggaattgagaatgatgctaccacaaggcatttggttgagatgctgtgggctatggatgaaagccgtgtggagactgtgttagcagctcaagatcgtgaagatcggaatcgtggtaagatttgcacgctagaagacaaagtggatcgtttggagaaggaactagccgcgttgaagggagaagcaccaccgcagaaggccagggttcgtcttaccgcaaggaagagagctctatttgtccatcgctaccaattggcgccaaaggtccgtgtggtggaaaaaaaagttaccccagccctagcggattctccggtcgtcaacataagtgatgatgaagtagaagaatccaagcgcacccattccaagatcgagtggggagcaattcaagatgatgaagacgagccgaacgagccttcaatcaactccgatgcccggaagaattagaaagccttgtcaaaccgttgtcttagatcgttgtgttagtttgcttgttttaagtttggttgtgtgtgcct

SEQ ID NO: 87980 - DNA, 1139 bp, Oryza sativa
aatggaggtggaccatctccccctgtcatcggctatcatgcccccaagacctcaagtctacttcaagggctaatcagagaaccaaccgatgtcagcaagaatagaaagactagagcatcggctatagacccatcggctctggttcccaagaagaaaactaggaagaacaagcctaagccaatcgatgatctacctaccttggatccatctatcgagcaagccctggatgaagaggaaattgaagaggatgttgacaaggctgcaggcgaagtaagcgatactgaaagaacaccattggcttcacccaagaagactcctccaactccttctactccagctcatttctccagggtaaacaactctccttgatcccttttataactacgttatttatagccgattacttataggcttcatagttgcaaaaaaagaaaactaatgtgaagaagaaatcagcagcaacaactctcaaaccggctccaccagtaagatgttcccatataaactctttcactaatcgatcataaccgatcttatctaacacttgtctcttttacagcctcctcctcctccttcttcccctgtacagcaatcatcaagtgatcaaactccatcggctgcagggagtcaccgtgtcgaagaagaggaacaactagccgctcctgccatcccagtaagtttccctttgacacaagaacttagatcggccatatctatttagcgtgtaactctctttcaattattcttgcaggccttagccaatatgttctttttcgacatcaaggactatttttatgagacagaagaggacaccaccaccaaagctttagctcccttatctgatgatgtgaagaaaactcttgaagacatccatcatcggctagaggcatcatctctagaaagtttggtggtagactgcggatcaattaggacttggctacatgaagttcaagctttggtcccagaagaactagccgacgtcctcactccaactgcttattttgaacaacatcaattcaagttggagaaggccaagctgagattagccgaacgtcgggagcgcaaagacatcgaagccacaatccaggccaattggcaacttgttcataaagagaagatccaagcttgatcagctatct

SEQ ID NO: 87981 - DNA, 625 bp, Oryza sativa
catgcttttgagagaggttgaggtgtttgaatacataccgggggaggaggattgaaagcgttgtatggcaccactggcagcaagtgcgaatagctaactacgatagtgtttgagaagatcttgtacattctctccttcatgaccttaaaatcaagagagtctggatcttcatggtttggatcatgcttgccgtaaaattcgaagccgtacgagatctctctttaattggagctagccggctcttgataaaatgccgagtgatctgttctccttgcagaccttgctcctttagcttcagcatatggtccatcaggtcgagcgcctgagcggcttcctctccaatcgacagtgagttccaagtgtcctgataaactggagggagacaggagtactcggggagtgcaggctcagggttttgtacatagaaccaattcgcatgccagcctttgttgaggttttgaagggcatggaaaagtatttttggctcaaagttcccctaagttggaaaccagcccccccaacaacacatggtttactcttgttcagttggagcttgacgaagcagatgcggcagaacaaggcaaaatgtggcctaatgcccaaaaaagcttcgcaggcgtgtatg

SEQ ID NO: 87982 - DNA, 799 bp, Oryza sativa
agccatgaaagctgtcaatcgggccatccgtgacagaagccgaatttccaaggttaaagccgattacggatgacgatggagaagaatgcacccatcgaagatgcatgtcttatggggaatatgcatccacaccagccaatgccggagcaaagttatcggctgagccgctcaaggactggttctgcatcttttatgaaggctttcagaaagatgcccatgtttggttcttttatgagaattcagccgacttggatctcccatcggatttcagattcgaagatatcaatcatgagagataccagaaatccagagaagtcttttcagcttcgataagcccatgcatccttcctatcggcattcatcaagggagaaacatacaagtctcttatgaattttatcacccaatgagctctgccagacagtttggaatgggacaactaccaatcggcttgttgtttgccgacaaaatccaatgccaaggagaaatttcatcaactctgatgatggatcggctactcaacatcccaggacccccttttggtagcattgagaacatagagctagcaaaattcaggagcagggcatttgacagatggtggggtgaatggaagctgcatctattccatcaatcggcttccatgtacatgacagacctctttcctgatgtcattcctcaggtacatctttactcttgtcaattctgtttgaacaattattattgaaatttgactaacttctcttgttatcttgcatataacagaatcctctcctctcccagagtaacagtggtagggacata

SEQ ID NO: 87983 - DNA, 4070 bp, Oryza sativa
ttcgccgtctttttggaggcagggctacggtttccctgcaacgtgctattgccggagatccttcgcctcttccaggtggagcttccacagctgagcccgttggcgcttgttcggatcgctatcttcgattgggcgtgccggacttctgggtttgagcctaacgccgagctcttcggcgccatattcttcgccaccgtgaactcaaagacagcgattaccccggctgggacgaagaaaacagtgttcgggagcgtgaactttaacgttcgtcccgagcggtccgatctctcaccggtgaacgctgccatgtcgaagtcggaccgccattggatagctcggtggttctatcacaccatccccttcgaggctggctctgacttggcgaaagcccttcagtgccggcgcaaggtgatcgcgccgaaccggaaacccaagatcgccgtggatggtgctatggagacgcggttcgtcctgctgcgcagggtctgctcccgccttagctgccgtgacttggtagaggaattctgcatacttcgtatctttcccctttcccaggcatggcaagtcacggttgatcaaggcgaagaggttgacggtttgccgaacctgatccttcctgaggggacgaacagtaagactgttctcttgctatatactgttgtgctttgttattttgccttgtctgacttttaacatagctacacacttttacttttgcagtgttgaccctcgaccaggctgaaaacgaggcccgcaggatgatcggcgacgtgtcggtcgtcgagtatagccagctgctaacacgacaagcggctgggcgggcgaaccaggtttacaacggcgaattgcctcctcgggcaaacccccacaaagcagacgacaatgcagggccttcgtgaaagcgaatgcgcggacaagtgaagcttgcccctaggaagcgaagggtccctgcttcgtcggactccgacgccgacgacgaggacgataccgaagaacgcgacggcgaggagaaaggagaggaggaagaggaggaggccgtggctgataaggccgcgaaagagacggttgaagaccgcgtcgatacccccggctacactcctaccccaagtccaggtcacaacgagaccggggtggagtcgaacagctccccccttcgtcggaaggatttggaaggggcgaaggctctagttgcgttctcctcgggcaaggtggcgaagggaggtccggtgaagaagatctctgaaaagaaaggactcgtcgacatcgcccgcgttttcagcgacgacgagtcttctgacgggactccaacttcgcccgctggccgcagcttggacctttcgactgctcccctcgctccgctaggcgctgctggggcaggcagtaacgccgccgccggggcttcagcctccgccgaacggatcgcgtcgactgcggcgagggttttcgggagccctctgcgtgagccagctatttcgccgctagtcaaggcgaagtgtgcggccgccaaaacatctgcctcggagtattcccttgcagcgccccacttcgcccctggtgatttcgagactcgagcggacctttttccctttgtggagggggttagcaaccttgtcttgctcgccggcaccccgagcctgttcaccgaacttaacgagttcgggtatgccttttcttccttcttcgttttcctcttcgtccctctttttttacgtctcacaattaaccttttgttcctttcgcccaatcctatctttcatctagattcttgtggctcactgttcgacggagcgaaccatgcgggcccgttttgacggttttaagagccgtcttcaggccaaggacgatgaaataagccgcaagaatttggaggtggaggccctggccaacactcttaaggaggcgaaaactgaagtcaaacgccttcagtccgagctagataaggggaaagaggccagggccgaggttgatcgactcaaggccgaactggagaaggagaaggcccattcggcggtgctcactaattactacaatcttactgagccgaagatggagctcttcgccagaaggctagcagggccgaagcgagcacccacggaggagtcgcagcggttttcgtgggagatggcaaagaccgccgaatccgcgagaacggcttgccaaacgctccgcctcgcccttaccgacatgggcgcgaaggtgcggggggtccctgccgaggatgcctcagccttcgacttctccgagtggacccagcaggctggcggatcggtttcggactgcgccaccgcgtacggcgattgctgtgcgcgtgtatcggcggccttcaccttaggccttttgcagcagttcggctgcgagcacgtcgcggagttccctacctatgcgaagggggaatgggagattagtgcgcagaacatttcgcccgctcttcgtgcgtggcgaaaacagttctggcagaaagacggccggtccgctgccaaggcgcgccttctggagcaactggcgaaggcgaaggcggcaggtcggggcgaaaaaaagggcgcggcgggcgaagaggttggaggcgatgcccaggatcacccagaggtgtgaggccctccgccctttctttagagttttgtagttttcctccctcttttgcgttcacctagagaggcaaatgatgtacattcggcaagttgccaccaaaccttaaaaaaggcttttttctatatttggaatgtatgacacaatgttaaatacttttttaatgatcaaagtctttggcttattatttcgctcatttcgcatcatgccataccgcccccttctttcgcctaatcctactatataagccgtgttttgctttttctgcgctgtctatcagggggttcgccgaaagttgtgcattcggcccccttccgggagctggcgaagccaaaacgagaaatttgtggcattgaaggacctgccgaaggtgcgatgtccatttcaccctgtttatcacgaaatggagataaacggtcggagctataaggttttcaaggttgccgactggctgcggtcgcaccccgggcgaaccttagaagattacgatcttgttcattcaagacgtttggaggatatggctcgcttttggcgaaaccatcagaggactaaacgtcaggaaacgatctttcagcgtcgttacagtttagtctgtgtttcgccccctactcctcttaagattgtgtatgatattagtagtgatgacgaacctagttcgcctgatcattccttagggagggatagtgattatgggggcgaagatgtaatttacttgtaaggtgaattgtatcgtgttgtgaaacttctattcttccatttttttcgaagttaataaagacgtgttttatttccttttcgctattgtttgaatcgtcgcattttgtgcttttgttaggtcggaacatgccggcccctttgcgtatattagcgaaataggtgtactgacttttaaccttttcgttgttcgttttcgatctgtagcgttctgtgtcgaaagaaacgcttttgcttttatgttgatcgaacgtaacgtcgttcggctagttattttcctagacaagctgttgcggtttcaacgttcggcaagcgatgcttcggccgattcgtttcgcccccctagcgtttttcgctgatcaggcgtttgccttggggtttttccacaaattatcaatcacacgaaaaataaaaagaaggcggaggacacagagattttatactggttcaggcctccatggtggataatagccctacatccagtttttttttctcttttttctctctttcttctttttttgtgttgccgaaaggcttacatagtgccgaagggcttacatagtgccaaagggcttacatagtgccaaagggcttacatgatggtatgtacatttttacaagttggcgatttgggtgccacccattctagacatagaagcgcttgagagagttggcgttccaggaatggtcgaactcctcgccttcgagtgtcgctaggcgaaaagatcccgtcctggacttgtgtttgatgaggtacggtccttcccact

SEQ ID NO: 87984 - DNA, 2712 bp, Oryza sativa
agtatttcttcaagtacttgccattgagcgctcgtccataaacttctccatcaagtccttgtagcatgtacactcctttagacacaaccttatggatttgaaaccgtccttcccaattcgatgaccacttgctgaatttattatcacgagttcctatggcaaaatcaactccaaacaagttctccctgagaaaaagatttgggcaccacttttttgttgtaatgttgagcaacgcgttccttatccttggtaacttttgcaagagctctcaacctagactgaactaagtcttccctttcatcagccatgagatcataatattcatcggctgttaactcattttgtaattctgttctccttgagccgattcgagcttcccatggtaaaaccgcctcatgtccataaacaattttataaggaggaacttggatcgaaccgtgacaagccatccgataagaccacaatgctttggctaacctagtatgccattgccgaggataatcggaaatctttctcttaatcaacttgatcaaacttttgttagatgcctcggcttgccctttagcttgtgcataatacggtgaagaattcaacaactagatacccatgctatcggcaaactgcacaaactcatcggacacgaagattgagccttgatcggttgtaatggtctgaggaatgccaaatcgataaataatatgctcttgaacaaattggacagcatcccccaaatcactttcttcaaaggaatcgcctctacccacttggtaaagtaatcggttccaccaatataaatttgcgtcccttgctcgaaggtggattaatcataccgatcatatcaattccccaacctctgaatggccatggcttgatgataggattcatagccaatgccggtgctcgttgaattgctctaaatttttgacaatcttgacatcctttgtaatacttgaagcaatcttccaacattgtcggctaaaaataccctgcacgtcaaagcaaccacttcatcttatgagccgattgatgagttctacaaattccttcatgtacctcgcctatcgcaaccttggcttgatcggcactcagacatttaagcaacaacccatcaatcgtccgataatataactcatcatccaacaaggtgtacttcaaagccttatagcgcaatttttgagaagccgattgagatggattctgcatatattgaaaaacatcatgtctccaatcaccggctattattgtggcaacttctacatcaatatcttttgttatcggcttgtatcctgatgctccctgagccaaatcattagcttcaacattttgctctcgagacacatgttttaaagtcactagcggaaacccatccatcaactcttggcacttctcattgtagaccatcagtgtatcattcttacattcatattctcctgccaattgactgatcaccaacaaggaatcacccacaatttcgatagcatcggcttcaacttccttaagcaactgcaaccctttgaggaccgcttcatactcagcctgattattagttgcataaggcttaatagtgtaggcaaactcgaaacctgccccccgaggagaaattataaccaaaccgataccacaaccatgagtgcacactgattcatcaaaaaataaagtccaaggcacaatttcaaccgagccgattgagacatcacgatgatccacaataaaatcggctatagcttgtcctttaatcgccttcagtgactcataccgaagatcaaatttcgtcaaagcaaatatctactttccaacccttccttttagaatcagagccgataacataaacttgactacatcggctttgcatatcacagtgcattcattggacaataggtaacgccttaactttgtgcaagagaaatataaacacaaacacaacttttccataggagaataccttgtctctgcatccaaaagcctacggctcaaataaaacacatccctctcctttccctcaagctcctggatcaaaactgagccgattgacttgtcacgtcccaaaacgactctaaaatacatcctctaaattatgcctagaataattaaaatccgtgtgaaagcctccaacaattaaaatgtgcaaagttaaaagtcaaataaggcttggaggatttttgtatatttcctaaaagtctaaaatgcgtaaataaattttagtggaattttcagagcacaaataataattattaagaaataaacaaagttaaaatggttttataaaaagaaaagctctaaaaagtcccttttccctccctctccctcttgggccggctcggcccatctccctcccctccctctcctctccccgcggcccatccggcctctccccgcgcgcgcgccgctaacgggcgggcccgcccgccaccctcgctgacgggtggggcccacccgtcatccccttcctcccgccgctcccgccgcctcgcccgcgccctagcgccgacgccgccgcgaatcccgccgcctcccgccgtccccgcgtgcaatcaataggggggaattattccccgggatcccctccccctttccccccttttttccctccctctctccctcggattcatttggaaacctctcccctaacctcgaccgcgctattaatggcggccgggtctcccgcgcccatttccccgcccttccgaccggcctctcttactcccaaaccta

SEQ ID NO: 87985 - DNA, 749 bp, Oryza sativa
attcagaggttggggaattgatatgattggtataatcaatccaccatcgagcaaaggacacaagtttattttggtggaaatcgattactttaccaaatgggtagagccgattcctttgaagaaagttgattctggggatgctatacaatttgttcaagagcatataatttgtcgttttggtattcctcagaccattacaaccgatcaaggctcgatctttgtgtccgatgagtttgttcagtttgcagatagcatgggtatcaaattgttgaattcttcgccgtattatgcacaagctaatgggctagccgaggcgtctaacaaaagtttgatcaaattaattaagaggaagatttctgattatcctcggcaatggcatactagattggccgaagcattgtggtcctatcggatggcttgtcatgtttatggacatgaggctgttttaccatgggaagttagaatcagctcgagaaggatggagttgcaagttgagttgacagccgatgagtattataatctcatggctgatgaaagggaggatttggttcaatcaggttgagagcccttgcaaaagtcaagggtgcccaagtctttttcgaaaggtgaacttgtgtggaaattgattttgccgatagggacttgagataacaaatttggcaagtggtcaccaaattgggaaggccgtttaaaatttataaggttgtatccaaaggggcttacatgttgcaaggacttgacggtgaagt

SEQ ID NO: 87986 - DNA, 864 bp, Oryza sativa
atataagggagaaaagaaggacattctagaaagaattgatgccattgacattagagtagaaagcatgggtatgagtggttctgatagagaggagagaaaggaacttgaaaatagactcaaatttgttattagggaagagaaactgaagtggattcaaagaagtaaaggaagtattacaaggggattgtaatactatgttcttctatgctaaggcaaatgggaggaagaggaagagtcagattcatagtttgtgcatgaaggagaggtgattgaaggataagataagtttgttgcttcatattagaaatttttacaaagatctctttggacattcaaaggaaaacatgttttcaattgatatggcaaatgtatctaaggtggcaaaggaagatatgaagatgttaaccattcctatcactttagaggaactcaaaacaatgatttttgaactaaaaaagaacaaagccccaggtcccgatggaataacaggagaattttacatgcatttttgggacttggtcaaacatgacatgattgacttgataaatgattttatcaagggtttaataaatattgatagattgaactttggagtgattacattgattcccaaaacaaaagatgcctctcaaatacaaaaatttcgtcccatatgtctgctgaatgtaagctttaagataataactaaagtcctcatgaatagactcaacacaatcatggcatacattatctctaaacaacaaacaacttttctgaaaaatcgtttcatcatggaaggaatggtgatattacatgaagtattgaattcagtacatcaaaaaaatgcagagtgggatcttgtttaaagttttattcgaagaaaca

SEQ ID NO: 87987 - DNA, 507 bp, Oryza sativa
gaatgcaactctggtaaaaatttgcatgcactcatgaaaagggagtgcacccaccttgtacgggtctgaggtaccaaccatagatgcaacaacattttcgcgtgtagtaacaattatcacactaccccttgcaccacttgacaacaaattcctcagctctctccattcatttacatcacgagtccacagatcatccaataccaggaaataatttccattctgcagaattcccctgagcttattttggaaatgttccaagtttagatgcttgcaactctcaccactggcagactcgattatatcttgtagtatatttttcagattaaatttattagagacacaggcccacatcatcttgctgaacctctccctgatttgttgatcatgatacaccatatttgctagttcagttttcccaatgcctccaagcccaagcagagcaagcacaaaaatatcatgatgttctgctgctcttagtatcttactaacaatctcatctctagcatc

SEQ ID NO: 87988 - DNA, 811 bp, Oryza sativa
ccaactaatccgaagaagaaaacctccagtcgtcctttgccaaaaatcagaaagtcttccaggtacaaatcatttggccatcttccttgtcttgcagcttaccctctgttgaaataatactaacagcataactcaaactcgtaggaagccgtctgacatagaaccttctgaaaaagaccccgagccggctgacatagaggcaaacccttcaaaagaaaccgggccaactgcagaggatcgtccgagtgacaaacaaccggcaaccgacaatgtagaacccagcaacgagcccccgactgggaaccagtcggccgaagctgaagtcggtgctaaccaggagtccccgactggaaaccagtcggatgcagggccaaaccaaaagattcccgaggttgaagctcaaacgaacagtcctctcgggaaggatgctgacagtgaatcagaaaccagatctcctgtgaagacaccaaagtccactcgtccccgaccgggaatcatcacaggtagacacgctatctgaaatcattttgatccaacagactttatttggctgcttcatcttcattcatggatacactagggccaataattggtgatgaagaagaaatcctccggatacaagtagctgaggattcatgccctccgattctggtcaagtggtgggatgacaacatgcagcctcaagggatcgtgataaataagcaaaaagaggatgaagagttatgcctactgaagaaggcacttggtcaggcaacccgcattgtaaatgtaagccctctggtacctgatctcaaccatcttgtttgccatt

SEQ ID NO: 87989 - DNA, 652 bp, Oryza sativa
cctttgctttcagaatcggatagataaagacccagtccccttatcgtatgtttcttcgaataaaactttaaacaagatcccactctgcatttttttgatgtactgaattcaatacttcatgtaatatcaccattccttccatgatgaaacgatttttcagaaaagttgtttgttgtttagagataatgtatgccatgattgtgttgagtctattcatgaggactttagttattatcttaaagcttacattcagcagacatatgggacgaaatttttgtatttgagaggcatcttttgttttgggaatcaatgtaatcactccaaagttcaatctatcaatatttattaaacccttgataaaatcatttatcaagtcaatcatgtcatgtttgaccaagtcccaaaaatgcatgtaaaattctcctgttattccatcgggacctggggctttgttcttttttagttcaaaaatcattgttttgagttcctctaaagtgataggaatggttaacatcttcatatcttcctttgccaccttagatacatttgccatatcaattgaaaacatgttttcctttgaatgtccaaagagatctttgtaaaaatttctaatatgaagcaacaaacttatcttatccttcaatcacctctc

SEQ ID NO: 87990 - DNA, 2174 bp, Oryza sativa
agtatagattaacagtcttacaatttgaagtgcatatgcatgtaagtattatagaaaccaatgaatttatgacagcaaaatggcaaatatcatactaaagagtaaagaaaccatgatctgtagagagagaattaatgaacatctgaaagatacagattcatacctgaacacgactccatagcaagggaacagcaactttagcatgattcttgacaaaaaattggtccatagtggttgatttgggaactctaaaagaagagtgtcagtttgtgtactcaagttgttgttgctaacaacaagactcttaggtacagcctcataaagagttccggcagctcctgcattatctggacagcccgaactcttcccccctgaaaaaggtataaacgttaattcaaacataaacaaaacaataaaattgtctacactatagctccatccatattctatatatcattagaaagttactcagaatatgagcttcatctcattaaacaaaagactaataacatactgaggcctaacagtaataaaaaggagtctcagaatattttgcgacaaacaatacagtacgatcatgttgcctgcaaatatatagttgctatttgataatctgcatttcagggatataagaaaggatcagtgtcacagtgtgcataagaccaagcacaataccatgagcaaaaacttgggtgtcatcatgtctcttgaaaacattaatagaatcgagtcctccaccacccccagccaggccattccctcatgaagcctatcttgccagctccatgcctgttgcaaacagaagatcagaaggggaaagtttgcaattctgcatgggcttattgaatatactagagcgcatagtcaacagatttataacaaaccaaaataacagctagttcaagctaatgaaagcattcctcaactcaaatgccactcattactgcattggtggtctagtgtttagctggattggtttgaactaccaaatatgtgcaattgtgaaagttggtaacaataaaatgaaactattcctatattcatttattagtcaatcaattatatgcataatttaaccactgaactaatctggactgtgacattaatttctcttattaacacctagtgcaaaaaaaaatcctcaaatccaattgtctagtaccatagtcaagcttgagctcatgactacatactaaatatgctaaactcatacattcctatcacattagtccttaacttctcaagtgttaagaaaaattacaaccagactgaacatttaataacttcatgttctttttgttcgttgaagaagctgcaattccattgtggcggctaatcgtttattaacaaaaatataaacagcatgacaggaaatcttgttctcatatctattagaccgagcaagcctctgtaaatccctaatatgtttagtactacctccccgcatccatgactcattaataacaaaatgaaaaacaggtataaatacgaaataaatcctactgaaccaatatattcatatgtgacctcagctttggaaactgtttctaatctgcaagtttgttaggcagtttaaatgcccatgcatcatttcaattagcacatgtaggaagcaggaaggaatttgaagcaattctaagaacacttacatagtcttagacttgatatagatgcttcccccagaaccaccaccgcccttctcgctgctatcccctccatcggcgagcactgtgccattcattatcaggtcatcggcatacagccacacgataccgccgccgcttccgccgtagtccttctcaacgctggtagagccccctttgcttccatagctaaacgggtgctcgaggtcggaccacgcgtaggcgtcaccgccccacgagtcctcctgcgtctgcccatccttgacgtagcagctggcgccacggccaccgtggccgccgccgtcgccgtgcgtccccgtgggcaccccgctggtccgctcgggcggatcgccggcgagcgcggtggtgttgacaacgaccgtgtcggcgattgtgacgttggccgcggcgagggagaccctcccggcgatgacgcggacgccgcggccgaggcggacctcgccggagaggttggcggagatgacgcagccgggcctctggcaggtgagggcggcgccggcgaggagcacg

SEQ ID NO: 87991 - DNA, 776 bp, Oryza sativa
cgccaaatgtttggccacccgtggggcatggatcaatataatctaaatacaaacaaacaaacaaaccttccaacaatcacctaatgcttcatacggggcaccaaaatgaaaaatagagcagtggaaatctcgagaaatgagaacggaagaaaatagtcgtcaacaaagaaccaggaaagctacacaaggttttcatctggggaattcacaacttgcctattccgtcatctatctattgggtagttgttaactgcaatgatccatctttctgaagttttaggctgaggctagtgaaccgttctcttgaatattgtcttgaggctttcctccaatctgttccggccttcatcattgccgcaaactcatcatagcttatcttgccatcctgaaagtacagaacaatgctattaatactttcagagtcatgtgtgctatgaatcattatgtcaaaacattttgtgcacaccaccaaattaattaaactatttgaagaagaaaaaactagcagtctatcaatttcttaaaactagtcaatgaagagccacaaaccttatcagtgtctacatcacggatgatggcattgataacctcttcatgatttgctcccaggtcatcagccaatgattcacggagctcatcgatttcaatatatccactctggttccgatcaaagtatgcaaatgccttgtgcagatgctcatcgttgccaatctttctcaggtgaacagatagagcaacaaactccccgtagtctaaagatccatttccatcgacat

SEQ ID NO: 87992 - DNA, 1115 bp, Oryza sativa
gatggcaacgaggcacccatgatggcttggtgttgttggtaggttgcaccctgcacgccgagaggattgataaatgcaggcatagtgtttgcgccattggcggcgtcgccggtgtcaatggccacggcgccatgtccgacaacgagatcaccggcatgctcatcgccctggtcgtcgccggccagcacatgagctccagcgcgagcacctggaccggggcgttcctcctccgcgaccccaagcacctggccgccgccgtcgacgagcagcggcggctcatcggtgacgaccgcgtcgactacgacgcgctgacgacggggatgagcacgctccaccgctgcatcaaggaggcgctccggatgcacccgccggcgccggcgctcgtccgcaccgtgcgcaggggcttcgccgtgtggaccagggaagggaaggagtacaggatgccggcagggcacagcgtcgtgtcgtatgccgcgttcaaccaccgcctcggctacgtgtaccgcgaccccgacgagtacgacccggagcggttcggcccggagaggaaggaggacagggtcgccggcaagttctccttcacggcgttcgggggcgggaggcacgcgtgcctcggcgagcactacgcgttcctgaagatgaaggtaatatggagctatttgctgaggaattttgagcttgagctggtctcgcctttccccgaggttgaactcaacaacataatgctagggccgcgaggggaagtgatggttagatacaagagacggaagctgacaagcacctagtgcattaagttgtaattacagtcaaaattatttgagagcagacgtactctttactactacctccgtctcaaataagtgcagccatggtattcgtatttaatatttgatcgttcgttttatctaaataaataaataaataaatataaaaaaatagtcacgcataaaatacaattcatgttttatcatctaagagtaacaacaataaaaaaatacttttaatccaaaatcataaatattttaaaaataagacgaatagtcaaacgttgaatatgaacaacataaaactacatttattttgaacaacataaaactatatttattttggaacgg

SEQ ID NO: 87993 - DNA, 981 bp, Oryza sativa
atgcattatggaacattacttcactggtcaatgttgtaagtatgctatgtccatctgcatttcattgttgcatgcttatttgtctatattgtattttgagatcctaagacggctgtagttagtgtctgccattattcactggttttagctttccccgattttgttcttattgttgatttatcttcataatcctcttcccatgatattcaggttgtggcttttgcttgcggccttgtacactacaagtcatcaaccaaaagacatcctagtacgcagccatggaaccttggaacgtaagtgccatttccctttgcagttatatacaatacaactaaatgcaattaggatatggatgcatttttttcccctttgccttgtcttgatcctcctttcatctcatcggcgcattttcaattctatcacagggatgaaagtggctggtggctcttccctactggactcatgttgctgaaatgcatccaagctaggcttgtcgattggcatgtggctaatttagagattcaagaccgcgcagtatatagcaatgacccaagcatattttggcagtcatgacacttggcattactactactaaaggttcttttgggagctttttacaactcaattttttgggagttgataaaaggaagggtgggggtactcaaagcacggcctttctttattgacctttggccgaagaagaagcaactactacagtgggttatagatgcaatttccgcgtccctctgctaatcatatgtgcagtcacaaccaacctgtattttggtgttgtatatataaaaaaggtgtacttgatccattatttgtaggatttagacaccatagagtttataaacagttcccaagctaactgaagagatgtgattttgttgttgttgctactgctcttgttgtcggtgctatgtactttgcctctagatgttgagctgggcaaggcaggcattgactgtgaaacttgta

SEQ ID NO: 87994 - DNA, 672 bp, Oryza sativa
gtttcatccttcttcataggcatgtctggattcaggcttcttctatgtggtggatcatggaataagccaggagttaatggatgatgtttttgcccagagcaagaaattctttgaccttcccatcaatgagaaaatggagcttctccgggatgagaagaatcgaggctatacacccatgctagatgagattcttgatccagaaaatcaagtgaatggtaataatatttaactcctgcatgtgttgtttattattaaaattgcatgtcatgatgtactgacatactcttggttttgagattattagcaagctattaaaattggtagcaacagtacctcccaaagaaaagttgataaaaaaaaatgttatgcatagacagctgccttgagtaaacctcatttcattttctacagttatgtagtttttcctgctccaggtttcatactattcatacttgtgcattttcaggtgactacaaggaagggtattatataggtattgagataccagaagatgatccacaagcaaacagaccattctatggtccaaatcagtggccatccgatggtgagttgtctttcttctgttattagaaaaaagaaaagatctcttccaaaactgaatgctaatgaataaaatacacactgtctaagttattccatctatactatgct

SEQ ID NO: 87995 - DNA, 674 bp, Oryza sativa
actatcaagaattccgcctgtgatccttttgcgcataagagcttccttaattctagaatggcctagttgagtatcagcatgcatgttctgtgttctgtatgatgcaacaagtcattaggaataaatagtaatgaaaaagggaaagaaaacaaatgatcaggacgaataaaaatagtaactcacagtgaatgttgctctattttaattctagggctaccatcaagctctgcactcattggttcttcaacagcataaacgacaagaccaagttggcaataccctaatgctgtagcttggaaccaggcaagatcaacacgaacaccattcacacccagagagggattagcatgggtttcaagccagtcgaggacaggaagaaatgttcctctgagacttccacgtcgaaccaaacgcaactgggcattcaatccagctacaagacggtgccatatcgatgagggaacagcctgtaatgtttaaaatagtgttatagaagtataagaaaaagcttcagaacataactaatgcagttagaaagatcttaaaatcatacctgactcataaggctagtgagtacactatcactatggagtgaaaatggagccatgtaacttccatcacctccaaagatcaagcacattggaaacctttggcgaagacgaagtggaagatca

SEQ ID NO: 87996 - DNA, 590 bp, Oryza sativa
agctgtctgtagcagaatttcgaacactgaaatggctaggaattacctaggttctacttctatgagcatcatttgtattttgtaagatttaaaaattgttaaattaagtcaaactggattatataccaggcccctctacttgatcagatttcactccatgtgtcaataaaacaagactccagaaacatttttgctagtttcattactaatgagtccaatattagtagtatgtgatacatcaaacactaaatagtaatcctggattctatatgataccaatcaaatcatttcaggttttgggtcaaaagcataaactcatttctttgttaattagtgttagatagtaaaattagcacctatgattaatcaaatgctacccttaacaagagtcacagaatgagaactacaggaacatacccttccttcacaaattcctggaagaactccagctccagtgtctccgacagcatgacgacacaagcttcagggtgttgccgcagtaggctctccagcccacgctggtgccgtacgccatacgcccactgtgggctgttccacaccatgaacaccttcacggagcacttcccatg

SEQ ID NO: 87997 - DNA, 535 bp, Oryza sativa
tttggtttcatgatctctcaagaagtggtggcgaatatctatgtgcttggttcttgagtgttgaacgggattgttggtattttgatggtactctcattatcacataggagtgggatcttggtgaagttgtagccaaaatcttttagggtttgtttcatccaaaggagttgggcacaacaagaaccggcggcgacatattcggcttcggcggtggatagggcaatggaattttgcttcttggaggaccaagaaacaagggaccgcccaaggaattgacaagtcccggttgtgctttttctatcaaccttacactcggcataatccgaatcggaatagcccaaaagctcaaagtcacaacccttaggataccacaagccaatattaggagtatgaactaaatatcttacaattctcttgacggcaatcaaatggcactctttaggctccgcttgaaagtgagcacacatgcaaacactaagcatgatatcgggacccacattgagcgatataccttttggagcgatataccttttgg

SEQ ID NO: 87998 - DNA, 1146 bp, Oryza sativa
tattatgccgccgctgttgggcctttatacaatttcaccgccggcttgcttccgtcgccgccgactggtgcctccgcctacacggctggcctattatgccgccgctgttgggcgtctacgacttcaccgccggcctgcctccgtcgccgcgactggtgtcctcgcctatacggttggttggtcacaccaccgttcatgggcgtccacgtcttcgccgaccggctggccttcgccgccgccgactggtgtttctgcctacacggctagcctattatgccgctgctgttgggcgtctacgacttcaccgccggcctgcctccgtcgccgccgactggtgtcctcgcctatacggttggttggtcacaccaccgttcatgggcgtccacgtcttcgccgaccggctggccttcgccgccgccgactggtgtttttgcctatacggttggcagacttcgccgccgttaatgggcttcatcatctacaccactggcttggtgccactggcgccgactggtgtttttgtcaccatcgatggactgcttcgttcccacatcggctacttttgctgtcaccgagggaatattacaaagctaagtcatcatttattttattctttatatgatattttgtcttttcctttgcctcactacatcaactggttcgccgttgactagtgagtcgggggctatagatgttatatcgtattttttaaacaattttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcagaataaatcaaaagcatagagatgagataaatttattttctgctcttaataattgcaaaagtacccgagtagtaaattctgattcgtgaaactttggtccattaatggcgaactcatgtcactcatatgcatgtctgggaagtgcctaggccgactcccggtgcttgggggctatgactagtcggacagagcgtttaaacgtaatgaatcatctgctcggggaaatcaaaattgacaagagga

SEQ ID NO: 87999 - DNA, 583 bp, Oryza sativa
cgctgtcgccgcgctgaccccttccaccaccaccacccgcctcgccttccgccggcagcggcagcggcagcgccagcacgcggcggcggctagcggccggcccgctcctccaagacatggccgcccgcttcggccccctcctcctcgtactccccctctcctccgcgctgctcgtcctctccgccgccacggcgccccgtggccgtcccagccaaggtatgggagggttgtggattgttcacgatcgtgtccgtgctagagatttgttgttgttgttgctgctgcttcgctgaccaccttgttgcagtggatgtggggaggcagctgagggaggagttgtgggagagaaaccaagggcacgagatgctcaggtcgtggcgcgacggtgacccgtgctcgccgtttccatgggaagggttctcttgccgatggaaggacggcaacctcttcgttgtcaagctgtgagttccctgaatccctcgttctcactctcacgatcacggccatccattggtgctattcattcggctttgatgagaatttatttggtcgttcctttgcatttgttatatatgcaagtatg

SEQ ID NO: 88000 - DNA, 667 bp, Oryza sativa
ttcctgcagccctgtatttacccaaaaaataactaactagaaaaaaaatgaatgaatccatcccaagttaaatgttatttgttaaattgcccccggtttttcttagtctcgtcctctgaattgtacatggtgaagccgcgatgaaccattcaaattacagcctggacatgatcatatgtcttccttgcgtgacctcatgcttggttttgttttctatgttctccaaaactgcggtagccgccgatgttacgagctctgcaagatctctgtagaggcagatcaccattacaaatgcgtcagttgcgatcaaacgagaagctaaccgagcttagctactaagtatgagaatataatggcgccaaatggctgcagcattttaaacctacctgtgtcgtaggtgaggccgactgtgttcttgacctcgcgtagcgcgaatttgaagcgttcaatgtcgcggggatggtgagcgacggactcgacgacggcctgcgggaggacgagatccgagggtttgatgttgtaaaacaccgggatgatctttttccgtgactcgacgaggagggcgagctcgcggaggcaatactcggagtcgcagtagtgcggcgagaagatggccaccgcgacgccgcactggctgatggcctcgctgatccgctcgtcgaggcga

SEQ ID NO: 88001 - DNA, 548 bp, Oryza sativa
tgaggctcaagatgtcttcaagcgcttcgccaagcaagcccaaaacctctatgatctcaccatcaagagggtacgaagtgacaatggaggagaattcagaacacacaagtggaggaattccttgatgaagtggggaatcaagcacgagttctccgccccttatgatcctcctaaaaatggcattgttgagaggaagaaccgaactcttattgaagccgcaagagcaatgcttgataagtacaagacttcggatatcttttgggcggaggccgtgagcaccgcatgccatgccatcaattgcctgtacctccacaaaattctaaagaaaacttcatatgagctcttgagtggtaagaaccaaatgtttcctattttcgtgtctttgggtagatgctttattttgagtaagaggcctcgttcatctaagttctcacctaagggggacgagggattcttacttggctatgagtcaaatgcacatgcctaccgtgtcttcaataaaaccttcggtattgttgaagttataagggatgtgacatttgacgaat

SEQ ID NO: 88002 - DNA, 816 bp, Oryza sativa
cgttagtgccgtcatttcatgtcggccaccattactcagctcgtaataaccactctcttcatacaaatccaatgttgccgttttataaaaggaaaggagaggagatggtcctcactaacaatactgagtagtagagaaagagaaagaacggagtgcattgaggaggagaggaagccgcataagagaggaggcagtggagagaagaaaataattgcacgtaagcagtcagacgcgccgaaagtgtcctcgtctctttctaaatatgcatattttctctgaacaacccattaataattgagatggtgcgcacttctctctctctatatatatatatccactagagttcaaatcatagtgtccatagatatggttaccactgcatgtggttccccctatgtgatatggatctgtgctgaacatccaaatttctcaccaatttttgtaagagttctaaaattttaatcccttctcaaattccaaggtagtacaccaagcactataagcttgctacttgctacaatgtatacacacacaaacacaaccctagctagctacccagtatatacatactgtacttgtacacagcttaattaatttaattgaattgattaattagacgttgacgaagggcgagccggtgaggaactcggtgaaggcgagggcgacgaggccgagcatggcgaagcggccgttccagagctcggcgtcggcgctcatcacgccgccgctcctcgcctccgcgctctcgccgcggagcagcggcaccagcgacgccgcggagagcacggtggcggtggcggcgaaccacgcgagccc

SEQ ID NO: 88003 - DNA, 2144 bp, Oryza sativa
actggcaatgctgcttcatcaaaacatcacccaaaggcagcagatatctccaattcaggaactccacatcaccttttacctgttcttggcctttgtgctccaaatgctgatcagatgaactcatataaagggtcagtttgtgggccaagcacaaaggagcaaaaaagagctagtggtgaactagccaacaaaccgctgttgactcctgctgttgatcattctagcgaacaaaaacatgatggccaaccaactccttgtaagcctatgtttcctggttcctccgaggagactttgcgaaggctgaataatatcattccagacagttacttccccttccaacctgtatgtcctcttctttctttggtagcatattatttcatctagttgctttatcgttgttcatgctttttcttcaaaagtgaaaaatataagatagttgtccactttatacttattaggaggaaatggtgcaacctaccctgatattagtttttaaaatattttttatggatgcaaaattgggaaaaaaagaatccattcttgagtacagcatatatgatgttttatctagttaagagcatcattaaagaaaaagaatgacaaggtttttgtgtgcagattcctcctatatccgggaaggggattggtgatcatgtagaaaatcctgtatcgtccattccttcatttcaagggaaactgggtcttcctaattttagtctggaagacagtattccacttaagcatttgaagtcagtaccggatctatttcccaacttgtctttgggcactagcaatgaatatcttcgtaattgtgtcccagaattgccaaatagttcatttctaccaagctttatggcagatattgctggaacttcaaagcagaagaacaagttcatggcagatatgtctggccttcttccaggtttggcaatcaacccagttcaacaaatccattcgtccatgcctgaaaatcataagaaggtcttggacaaattaatgatgcgtgctcagtactcctcaagcaagttcttgaagaatgcctcaaataaattcctgaagaagagtttaaaaccagactattggtcagaagatgaactcgatgctttgtggattggggttcgcaggcatggaagaggaaattgggaggccatgcttagagatccaaagctgaagtttttgagccaccgatctcatgaagagctggcctcaagatggattttggaggagcagaaaattatagaggaaccaatgcctacagccaccagaagctccaactctacatcatttcctggcatatcggatgcaatgatgtctcgggcacttaatggaagtagcttttccaaactgaggatggagccgccaaagttgcagtcccacctaactgacattcagttaggttgcaatgatataccaaccagattttctcatgttgagcccactaattacatgaatttaagtgagggtggtccatcactgacaccgtggcaggatttcaaaaatagatcaggacacagtggagattttcctggcccacttgacaagtgggagaaacctgatatggggttgatcccaccatttatgccgaatccttttatgaaggaaagcattgggtcactgcccataaacagacacagcagtaattccattcagcagaatgaagttggatcaagttctcatgagagcatacttcatggtttttcggacggacaggccaaattattccatgagatgcaacggcgtgtgaagttagggaaattacccattgagatgaatctgaatcacacaaagctgtcagatcctctagctgagaactctggtgattttgaaagttcaaaaccgaacaagctaccgcactggcttcaggaggctgtgcgtgcacctccatccaagccacctgaatgtgagctaccagcaactgtttcagctattgctcagtctgtgtgcctactacttggagagcaaaaaccagcaatacctccattcccgattccaggacctcgtctctctctccccaaggacccaaggagtgctccaaagaagaggagagttcacaaagttcagcaagcttcctccctggtagatcattccaaaactacagttgggcaaggtgaccacaactctactccgtcagcaccactatccat

SEQ ID NO: 88004 - DNA, 545 bp, Oryza sativa
gttcgcgtggccaagatccaccccgtccacccctccttcgtcgagggtcccgtcgccggagaagcccgttcccgtcgtgccgacggtaaagggtttgccatgtcccgcccgccttcggcccagtattcccgcctcctataggcccctctcttcctctctaatctctttcttttcgttctttaggtcgtcccggtcgccgtcggccgcgtgtcgacttccctccgtcgctcctcgtcgccggtcgccgccgtccccttcggtgaggaactccctcccctttcctttactttcccgattcccgtgcgtcgccgccgcccgcgctcgccgtcgcctttggtcgttgccgccgtccgctgccgccgctttcgcgtcgcttttgcgccgtcgcctctgccgccggttgccgtcgccggcaacgcgttcgcgcgcgcgccgtcgccgctagccatggccggccggtcggctttgatgccgagccaagcccggcgggcgcctctatcgccgcccgtccgatcggcccgagggcgatctgggccgtcggtccc

SEQ ID NO: 88005 - DNA, 550 bp, Oryza sativa
gggtaggtgagcatagcggggctcacctaaccacatttattgcggtttgaacgagcgcgtcacgccgcatgtaacgcagtgcagcgcactcgtttatccggtctgtgaccagtcacagaccgatcagatcgtgggttaggtggcgacaggcggtctgacgtacgcctcgccccatcccgtcaggatgagagcctccaagcactcatccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacattggtcatgtcgtcagcagacagccatgttcccacgtcgcgcctgcttccggcggaagtggaggtaggtatgggccgtcccatcagaaggtcattcagacggcaaccatacaagtctccgtctgtttatgaaaatataggataagtccccacaaaaaagagagagatg

SEQ ID NO: 88006 - DNA, 619 bp, Oryza sativa
ctcgctcccgctcggtgagcgcgtcctcgcggttgcggtgcgcggactcctcttcggcgcaggcggcctcgtgcgcagtcagcgttgcctcccggatggcaacggcggcctcgcgatccgccaggtccctctccacggcgcaggcacgctcttccagcgccatggcacgggcctcaagggcttcttcgcgccgccgggatgccacctcggtctccgctgcccgccgttctcgggcagcggcagcgtcaaggaccccccgggcggcgtcgagcttcttccctagctccgcctcccagctcccgtattgaaggcggagggtgtcctgcgcctcgttcatcacggtggtggcgatgagggcagccccccgctcctcctccacctccttggcgatctcccccagcaccttccgacgggtttcgagctctgagacgtgccggcggtgtgccttgcggcccacctccaccatggcctccaccgagcgtcgcccctcttcgacacgcgcccatgcggcgtcgagctccgaacgctctgcatgcagggcctccacctgggcacttaacccgtccaacaccgtggtgtttgcgacggccaaggcctgcagaagggtaccgagctcgaa

SEQ ID NO: 88007 - DNA, 552 bp, Oryza sativa
cgcttcaaatgcttatgtgctcctctgcttatagaataccttctctcatcctgcataaaacattgtagttagctcaacatgatgtagtcttggaattttggtatggcaggaggcaagtacggcaccctgctgtattcttctagccatctctcttcatcacatgaagccatccatttttcaaccttgtccattatttctttacgacttgttgcctcctcttttactttgtatatatattcatccattgtctttagtagatcatcatggtccacatcccctgttcatatttttcgcaagtactgttattagtcaatgttgtagaaagttctttgtactttaagattataatgaaatctaattggcatcacacacctgacattatcacatccattattttgttcatctctgtctggtaaggcatatccatgtgtgacttcttgcaaatttcctttatctcggtttgctttatcatgaagagctctttcattttgcttgcctttagatggtctagtcgctgaacttcagattcgatctgtttcatgcaatagtgga

SEQ ID NO: 88008 - DNA, 845 bp, Oryza sativa
ttgaatgtgcaaaggagcagcgacttctgaagttgatccacgttctgtatcagtactggtcgaagttgtaatctctagaggtccatctcgatcagcatcaacagtacccgaacccaacgaccctggccggtctgaccacacgtcctgcgccggtctgaccggaggtgtgccggcggtctgaccggcctggcgcccggtctgaccggccgacccgacctcatcgtcgtcgttgtcatcgctctcgtctacaaaaatacgaccattctccacctgaacctgtgacagtgtacctgcaatatcgagtctagtacctggactagcctcatcaaaagaaacttcgcaagtctcaacgattttgttagtctccaaaataagtacacgatagccatgagtatgtgcggggtaaccaagaagcaatccatcggtagaacgtcccacaaacttatccaaatttccagatttcaagacaaagcacttgcaaccaaaaacatgcaaatgtgaaactttgggttgatgtccaaatcgaagttcataagaagtttttccaagtttagatctcaagaaaacccgatttgaaatataacaagcagtgttaatagcctcagcccaaaattttctaggagttttatattcattcaatatcgttctagccatctcaaccaaaacacgatttttcctttcaacaacaccgttttgttgaggaacatgaggagaagaaaattcatgttcaagacctctttcgttgtaaaattgttcaaaagaagcatttttaaattcaccaccattatcacttcgaattcttttcaaagaaccaggaaattcaagctccaatcgaagaaacaaac

SEQ ID NO: 88009 - DNA, 713 bp, Oryza sativa
caaagttaaggcaaagagaggaggtgtggggtagagaaggatgagaatgagagaggatgcgcgtcggcgccggtgctcaccggaggcggaagcagcaggaacaccgcaccgccgctcgcgggatggatggagatcggccgcaggcgacggggcgaactcctcgaggagacgggagtcgaggccgaggcgacgccgggacggggagatggactcggggtcagaggcgagagtatgcgatggaagcagcagggcgcccggcgacggagaccggcgcgacgacggcgcaggcggcgagccaaggagatgacgcgggccgcggcggcgtcgtcgggtagcggaggccgcgacgcacgcagcctcagcgtccgcggagtcggtggataaatggaccgagcccagccgtgctgtcccgggcacgatggcgcgtgggccgtgccgtgcctggaccggcccgcggtacggcacggcctgctcggcacaccggcccacgtgccaccatcgtgcccgttccggcacggcacgggacggctcgataaagcagccgtgactaacgggccgccgtgctgtgcaggtgcggcccagtttaccactaaaacgcgggatgtataggtatgggaaaaagtacaccgacggtccctcaacttgtcatcgagttacaaaattgtcccccaaccataaaaccagatatccaacgtccctcaacttataaaacc

SEQ ID NO: 88010 - DNA, 2630 bp, Oryza sativa
ttttaccacgtcgcatataattctttttttttactccgacagatttgttttttaatattttggctctttttttactgcgtccacgcagattgttttttttggccggacttttttttcacctggttttttttggcgcccgttttttaggaatcagacagattccttttttatttcttcgcgcccttttttaccgtggaatcggatttgttttccttttctttttctcgcccgttttttgatcagacagatttgatttttcttttcttttttcgcccggtttttcgcccgttttgttttggatcggacaaatttttttcgcctggttttttttgtcggcaaaaaaaaagtggtgcaaaaaacactagatccaattcctttaaaacagaaaaaaagagaaaaaaaatgtgattcctttaaaggcgaaaaatgtgacgacaaaaatggttcctaaaaaataagaagttggttcgtataaaataaaaaatgcacgcgagaaaaaaatggaaagtgcgaaacatagtggtgcgatttctaattactatatatctcttctctatctctaatctaatctaactatttaaaaatagaaaatgcacgagaaaataaaaaccgttcaataaaacgtgtgagaaaaaagtcagaaaaagcgcaaaaaaacgctaaaaaatgttttccatcttccataaaacaaataaaaaaatgcgcgagaaaaaaacggtcagaaaaaacgtgccatttctaaaaaatggtttgaaaaaaccgtgcaaaaaaaacaccgtctattaaaaaacaaatcgctttgaaaaaactgtcagagaaaatactaaattgatggatgcttgactcggataggatccatcgattttttgccatctactatacggcttttatttcgtcatatattctcctgtattgaaaaaaaagcaaaaaaggacatttgaaaaaacaagcaaaaaaaaagcgcgagaaaataattgtttgaaaaaacaggcaaaaaacacaaaaaaataaaagaaaaaaagggagaaaaaatatggtttttgtcgtcagtaaaaaatgcaaaaaaaaacatgctatgaaaaaaatatttgaaagaaatacgccatttctaaaaaaatggtttgagaaaatcacgcaagaaaaaaaacaccgtttataaaaaaacaaaccactcattaaaatacaaacattgtcattaacatgattatacatgaaaaacatatattatcattagaatcttttcacccattacaacgcacggatataatataaatataaaagcaagaagaggaaataataataaagggagcactgtatgaggtagctagtagcttggtgcggtgccgagcgcgtagctcttgagaaggtcaccgcagatggggagtgggcgggtctggaggctacattacctggatacttcccaaaagctacgtatccgtatctgatacgtggaaggatacggatacgtatcggatacgtatcccatgtgtatcggcgatattggtgattttcagaaaaatcaaaaaaaaaatctggatactcccccgatacgttgagataccttctggatacgatcgagagaactaaacatcgctttatcctgcaactccacgccgttcgtcgcttccgtggttctcgcatatggcccgacaccccacgcggctcgcgactcctagcgccgctgccgctgacggacgccaatcgcagagttgtgcgccgtcgccatatgcgggcgtaacaccggatgctgaatgcagtgctgccgccgccaggcatagcaccgccgtccgccgccggcgccatctccaaccaggcaaccacttacttcagcagtgaggcaagcaagttccatcggtcgattcagttgttggcctctcccatgcagctatgctagtgttagcaatgattttctttttcttttttaacttcttgtccctctttctattttcttggtacaaagtgctacttttagatcggatgaaatttcggattggaatatcaagtgctaatgcatctaacactctcgacgtgtatgttcattacactcttggaataaacctgttggcaagttattggcaagttggcagtcttcagtctgcatcatcattctcggggttaaatcgcttcaccaaccttagtcaattacaattattagaaaatatttccatgacattatacgagcttatttccatgcaagagttcataaatttatatattaaatttttatattgttaatatatatatagacgtatccccgtatccttagtttttcacaaatgccacatcttcgtatccacgtatcgcgtatccgtatcagcgtatctagctaacatagtctggaggaagccgagaggattggcgcggcggaccatggtggcgaggccgacgtcctgaacgagggtgaccggcgcgcggtcgcgacccacctccatctcgtggcattcggtcaccgggctgctgagcagcgccaccgcgcacaccaactcggcaccgcggttgtccacctccaccagctccatgcggtagtgccccgtcgcgtccgttgtcccctccgccgatctctccaccgacccgctcgcgctcatgtagtgccggcactccagccgcacccgcgcggcctggatcgccgt

SEQ ID NO: 88011 - DNA, 586 bp, Oryza sativa
gagaaacttttctccaaatatcataatcttcagccataatataaaattgcatcctactcaccaatgagaaaaatcagttccatcgaaaacatgaggcttagttgaaaacctagcgggagtagccatggcaaaaactctagatcgataaaaatccaaagaagaaaacaaggctctgataccacttgtaggatcgaatcacaagaactaagccaaccagaggggggtgaatggttggtataccctaaaaccgaaaacttttagcggaaataaaagttaccctcgaaatcgacggaagtcggcctgaccgaagttgttctgccggtctgaccgagtggatgccaccggtctgaccggtgttgaatctccggtctgaccgccgagatcgcctgctgcgcctgtcgccgccgccagtctgaccgccgtgctcccgccggtctgaccgccgcaatgccgccggtctgaccgccggtgagttgccagttagaccgccgaaacccggtgaaacacaaatcgaagaactcttaaagtagatgatgactttattgattctctctgtgttacaaagtgcaccaacaacactccttac

SEQ ID NO: 88012 - DNA, 682 bp, Oryza sativa
ctcccccactccccacgttggccggcgaaatccctcccctaccggccacgtccggggctcccctcccctatttaggcttccccgtcgccccctctcgctttttccccatttcgccgaactctcccgagctccccatcgctcccgcgccgtgcaaccacccgccgccgccgtttccgctactccagccgccgctagccgccgctagggttgccgccgcaccgcgccgtccccgccgtcgggttcgcgaggctaagctctaccccggccgccccttccccgtcgagtttcgtcgccggaattcgcatcccctcgcgctccggtgagttcaaccgctatcgccgctttcggccatgaataccggtcgccgtggttcatctccctctctctaatctctctctcttccttccttagggcaccccaaagcctgtccgccggttgccgtcgccggtaacgcgttcgcgtgtgcgcgtgccgtcgccgtcgccgcggccggtcggccttgagccaagccgagccgggtcgccgccgccccttcctccccccctgagccgctgaccggtgggccccgcgtgccggcgccccttcctccctctcccgagccgctgaccggtgggccccgcatgtcggcgccgcccccccctccgtgctgacgtcagccctgggatttattgcacaataaatg

SEQ ID NO: 88013 - DNA, 628 bp, Oryza sativa
caactaacataaaagggttgaatatggaattgaatattacttcaaagtctaatccgttgggatacgacagcagaaaatgataaaaagatgttgagtaatgctttcattgaaactgctgactttaggactctaattgaaactgatgacaggaccattgttgttggtagacgagggacaggtaaaagtgctttatttattcagctaaatgagcattggaagaaagacaaaaaaatattaatcctgagtttctcaccagacgattctcaaattattggtttcagatcaatgttgaaaccatttacaggatcatttaatttagcaagggcagcaacaagactattatggcgatacgctatgctaatggagatagcatcatatatatcatctcattacaaattgtcatctcaaatatcatcagaaacattgttgaatgaacatttgaaaaaatggaattctgcacaaggtgacattttaaaaagtgtaggcttgtcgcaaaggagtatttagatgaaaataacccagaagaatcaattggtgatcttcaattcaatttgaatatctcagaaatagaaaataatatagtatcacttcttgaacgctcagacaggaaagttgtcatattaatgga

SEQ ID NO: 88014 - DNA, 548 bp, Oryza sativa
cccctttcccgttgagtttcgtcgccggaattcgcatcccttcgcgctccggtaagttcaacctctaccgccgccttcggccatgaatgcgggtcgccgtggttcatctccctctctctaatctctctctctcttccttccttagggcaccccgaagcccgtccgccggttgccgtcgtcctcccgtggcttgccgtcgccgttcgccgtcgtcttcctccgcgccggccaccctcggtgaggcttcctctcccatctattcccctccctctccttccaagccgccgtttagcgccgccgccttcgcgtcgcctttgcgccgtcgcctccgccgccggttgctgtcgccggcaacgcgttcgcgcgcgcgcgccgtcgccatcgccgtggccggtgggccggccttgagccaagccgagccgggtcgccgccgcccatccgatcaaccccgagggtgatctgggccgtcggtcccgtggaccggcggtggaccacccgcgtggtcccggtccacggtgaaccgtttccccccttgagtcgctgccgag

SEQ ID NO: 88015 - DNA, 551 bp, Oryza sativa
aggactgaaagtttttaaatagcttttgcgggttttaggctcaataaggcttgacaaaaacttttaagaaatcagaagctaagtatgaaacattgggcacagcataaattcatcagtattgtacaaattgtgcctccatcatcatcatcatcatcatcagaatcattgtcattacattacatcaatcagtatcagttttctcatcatcagagtcatcaagaccagtcagtcgaagatcggtgtcctgaaatctctccactacatcaactgctatcttgtcagcaaccttctgtgcatcattgataagatcgagaacagcttcttcgcttgtcccgtctgcaaagccgtcaatggcatcaatgtcgatttttgggtaaagggacttggtcattgctaacgccagactcgctcccatacttccagcttctttgatattcttgaaatatgtatccggagcaactctcagcttgtcgaagatttcggaagcatcaagtgtactcgggccattgttattgatgaacatcgcttggacgagtggggtagcaacatta

SEQ ID NO: 88016 - DNA, 559 bp, Oryza sativa
ctcggtgaggcctctgggctccggacaaattttggaaaatgttcaaccctgccgattcagtgctcagaggagttgcttgctgggatacagccggaattgccctgccatgttgcatccttcccctgcaagtacttaggtctacccctttccatcttcaggttgaagaaagaagacttgcagccattcgttgacagcatagcccggcggcttccagcttggaaatccaaccaaatgtcgttgataggtcatgtaacaatggttcagtttgtactcagtgcaatcccaatctacctgctgattactatcgatgcacccaagtgggtgatcaaaggaatcgacaagatccgacgcgggattctctggcaggcaaggcgcaagccaatggaggttgctgccgggtcgcttggtcgagggtctgtgctcctaagaactatggcggtttagacttgccaaatctggagttgatgggtattgcacttcgctccagatggacttggctacaacggacttcactaagtaaaccatggcaaggcctagacatcccggggtcgcaaaagga

SEQ ID NO: 88017 - DNA, 501 bp, Oryza sativa
cattcagatctttgtgaaatgaatggggtgttgacgaagggtggaaaacgatatttcatgacgttgattgatgatgctactagattttgctatgtgtacttgttgaaaacgaaagacaaggctctagactattttaaaatttataaggcagaagttgaaaattaacttgatagaaagataaaaacacttaggtctgatcatggtggagagtatttctcaaacgagtttgacttattctatgaggaacatggcattatacatgagaggacgcctccatattctcccgagtctaatgggattgctgaaaggaagaaccgcacactgactgacttggtgaatgccatgttggacatcgcggagctacctaaagcatggtggggggaggcattgttgacctcgaatcatgtgttaaacagagttcctaatagaaataacgacaaaacaccatatgagatatggattgggagaaaaccatcactttgttattcgcgcacatggggg

SEQ ID NO: 88018 - DNA, 596 bp, Oryza sativa
ttgtcctcgtcccacacgggaaccctttcccttcttccacaacagtttaagatcttcgaccagtggtcttaggtacacatcgatgtcattaccaggttgcttggggcttgaataataatcggcatcattatgtacttcctcttcatgcatagccaggggggaggttgtagatacacatcgtaatgggccaagtgctatggccgctgctcatctctccaaaaggattcatgccatccgtactcaaaccaaaccgtatgtttcgtgcgtcctttccaaattctttaaattttctatcgatgtttcgccactgcgaaccatcggcggggtgtctcagcatcccgtcctgttgacgctcttcagcgtgccatcgcatcattctagcattccccttgttcctgaacaaacgccttagccgtggtcttataaggaaataccacatcaccttagcaggaattctcttctttgttagctgcgtcaacttctcctggatcgtctcgtctaatcttgtatcgtagtgctttgcaaatagggcatgcttctaggttctcgtactcctccccgcgatataggatacaatcattcggacaagggtgaat

SEQ ID NO: 88019 - DNA, 1362 bp, Oryza sativa
cgcagacatggtggcgaggacgagcagtcgtgcgggaagcactccccaaaaacctgatcacccgcctacccggtgcagatctcaggcgaaggtgtgattccgaaggccctgctccttccgatctctcgtgcgtgcaagcgattagaagcgagaaagcgagagcagcacaggcacggaggaggaggaactaacacccgggaaagaagcaagcgaatcgttctgatcggactcgcggcctccttatctatcaggagagaggcagtcggcagtcgtgggaacgtgggatcgtgaacgtgccgttgcggaggcagttgtgggaacgtgggttcatggttgcaaaagtgtagcgccacgccacgcctagccctcggcctcggcccggcgcgcgcgcgcgtgtggctttccgacccccacctcaaccagtcaacagggggcctccaataactccctatttaggttaagatattcctcgcttaaatcctgaggtggtattattatccttaacacttattatgggcctttgagatttaataggataaattgggcctagcccaattattctaacaatccccaccaaatttcaaggctcataagaaatgttctcaaggttgtgcctatttgatataccagggttttggtggagactgttaagttgaacttccacctaggaaatgagctacatcagaccacaactgaacaatggactatgccttgaattgtcagttttgtgtgattaggtttcactcagacccttgactggtactggactgccgttcgcatcccctctgtttggagcatataagtcaaactccaggcctttcatgagtatctagagatcgcccaaacctcatagactgtgactagcagtcgaactcatataggtgtgttccttctgagatgttctgcaggtcaatatctctgcttggaaaagccactcggatcacattaaggcatgagtcatcctaccatgtaggaaagaaaagaagtacatcatgaaaataagcccttttcaagggtctcttctctcagtcacacaatagtttgttttgccatccaaattcatgggatctccgatcacaatggacaggtttccactattgtgcaaccttaggtgggtatcaagcccatttccctcgatgcactgtctatcacattacgtggtagccccttgataaactgatctgccagatttctagccgtttggacatagtccaatgctacactccggagtttttctgctttctgacagatttcagtcttctcttgatatgcctagatgacttatgttgtcctttgaactgttcactttaataatcactgtttgactatcacagttcattaggatagctggccctggttttt

SEQ ID NO: 88020 - DNA, 560 bp, Oryza sativa
aggcacacctgaatatctggcacctgaatggctaacatcacagatcactgaaaaaagttgacgtctacagctttggagttgttctcttggaaataatatgtggaaggaaaaatatcgatatttcacagccagaggaaagcgttcagctcatcaatttattgcgagagaaggctaaagacaatgaattgaatgatataattgataagaaaagtactgatatggtctcacaccaccaggaggaagtgattaaaatgttgaagctcgcaatgtggtgcttgcaaaatgagagcagcagaaggccttcgatgtcgatggttgtcaaggtattggaaggcgcagtgagcgtggaaaattgcctggattacagctttgtcaatgcaaattcagtgatatctactcaagacaactcatccacatattcagctccactttctgcatcgattctatctggtccaagatgaaataggcggctactgagcacaaaaaaatccaccgatctatgcacatcatattttgaaactactttggtaatctatcatatttcttcttgtgagaagtat

SEQ ID NO: 88021 - DNA, 966 bp, Oryza sativa
cgggcagcgcacagaccggcggcggcggacgaaggcgatgtcgagcgcagggagcggcagcgcgtgcgggacagatggaaggatggaggagaggagctcctcactgtgagcacggcggccggcgcgaaggatgaagacggcggcgatgaccggcgacgcggaggcacggacgggcggcggcgacaccctaggagaagatggagaggcgttaggagaggagacgacgaccacggcggcttgaattgccggccggagatggaggggagggaaaaactcaccggctcgcgaggggagaggcgctccggtgggattccggcgacgcgaggcggcggccgggaaagctcttgcggcggcgaagctaacggcggcggcgatttggcgcggcggcgactctagcggcggcggctcacggccgaaggcggcggcaagcggcggagctcgggtgtgacggcgcgggcgcggtagggggcgtgggagaggacggcaaatgggggaaacgagggaggggactcgggggagggtttttatgggcgagagaggggcggacgtggccggggagatggccgaaaccgccggcgacatggggaggagagagagagacggtgaggtgggattcaaaatgaatcccgcccacttcgtgcatgcgcgcgggcgggaagggcggaggagtggggcggcgacgtgggcgcgcggcacgggcggagtggggcgtggagaacggcgggaaacggcggcggcggcatgggcggtttcgacggcagcagttggagctccagctccaacggctggaggtgggagacgaccgacaggtggggcccacctgtcggcatcccagagagaggagggaggggcgcatgggccggcccaacaagaggaaggccgagcgggagagggatgggccgacggcccaagaaaggaaaaggagggaaaagaaaaaaaagaaaaagaagaaaggatttttcctgg

SEQ ID NO: 88022 - DNA, 887 bp, Oryza sativa
ccaccaaaaagggatatcgagttccggattgacttggtacctggaactgcaccgatccacaagaggccttacagaatgggagccaacgagttggcggaagtcaagaagcaagtcgatgaacagttacagaagggatacatccgcccgagcacatcgccttgggtgctccggttatctttgtggagaagaaagacaaaaccaagaggatgtgcgttgactaccgcgcactcaatgaggtcaccatcaagaacaaatatcctttgccaaggattgatgatctgtttgatcagttgaaaggagctactgtgttctctaagatagacctgcgatcagactatcaccagttgaggatccgcgaggaggatattccaaagacagcattcatcactcggtacgggttgttcgaatgcacagttatgtctttcggactcactaatgcacctgccttcttcatgaatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaagttcggagtttcttaacgacttgcgggctattaccgcctgttcattgagaacttctctaaaattgctaagccaatgacacagctattgaagaaggaagaaaaatttatctggtctgctgaatgcaataggagttttgaaaaactcaa

SEQ ID NO: 88023 - DNA, 542 bp, Oryza sativa
aatctgaaagaaacctttgcgagcatccgtgctttcaggatgaaactaaacccaaaaaaatgccctttcggagtactgtcaggaaagctgcttggatttatggtgtctcacagaggcatacaggccaacccggagaaagtcaacgccatcctcaacatgaagccgccgtgttcctagaaacacgttcaaaagctgactgaatgcatgtcggtgctcagtcggtttgtctcacgactcggcgagcgggggatgcccttcttcaaactgttaaagaaaacagacaatttctagtggggacccgaagcacagaaagcctttgaagatttcaagaaacttctcactactccaccagttttggcctcaccacacccacaagagccgctattactatacgtatcggccacttctcaggttgtgagcgcggtcctggttgtcgagcgtgaagaagaaggccatgttcagaaagtccagtgaccgatctacttcgttagtgaggtgttggccgattccaagacgagatatcctcaagttcagaagctgtt

SEQ ID NO: 88024 - DNA, 586 bp, Oryza sativa
aaccgaatccatgccctatttacagttgttaggaaggattaatttattatccgagatccgtatagtacttgtagaatgattcataatgacagtgcaatatatgacaatacctatctatcacttcgaaaatatgtgcgaaagttttctccggtttatccattgattcgtagacatagattttggatttctcaaggttgaaaagaataaggacccagtggaatctgcaatttgcattagatgatacatgtgtgtgtgtctatatatatatatatatatatatatagagagagagagaggaaggaacaaaattgaagttatgattgtaggaactcacgatgtgttgtagggaagtagtatgaacatcttataatgctgctgcaccgggaaatggaggatattgtcctcggtttgtttctcatagttttgtagcatcagcgtgttcactttgcgggggtccatgaatcctgtattgaatttgttgtgccgacggcacaactgaatctctattctacaacgggtacaaggaatttgtataagctacgttcaaaggaggaacaaaattgaactataaacaatacttacaaag

SEQ ID NO: 88025 - DNA, 1054 bp, Oryza sativa
ccatgtttctttgcacaggggaactttgaaatgtcccatcaacaagccttggcacaagtaacagcagaagcagtccattctccgtacagtatgattaatcaatcagatttctcactcccgttctcgtcgacaacgacttcagtgttggcatcacaacatgtcaactcttctgccaatgtgtcatcaccacgagaaataccaactctgccatcccacacagataatagcaccattgaatcaactgaggtttcacatggattccaaactactgccctcactgaggataaacctgctgatgatggctacaactggcggaagtatggccagaaggcagttaagggtggggagtatccaaggagctattataaatgtacccatttaagctgtccagttaagaagaaagtggagcgctcatctgacggacagattactcaaatactttatagaggccagcataaccaccaacgaccaccaaaaagaaggtccaaagatggtggcgctttactaaatgaagcagatgtttcccctgagaaggaagatgcatcaactagatcagaacagggctcccaagattattctggaaaattcaaggcatcaaatgatggtggtccttcatcatccaggaggggagataggggtgagcaaatatcgggctcaagtgatagcaattcgagctcggtacccgaagaagtgaaggttgagggtagagctactagtgatggaaatgcgaacaaaaggtggtctacaaaacatttttgttttacttggacattttctgagcttcaatatataaatgctagtttctattggacagacatgtgccagctccagctcaaagaatcattgtgcaaacaactagtgaggttgatcttttggatgatggctaccgatggcgcaagtatggtcaaaaagtagtaaaagggaatcctcacccaaggtaattctgttttttaaattgcacttacttgttcccgatgttctgccatgttttttcattatattggagcagctctgaatagctcaatgcaatcactttatttttttttggtacaga

SEQ ID NO: 88026 - DNA, 680 bp, Oryza sativa
cccagcgcgggataatcattaatggtgcaaaacaatagaactcgtagtgtgaagttctcctgaccatatgcatcccaagtttccacaccctctttccacagaatctcaaggtcatcgataacaggctccaagaacacatcgatgtaattgccgggttgtctcggaccttggattaacaagcacaacataatatatttccttttgaagcacaaccatggtgggaggttaaagttcgcaatgagaactggccaagtgctgtgagaactgctcatgtctctgaaaggattcatgccatccgtacacaaacatatcctcatgtttctgggggtcggcagcaaagtctttgtgctttcgttcgatattcctccattgaatcgaatccgcagggtgtcttagcaaaccgtcattccttctctctgtggcatgccaacgtactaactttgcttcattggtgttggcaaatattctcttgaaacgatcaatgattggtagataccacacgaccttcgccggaccaccctgctttgacttctttccctcccccgcgctcttctttcgcttgtatcgagaagccttgcaaacaggacaagcatctaagtccgcgtattgcttgtggtacaatatgcaatcgtttggacacgcgtgaattctccggacctctaaccctaggggacacagaa

SEQ ID NO: 88027 - DNA, 2288 bp, Oryza sativa
aaccagtcatcacaattcaacagacaagtctagagattttttcatcaacatcgtgcatcggtttggagtacctaatcggatcatcactgataatggcactcagttcactggcggagtatttaaagatttctgtgaagacttcggcatcaaaatttgttatgcctccgtagcgcatcccatgagcaatggacaagtcgaacgtgccaatggtatggtacttcaaggaattaaagcacgagttttcgaccaactgcatccgtacgctggcaaatgggtagatcagctgccgtctgtactttggtctctgtgcactacacccagtcgggctacgggccagtcaccgttctttctagtctatggtacggaagcaatgttgccaagtgaggtagaattcgaatctttacgatttcgtaacttcaaagaggagcgctagggagaagaccgagtggatgatctcaaccgactggaggaagcccgtgaagcagccttaattcagtcggctcggtatttacaagggatgcgatgttatcacaaccgcaatgttcgatcgcgggctttctcagttgaagacctggttttaaggaaaattcaaactacacgagatcggcacaagttatctcccttatgggaaggaccgttcataatttttgaagttactcggccaggttcttacagactcaagcgtgaagacgatactcatgttgacaactcttggaatattgagtatcttcgtcgtttttatgcttaggcattacttttgtatcttcctctttgactgctaacatcaagttgttccttgagttaccagtcgggggctactataataataatggagtgtgattattatcaattcaattttcttacttgatttatcattgccttgtttgatcttttggcttagtcaatgaggactgaaagtttttaacaacttttgcgagttctaggctcaataaggtttgacgaaaacttttaagaaatcaggagctgagtttaaattatcaagcacagcataaattcatcagtattgtacaaattgtgcctccatcatcataagttaatactatacaatgtaaatcagactcagttttttcatcatcagaattaccagacccagtcggcccgagattgttgtcctgaaacctctcaactacatcagcagtaatcttgtctgcagccttttgtgcatcattgatgagatcaagggcatgttcttcacttgtcccatctgcaaagtcgtcgacagcatcaatatcgatcttcgggtacaaggacttggtcattgccaatgccaggctagcccctatgcatcccgctttcttgatgttcttaaaatatgtatctggagcagctcttagcttgtcgaagatttcaacagcatcaaaagaactcggaccattattattgaaaaacatggcttggatgagtggtgtggcggcgttggcaacttcatctccggctccttcaagcttcttaattttgttgaccaagacgtcgaattgagcttgagatttgattttgcgatctgcgcaaatggttcacatcaacgactatgcaagaagacaagaatggtttgaagtttcagcaacaagtacattcgacatctttcagagccgagtccctttgtttggtcaattcgcccttgtctttttctagagctttgattcgcttttctagctcggatatcttggtagcttgcactgtattattttccattgatcaattacatatggatagcggctttgagtaagataggcaggactgaaggttggcgttggtacctttttagggagggctgcttgcttgagcctctgcttccgggatgtcttcatttcgttctgtacccgactgatttctagtcgggggctcctgatcagtactgacttcagcttcggccgactggtttccagtcgaggttcattgctggcctgtacattgtcggttgctggttgattactactcaggcgatctttggcagtcggcccggtttctgtcgtaggactagtctccgcgccagttggttcagagtcttttccagaaggatcgatgtcataaggcttcctgcaaatttgagatatgctattaacaatacttcaatagtgaatgattagcgatacaagagaaaatgctaagtgacatgtacctggatgacttcctgattttcggtatgggacgactggatgttttcttcttcgggttagcttgtcttggctgttttccagtcacccctttgctgccagccttttcaacatcgtcaccctcatcgtcactcagaactaatttcctcttac

SEQ ID NO: 88028 - DNA, 1074 bp, Oryza sativa
gtgcaaccacccgccgccgccgtttccgctactccggccgccgctagccgccgctagggtcaccgccgcaccgcgccgtcgccgccgtcgggttcgcgaggctaagctccaccccggccgccccttccccgttgagtttcgtcgccgaaattcgcatcccctcgcgctccggtgagttcaacccctaccgccgccttcggccatgaacgccggtcgccgtggttcatctccctccctctaatctctctcttctccttgtttagggcaccccgaatcctgtccgccggtggccgtcgtcctcccgtggctcaccgttgccgttcgccatcgtcttcctccgcgccggccaccctcggtgaggcatcctctcccttctattcccctccctctccctcctagccgtcgctttagcgccgccgcccgttagccgtcgctttagcaccaccgcccgtcggcgccgcctttgcgccgccgtctccgccgcgcgttgccgtcgccggcaacgcgtgtgcgcgcgccgtcgccatggccgtggctgcttggccggtcttgagccgagccgggtcgccaccgcccgtccgatcggccccgagggcgatctgggccgtcggtcccgtggaccggcggtggaccacccgcgtggtcccggtccacggtgaaccgccccttcctccctctcccaagccgctgaccggtgggccccgcttgctggcgccacgccccgccttgatgacgtcagccctgggatttattgcgcaataaatgatttaaggtttttcttttatagtaataaacacagtgaatcttctaaaattcataactaattcatccgagctccgtttaagcccattcaagtctcagtaaatcaagaaaaatgagtagaatccattaaaaatacttttgttccctgtttcagtagtcttatagcctgtttgcattgtttgctttgtatgtagatagattccggttcctccgacgctccggtgtactttgaaatagtcgccgaggttcctccagcagcagagcaaggcaagtcatgcttgttacttgaacatgttgatcctatattgcaaa

SEQ ID NO: 88029 - DNA, 1574 bp, Oryza sativa
cctctagccgacgcatccaggcaagggtgggcgtgatggagtttggatgggccctgcgacggcctatgcggcttctggattcacctaggcatgagaggggactgcccgctaccttgcgaggagtgggggtgaaacctgaggtgtggtgtgcttggttagagggggttatacgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgagcccgcggttatgggcggtcaaccagattcaccgtgattagtctcaccctagtgtaatcttttgaatttggatagtttaggtggatggttgggcctgtcgcaacgtggtatagcgttggacagtggatgattaatattaattaattattataactgtttaaatctttcaacttctgtttataaatgctcgctttatgcaaatgaaccactctagctcttctttgataattccctgcatcatacccctattccggtatgacttgctgagtacagtgggtagtactcagtcttgctctatttttcccaaccccagagcacgagtatgtgtcagatgaaggtttctccgaggagtaggcttcgtccgtgtagtcgaggatgcctgtggagtggtgttcccgctgcagttctagtcaaggcttagctcctgttgtcttccgttttcccgctgcatttatgtaagacttttatgatgtttgtaagacgtggatctgaatgtcaacattgtcgtttgtgtaccccggccggtcctggatggggattttaatgcacattctgcttggaattctattcgggaatttctgggcatgacagtgtccttctggtattttttacaaaaaatcagaagagaagggttcagagattaaggaaccgggaacgttttcaggaggttgaacaggaaatcagtcatcggctaaagaaaacaaagccaaggcaggagtggcgtgttaaaaatcaggttcctgcagccgatgaagccacgaccgatgaagcaaagagattggccaaaggaaaaagtgttgtaactgcatcggttaacatggttttcatgttgcctaccgagtttggggtcaagcaagccgatgtcgatgatgttgaagaagaatcggctaaattgattttgtcaccagaacaagcagtcttcgagaagccagagggtacagagaatcggcatctcaagccattgtatataaatggtttatgtcaatgggaagttgatgtccaaaataatggtcgatggtggggctacagtgaatttgatgccttatgctatattcagaaagttgggcagaaacgctcaggatctcatcaagacaaatatggtgcttaaggattttggtggcaatccatcagagaccaaaggagttttgaatgtggagctgacagtcggcaacaaaaccatccctacaacgttctttgtcatcaatgggaagggttcctacagcttgttgcttggaacggattggattcatgccaattgttgtattccttcaa

SEQ ID NO: 88030 - DNA, 727 bp, Oryza sativa
  unsure (1)..(727): unsure at all n locations
agcaattcagagagcaccggcgtcggctatgaatcctatcattaagccatcgccatttagaggttgggaaattgatatgatcggcatgattaatccaccatcgagtaaaggtattggtggcgaccgattattttaccaagtgggtaaggcaattcctttgaagaaggttgattctggggatgctatacaatttgttcaagagcatataatttatcgatttggtattcctcaaaccattacaactgatcagggttcaattttcgtgtccgatgagtttgttaagtaaattcgggatagcaaattcagcaagtggtcgccgaattgggaaggaccgttccaaatctatcgagttgtgtccaagggagcttacatgttgcaaggactcgatggagaagtttatggacgagcactaaatgacaagtacttgaagaaatattacccaagtgtttgggttaatgcatgatcggctgatacttgccgatacatgacgtctccgcggaaccttgtcccgagcacccggaggtctccccctctttctaggatgggggggtaagagcagagtcagtatccttctgggttacctctactctttccggcacatttactgcaggtatatgcgaccttgtcactcccttgtaatcagtgaaggcatctggcaacttatttgtaatattttgcanatttatgattctctgaacttccagttcagcttcactagtgcgtggat

SEQ ID NO: 88031 - DNA, 1337 bp, Oryza sativa
catggcaatcgaccaggtcgagctgggcgaaaacccggacgactggcgaacgcccttcgtcaaatatctcaaagagggatggctgccagatgatgaagcaaaggcgaaacagttgcaaatcagatctacaaagtacagcttagtctctgggcaattgaaccgaaccgggatgctgtagcccatgcttcgctgtgtctccttttccgagggtgaagaaatgataagggaaatacaccaaggaatgtgtggagcacaccaagcagcaagaactgtcgcatcaaaagtatttcgccagggcatatattggccaaccgtactaaaagtatgtgttgagcaaatcaagaagtgcgaaagctgtcagaaacatggtcgaagccaagctgcacctcagtacgacttgcagccaatcgcgcccatctgtgtcgcgaccgagaaaatttgcattttcccgaacgctagtgtattaatccccgtcctaggaaaagccggggtacaccacacaaacatgatacaaaaggcacatctttattatgtcgataatatttacattattacaaaggcacataaggcctgacaatcaaaaataaacagcagcggactagcgggcctacggctccatcttcacaggcgctcaattggggtataagccaggactccacctaagacttcttctccaaagcttctcttactgaagggggaggtgtgtgtccaattccaccataagccaaccattccatactgtccaaatgatatgagaattcccaaagtctaaagttataaaaccacctaatgttgcataattaatcagcgaagcatctacctaaattcatactagtggaaccatgaatagggtacccactagttggggttttgtttatcctagggtgaacaaggtaataataacaatagcaataataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcgctttcccaaactttggcttcaacctccacgtagagcggatcttccaaagctgcagcgtctacacgaccaacggaaaggaaaaaggcttttactctaataaactccatataacaagcaggaacaaagcacaaaaatgggttcttgacttcttaagggaaaattagagacttgaacggtccaattccgagttcaaatggccaagatatggccatttgaagtttatatgctctttaaatggatatttgcgaatttcttcatttaaattttaa

SEQ ID NO: 88032 - DNA, 1050 bp, Oryza sativa
gtaatcgatacaaaactcaatgccttcctcggtcgtgtaaccttcaatgatgctcccctctggttttgctctgttccgaacgtaggacttcagaattcccatgtacctctcgaatggccacatttctctcataaaagttggcccacatatttttgtgtgcttcactaggtgaacagtgagatgaaccatgatatcaaagaaagccagtggaaaatacatctccaagtgacacaggctactgacaatatcggcctgcaacccatctaggtcttctggatctataatcttctgaccgattgcattgaagaaggcacaaagccgttggatcgtgtgacggacttgtggtggtagaatgccacttatagcaactggcaagatctgtgtgattaccacgtggcaatcgtgagacttcattccaaccagcttaagatcctccaatttaacgtacttacttattctcgcgcaatagcccgaaggaactttaatatctgccagacatgatagcattgcgatcttctcatccttcgacaatgtgtggcaagctggtgggaggtacgctcttcctgtcttctcatctgtaacaggctgaagttcactgcgaatgttcatctcctgtagatcgagacgcgcattcaacctgtcctttgtcttgccaggcatattcaacaatagccccagcaagctatcgcacacattcttctctacgtgcatcagatcaatgcaatgacggacctcaagatcttcccaataaggtagccgccaaaatatggattttttcttccacatcctcttcttgtcctccttgctacgttttcttttcttcccaaactcattagtaatgtccttcaccatgttgtgtacctgatctccggacaaatccgcaggggcagacccaagttctttcttaccattgaaaattttcttctttcttctaaaggcgtgccgtagggggagccatctcctatgacccatgtaaaccatctttcttgatttcttcagccacctactgcgtgtatgttccatacagtcagagcatgccttctttccttt

SEQ ID NO: 88033 - DNA, 2889 bp, Oryza sativa
acgatcatcattttgctcaactgaatgtaccatcctttgatgcaagtatgcgatagcatggtgctttctatccttggtttgcccaagaacagctcccacagtaaaatcactagcattgcacatgatttcaaacggcagcgaccaatcagggggttggatgattggtgctgagatgagtgattccttaaagattttaaaggattttagacacttatcatcaaagtcaaacagagcatccttagctagcaaggcagttaggggtctagcgattttagagaaatcctttatgaaacgtctataaaaccccgcatgacccaagaagctacggactcccttgacattgacaggaggtgggagctatcgaattacttcgatttttgctctgtccacctcaactcccctttcgaagatttgacgtctcaggactattccttcacgaaccatgaagtggcacttttcccaattaagtaccaagtcctttttcctgacatccttgtaggaccctaagttctccagacaatgatcgaaagttttaccatagactgaaaaattgtccatgaagacttccatggtatcctcaatcatgtcggagaaaatagacgtcatgcatctttgatcatcgagatggatggggatttggtgataaccaaaatacccatcaaggaaacaaaagaaggaatggttcgctagccgctcaagcatttcatcaatgaaaggcagcggaaagtgatcttctaagtagccttgttgagtttcctatagtcaatacacatcctccatcccgtgacggttcgttgtgggatcaactcgttgtttgagttttcaacgaccgtcatgcctcccttcttaggcactacctgaacagggctaacccactcactatatggcacgggatagataatcccggcatataggagtttcaagacttcctttttgatgacctcccttatcgcattgtttagcctcctctgaggttccctagatggtgtacaagacgggtcgaagggaacgcgatgagtgcaaagggtcggactgatgccttttaagtcttggagggaatagctaaaagcaacacgatgcttttctaaaacagcgataagtcgggtcgtctccctctcagagagtttgtcacttataatgactggagactctgcatcactgttcagaaatgcatagcataggcctgaaggtaagggctttagctcaattggggctcatgacggctgatccatttttggcagatcaatcgtttctccagattcatccaccccttcattgaattcctcgatggattcatcgagattagactctggggcctcgaatggagaaatagccatcacttcctcaattggctcaggaacaggaagaggctccgtcaaagaattggttgattgcaatacagggacggaggtgacgatttttcctactttcaggttgaggacaccggtttcgggcacatttaagagtttctctatgggatgtcctatgagtatgtcaaaatcagagatatcaaacagatggaaatctaagatgacctcaacgctattgtaccgtatgggcacttcagagataatccctaaaccttcggtagtaggatttgtggagatttggaaggttttgatggttggtaccaacggtctgtcccctaaccaaggataccttttcttgaacttatctgcctgcctggcagaaaagctgaacttccactgaaaactccgaaggataaggcaagcattgtacactccactcagtgtgaactcattcaaccttggcaagcattaaatagaattgccactaggatgtaataatgggaatacatctacgtgcatgaatccagataacactacaacgtactaacatcactacgactattgtgtaaccaatatcaacatggctgttagcccaaaaccgggagacgttggcccaaccgggagaaaaccttgctacaccccaaaaagcttactcaagaggtgaggggctccccccacttttaagttggttcaactccccctagattagcaatgtgggactattcccaaaaatctcccccgtcacacattggtgccccttagccctgaccggccccacacacaggcacatacgggcctcacacccgcggtccactgaccggccccacacacgggcacgtacgggcctcacacccgcggtccactgggctttgggcttacaccgccctgagtgtgcacaagcactagagattgtgggtttggctctgataccacttgttagcccaaaaccgggagacgttggcccaaccgggagaaagccttgctacaccccaaaagctagctcaagaggtgaggggctccccccacttttaagttggttcaactcctcctagattagcaatgtgggactattcccaacaatggctagcaaaagaagaggaaaaaaacatatagttagcaaaaagacataaacacgcattatttttttagctacacaaagggaaataatttaccaatttcaacattcatagggtcaaatagatcaggtcacttgctataaatgctagtatcaccaagatccttgacatgtaacagataatcattatatgctttgtgcctcctgtgctagtgctaatttaaaaagagcatttgcaaatttcagatctcaaaccatgcgcctaccatacctgtaaaccctaacagagcctacatcataatgcggtcacaccctccatgatttcaataattgatcaaatccacccccaataattgctaaggcccggtttggaacatttgtatggttctaaaatttataataatatcaatattttaccagcacaatttcaagcctttttgtcagtatcagtagttcagtatgattgtccctaactctataagatacatatctaaaaatttagtt

SEQ ID NO: 88034 - DNA, 1505 bp, Oryza sativa
cagaggtagctgacagcctcctttcaattctatcaacaagaggtgcaaagtcaatcacctttggtctagtggttcccaaagggaggcccaaatatgtaaaaggtagtggtccaatagcacaaccaaacaaccctgaaagatgctgaactttttctggatccacattcaaaggaatcatgcaagatttactataattttttttgcggggagcaagatttactataattaacctttaaacctgtagaatcagcaaaggtgttgaggatagcctttagacaaaaaagttattttgaggaagctgtcaagaagagtaaagaatcatctacatattgtacaactggaaaatcattgtcaggtgttggaatgggaatagaaaggacccttgagaataggtcttattgattacagcctgcaaaagataagcaccaagcacaaataaaagaggggacaagggatccccttgcctcaccccccttgtgcaataaaaagatttccctgggacaccattaagcagcactgaagaggaagctgatgaaaagatcaagttaatccaactcaaacatttagagtcaaaacccatttgcttcataatattcaagataacagagtgttcaattgtgtcaaaagccttttcaaaatctagctttaagagcactatttccctctttgattgttgacactgatgcaggtattcaaaggaccaagcaagacaatcctgtatagttctgcctctaataaagccatactgattgtgatgaataagttctgtgaatactgattgcgacctatctgccagtacctactggtatttcttacaatcacagttaaaatccgcaagcgcatggatataccgatgtatcacttcccctacggagtattccaagggtatcgaatccaagggaacgtgtgcgatcagatcttcctctagttcaaccaaggacaccaagcaaatgataggccaggaaagagaggattcactagtaagaaatagtgtctagggaaagcttaactttaatcctaaggcaatacttcaggcactggcaacccgctgttcccagatgtcgctctactacgtaccccgacagggaggacttaagtgatttcgagggctgtcaccacctctacacctacctcaaacgtactgtgggatacacagcaattactggataacaattacctaaacaccacgtctaagaaattaatatctactttagtgtgtataactcaccaaagcaatcattatgcttttgttgattatagtgaacaataatcccgtatgctatttaggaactaaccaagagataattctcataagataaatctaaattactcaggaagaatattatattgaattcagagtaataaacagaataaaagaaataggagatgattaccgacaactccggaattcttccgacttcttatactctactttcttcctattctaatatacaatatagtatagtagagcttctataattcagctcaagcttggaaatgtgtga

SEQ ID NO: 88035 - DNA, 1986 bp, Oryza sativa
catatcataggtgtttagtctatcaattaggagaagccaagcaaacaccttaactttcatagaacactagaaaaaacgcgtggcaaaagccacgcatggtataatgagcttaggccattgggcctagtggggtaacaaatgagtatatacttccacttaattatgggcttattttctctgatgttttgggttttaaataaatttctatttcacattataaaatgtttggattttgaataaatttatagatggatcaatgtatgtgtattaaatgtttgaggttttgaataaatttatgtttcatagtataagatgttttgggttttaaataaatttataaatggatcaatatatgtgtttcatatatatgtcgaaatttatatgaacattagtgaatctagatgggagattgaagagcttaaaaatatccttgtgaagtttatgtccatattcattgtactacgatatgtcccatccagtacaggatgctatattttgagacggagagagtacaaggaaagtgaaaattaatcaaagctgtgcgtacaaaatagggaatacagactactgaatgtgccaattcatgcatcgatcatgcatcggatgtttgcattgatcagcatgcaccggatgtttgtatgctactcctacatcctacatatatggttaatatctcgtttcatccagcatcttcttgtgccattgcacggcctgctgagccatggtccatggacccaattgctcctcgatatattcgtgaagaagcttctggaagaaactccatccgatggctggtgcacgcacgcacgcaagagcaaatcgttgcacgcgcacacgcaagatcttttcgtcgagcctcttccgcgaaaccggtgctgccacgtggcaccattctctttgtgatcttttgcatcgaattcgtattataagatttgcttttccaaatccaacttaagtacccaggggcttggacatgcatgaagtttattgcatatattttctgagaagagaacagtccattaccccatacataagtccaaacatccttatcatcagataatagattcagggggtcagcttcactcatggattcatattgctggaaagcttgttcagataaaggcagagcaaaaagctgtgatatgcttttagtagaagttatgcttaccgagtccttgcgagagagtgcaaaagagtgaattctagggaacacagctgacctaactttaccattccaaaaatcatcccagaacaaaaaagtttttccatcacccactttacaatttgacggacttctgaaaatgtccacaaattgcaacacatccttccaccaaaaggaaccccttggatgaacaacatgtggtaatttatcagagttataagaggtctagatcaaatttacgcatgtaataggatgcctgttgtagaacttatgcaaatttttcatcaagagagcggcattctgaagattgagatcaataacacccaaaccacctgtattttttggttgacaaactctctcccaaagcactaaggatttcctactagaatttatgtcagatcccctccattggcaatgtctccttgctctatcaatactttcaatcacagattttgggagggagagggaacatatataataagtaggaagggaggaaagaactgaatttaccattgtgattctgtcaccataagacaatagagcagaggtagctgacagcctcctttcaattctatcaacaagaggtgcaaagtcaatcacctttggtctagtggttcccaaagggaggcccaaatatgtaaaaggtagtggtccaatagcacaaccaaacaaccctgaaagatgctgaactttttctggatccacattcaaaggaatcatgcaagatttactataattttttttgcggggagcaagatttactataattaacctttaaacctgtagaatcagcaaaggtgttgaggatagcctttagacaaaaa

SEQ ID NO: 88036 - DNA, 1038 bp, Oryza sativa
ttcctgcagcccatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgatattttgcctcgtttgttagccaccattgcccagaggaataataatacgtactatgacctacatacatttacatcggttgatgatcgaacaaagagtgtgctgcaaagagcctttttctcattgggtgcttgcataaatgcttttgtgcattgtcgaccgatgttctatgcatagaaggaccttatatggacaggtaaaaacggaggtcagagattgacagcaattgggtgtgatgggaacacccaggttctacctatggcttttgcatttgtagagagtgagaacactgaaagctgggactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaat

SEQ ID NO: 88037 - DNA, 1746 bp, Oryza sativa
ggatccatggtcatctccttttggatccctgtgtttggccaactcggttttgtcttctttggtggttgccctctaacatggacagggttctcatcctctgcttttactgatcttggtgctattatgaagctttcgttatcgtctggagtgatgctttggtaagtaacatggttacgtttatgtgtatatatgaaattttcaacaaaaaaattgatgatggcaaatagaaagttaatattttagatgctaactgttaatcaagtttttttatacaaataattagaagctcattaatttattctcatttttcttttaccttttcagtttagaattgtggtacaacaccatattggtgctcctcactggttatatgaagaatgcagaggttgctcttgatgctctttctatatggtaatatattccactctaatctgttgtgtattagtttagaaaacaacaaccagatcatgttgtatcatgtatatcattgtattgttttgtgtttctcctctagtaattgaaaaggttgcttattgaacattgttgttttcacttgcaaactttgtagccttaatatcaatggttgggagatgatgatttctatcggatttttgtctgcaatagggtaacttcacgatctcagctgtcactcactatgtggttcatctaactgatgcaacatgaaccataaatttgacatatacttaatgcatgtacatttttagagtgcgggtggcaaatgaacttggagccgggagtgcaagaagggctaagtttgccattttcaatgtggtcaccacttctttcttgataggatttgtgttgtttgtgctcttccttttcttccgtggaagccttgcatacatatttactgaaagtaaggcagtagcagatgaagtcgctgatcttgctccccttctagctttctccattttgttgaatagtgttcaaccagtgctctcaggtatgttattccatttgaaggacaagtatatcaaagtaattcaaaatttaacaataaaattactaattttctaatttatctataggtgtcgctatcggatcgggttggcaaagtgtagttgcctatgttaatgttacatcgtactacttgattggtatccctcttggtgcaatactaggctatgtgctaggatttcaagcaaaggtaaggaatttttgtatgatagaatttcactagttaatctggatttaagttgtgtccctcacttatgttcattctttttgcagggcatttggatcggcatgcttcttggaacactagtccagactcttgtgcttctattcatcacacttaggaccaattggaaaaaacaggttgcctttttttacctctgctcatatttttttcttatcctttttttctgattaaatatcttttttcaaataatttaagggtctctctagaaaattcatgggtcattagaagagcatatttttctcatttaatgatgtgcttcatgtttaattttttcaggtagagattactcgagagagattaaacagatggtatatggatgagaacggacgatcacagaattcaataggaaatgcatgatataaaacttctgcacacttgtaaagaattttgatgatttatgaatcaacctgtcaaaatgggattgtgctcggatttaagattttcaaggtttgaactttcaaaaaaaaatcatcaaggtcacgtatccaccaaagaacaattttaatcatatggcttggggggat

SEQ ID NO: 88038 - DNA, 2470 bp, Oryza sativa
atagacctaataaataaacacaaatatgtagatcatttagaaataaacttaaaaaaactatatgcagatcaatttggaatggagggagtaaggcataaccacttttcttatatgttacataatagtactactagtataaggcatgcatgcaagcatccaatttactatgacatcttctctattaaattactacttttttaaatcctctactctcatattatctaattctattggatgcatgcattatatttattaggatgatccaaactacaagataataataattatttcttggtctttgggttaatggaggttgtgctttatattttgaaatggagggagtacactgcactgataaatcttaattaatctgttttgcactgcatattacaggaaggaaaccaatatagatgtgtgttcggcacctcattttcccaatacatctccatcgtttttcgcgcgcacacttttcaagctgctaaatgatgcgttttttgtaaaaagtttctatacgaaagttgttttaaaaaatcaaattaatccattttttttaaaaagatagtgtaacactccgcttttcttgagacattaaaaactaattcggcaaaatcctaattgcgaaaatttcgttctttgtgtgcgagtctaagttatgccaaggatctcaattcaaatcctgttgttccctctcatcgaaatcaaaatcctccacctcaaattcctcttccgattcaagtctccaaatcaaattccaaaattcaatcgcatcctttgaatcctcgctaaacactcgctcccaattccgaaaaataccaaaccctatattgagccttccttgatttctccctgagcgctcgagttcgaatatcgaatttgaatcaaaatccaaactcagattctctccaattcaattcctctgcagaagtctatttttcctcctagttttggatgggccgaatccctctcccctcggcccatctcttctcttagccgttgcccctcctcccttcccacgtgcgccgcacgcgagctgctcgggagagagagctctctcattctctctcggttctctctctctctcctcttgccacactatacgccgtcgccgcgattcgattttcgccaccgcctttgaattcccgtcgcacccttgcgtccgcgcgtgctcccgcgtcgtggccgaccgcccggccgctcgccttttgccgtcatccatggctccaccactagcttccaaagcaaagaggcagtgccaccctcctctctctctctctctctcaccaaaatggcaagagaccgcgaccgcctcgtccccttgaccgcgccagcccgcgctcgcggtttgattctcgccgtccgatccaccgcctccacagcgcccttgcatccacgccgtcgccgcttttgcactgcctacgaaaccgccagctgccgccttgaccgccctaagtcggtttcctccctccccaaatcgacatccccctccgctataaaaactcgagcactcccatctccctcgttgtctcgcctcctctcctcgccacaccattgccgccttgaccgccgttgtcgtcgtcgcgcgtgccgtgggagccggcgagcgcgaggagccaaagaggagctccgggccgccccatcttcacactccctcttatcttccccgacacactcgcctcgacgccgcgctgcctcggcgtcatccgccgtgcgccgccgctcggtcgtgtgccgccatcggccttccacccctttccatcctcaaatcgccgccgataccgtttccgcacgccggtgagctcttcgcccaaattcttgccatttgcatcatcttggataagccccgagtcattcggttgcttgctcgtccccctaaacgtgccaccccgccgttgctatgcttcgccgccgccacgcccgcctatgcgccgccgtggaccccctcgccaatccctcgcgccaccaccattcttaagctccctaggaccaccccaaatcattccctagcgccgtcgacgccgccataagctcgccgtcgacgccgcttgaacccacaccgcacctcgccgtcaccggcttctctcggagtccctctgctccatccgacactagaaacgaaacccttgagcaccggagatgctcccgctgccgcgaatcggactcccgtcgcccgtcgacgaatcccctcttttgccaccgccggaggtcgccgccgcgattcgtcgccgtcgaagctcccccggcgcatccgaaccaagaaacgacaccctcaccttgtcctctctcccccggtggtcattcctcctcccgccgcgcctcgtgccgttccgccgacgcgcgctggcgtccgccgttcatccccggccacgggcttcttcctcctctcgccacccacgtggcctggcataggtgccacgtcggcttgacccggtcaagccggtcagccgctcgccctcgccccttcatccccgtg

SEQ ID NO: 88039 - DNA, 632 bp, Oryza sativa
tcaaacaagcagaaacttgaagaccccaccttccatcactatgtgatattctccaagaatgtgcttgcagtttcgactacaattaattcaacggttatgaactccaaggtatttccaactgattgaaaaacttatgaccaatgagtaatccttctcagttctaacttgtgtcctcttgacacatttcaggattctggtagcattgttttccatttgttcaccgattcacaaaatttttatgcgatgaagcattggtttgacagaaatatgtatttggaagcaactgtacatgtaactgacattgaggatcaccagaagctctctaaggatgttgattttcatgatatgaaactgttacgacctgctgaggaattccgtgtcacgttccgtaatcattatcaatctttccagaagcaaatgaaaactgagtacatttctacttttggccattcacatttcctcctgcctgaccttcttcctagcttgaatagagttgtagttctagatgatgatttgattgtccagaaagacttgtcatctctgtggaacctcaatatgggaggtaaagtggtgggagctattcagttctgtgaagttaaattaggacaattgaaggcttacaccgaggaacg

SEQ ID NO: 88040 - DNA, 1048 bp, Oryza sativa
cctcacatttctgggagaaagtccatgaagccctaggaagttaccttgcgtttagcacagcttatcatccacagacagatggccagacggagagaaccaaccaggtcctagaggacatgctgagagcttgtgcgctggattttagcaaggactgggagaggtgtttgccctacgccgagttctcctacaacaacagctttcaagcaagcctgaagatgtcccccaatgaagcattgtttggtcgacgatgacggacgccgctgatgtggtctaagacaggtgaatgagcggtatttggacctgacattatcaacgaggccgaagagaaggttcgcctgattcgagaccgtttaaaggtagcacaatcacgacaaaagagttacgccgacacccgaagaagaaacctggaatttaaggaaggagattacgtttatctaaaggtttctccgatgaggggaacgaaaaggtttaaggtcaaaggaaaactggcaccaagatatgtgggaccattccagatcatcgccagacgaggagaagttgcataccagttacagctagcagaaaatatcgccgatgtgcatccagtcttccatgtgtcccaattaaagaaatgcttacaagtgccggaagaacaagctccgctggaggaaattcacatttgcaatgatctcacgtatccagaacacccaatccggatattggatgaagctgaaaagaggactagaaccaaagtctggcgtatgtacaaagtacaatggagtaatcacactgaggatgaagccacctgggaaagcgaagaattcttgaggacggaatacccgcatctattcgaaaactggtaagaaatctcgggacgagatttatttaaggggggtaggtttgtaacaccctgaaaattcgatcgacaaaatcaaaactctaaaaatacggattttcaaaaacctttttaaattaattgcatcatgccgatcttattcgcctattttatccggatttgatctcgaagattattaatcgtgagtaaagaatagttaattaggaataaacc

SEQ ID NO: 88041 - DNA, 629 bp, Oryza sativa
ttcattcaaaaaagcacagtttaatgatttagaaagcttgtacatgaaaactgatcaagtaactctttctataagctgaaaaaacggtgcctggctgtgttcgctatctccggatcccaaccggaacagtaacgcacggaaaacagaccgatatattagcgcgtaattaattaagtattagctatctgtcacaccccaatccggcaccgccgtacaacggcacctgacaggagcgtgtcgtaggaaaaacggggtgaaccgctttcaacgaaaccgcgatctcagtaccagtcccaggacatagtgctggtacccacggtgacaaatatgaatcattgcaatccttaaaataaatagaggacttaattaccttaacttaggttgcagctcagaacagcccgagaatgcaaccgacgacgcggacgaggaaacaccaacaacagcagcagtggcggaaccaacgaactaacacccaacaccacaggcgacggctgggaaccaagacaaacccctatctttacttacttaatcttaactttcaggcgggggaccttatatatttatatagagcagggggagtctttttgtacttaacacgtacgggaatttaggtgtctgatgcaaccttg

SEQ ID NO: 88042 - DNA, 836 bp, Oryza sativa
aaacctacccccccttaaacggaatctcgaccccgagattcggaagaactgacgaagagatcgggatgggatgccttcagctcgtcttcacgctcccaagtagcttcttcctcggcgtggttgctccattggaccttgcaaaaacggataacccggttcctggtccttcgctccatggtgtccaggattttcactggcctctccacgtaggtcaagtcttcgcgaacttcaatttgctctgagtcggcctgctgggatggcactcgaagacatttcttgagttgcgacacatggaacacatcatgcacgttgcccaaggaggcgggcagctccaactggtaagcgacttctccgcgccgagcaatcatacggaaaggacccacaaaccgaggtgcgagcttcccctttgtctgaaacctgtgtacacctcgcaagggcgtgacccgaagatacacaaagtcatccactgcgaattccaggtcacggcgtcggttgtctgcataactcttctgccgagactgggccacctttagattatcccgaatggttctgactttagcttcagcttctctcaggatatcggtcccgaacacttggctttccccaacttggtcccacaatagcggtgtccggcatttacgcccatacaacgcttcataaggtgccatttgtatgctggcttggtagctgttattgtaggagaactcggcataggggagactcttatcccaggtcttcccgaaatctaggacacatgcgcgaagcatatcttctaggatctgatttagacgctcggtctgtccatctgtctgcgggtgatacgcggtgctgaaatt

SEQ ID NO: 88043 - DNA, 697 bp, Oryza sativa
gaggccgtggggcttgagatgctgcgcatcgaccgcgcgtggaagtccgtgaagccgacaagctctgccagcggcagccgcgggctgatgccggtggagctgctccggcctgtggtcgccgccgtcgcatcgctggctcgctgcgtgcgtgcatgtgctgaggaatcgaatcgaatcgagggaggaagtggctggtgcgtggcggcgatggacggggacgccagggtgaggagtggctatggcgcgagggcgggtcctggtgctactactagtgctacgacgtcgtcgtcgccgtcgtacatgagcattgacggcgacgacaatggtggtgccggcggggcgaaggtgtgggtgctcgtgctgctcttcttgctgatcgtgctcatgttcttgccgtcggtggtgcggcgaggcaggccatggggaggagggggaggagagcaccatcgaggagggggcgggcttagcctcaagagcggccgggatgttgtcaacctctgcctcgtggcgttcgccatcctgtgcgggctgcttggccgcgccagacgacttgctgcctcgccgccgagccggctggaaagaactagctcggcgccatacacgaaagggaattcactgtatgtgcatgtgctctcgccctcccgatcaaaatttcccctcattttttttgtgatctctccatctctatattcaaatt

SEQ ID NO: 88044 - DNA, 658 bp, Oryza sativa
aggatgtggataggtaacaatactttacttcaacaaaagattttggctaacttgcatactgcaccagttgggggtcattcaggcattcatgtcacttatcaaagggtgaaacaactatttgcttggcctcacttgcgcactacagttatgcagtttgttactgcttgttctgtttgtcaacaagccaaatcagaacatgtcaagtatctaggaatgttgcaaccactgcctgtacctgaacatgcttggcaagttgtttctttggattttattgagggcttaccaaagtcagctaccttcaattgtatcctggtggtagtcgacaagttttccaagtatagccattttgttcctctttctcaccctttcacagctatggacgtggccgaagcttatatgcagtttattcataaattgcatggattacctcagtcactcatttctgaccgtgataggatcttcacaagcaccctgtggactactctattcaaattggctagtacacaactccggttgagttcttcttactatcctcaaactgatggacagacggagcgagtgaatcaatgtcttgagactttccttcgctgctttgtgcatgcttgtccttctcagtggagtcgatggctggctctagcagagtattggtataatactt

SEQ ID NO: 88045 - DNA, 990 bp, Oryza sativa
ttttacttgataattttatctccaatgcatacattttgatcggaccgggataaaggttgggttcatcgacagcgatgcacccagtgcaaagtcgacccctgcaacgtttaaggctgttgcagaaaaggcttgtaaactgagtgtcaaagaagcaaaagtagaataccccaacgttcgtgatcatgcctacttatgcatggatcttatctacgaatactccttgctcgttgacggcttcggtacgtacactagcttctaataatggagatacaatatatatccatgtataagaaattaactctaaagaaaaagaactcatatataggtgtgcaaattgttgaacaatttatctaacatgcagtttactaatatatatatatatatatatatatatatatataattatatatatataattggatgtcaggtctacatccaagtaaggagataacgctggtagacaaggtgaagcatggggagtactacattgacgcggcttggccattgggtacagctattgaagctgtgtcacccaaaaaacggcttcgagaaatatacaaatgatattgagatcgatgtactagctactttggaagttaggatatcgttttttgtatgatcgatgtttgtgtgctggttattacagtataactgagtatcatgatatataagtagtatgttaataacggatcgagctatcaatagatcgaggtggccatgctctttgtcctagactccaagttgtgtacgtttgaatatatagcagctttctatatataattactatcatagaaatcatcggttgtgttcgtgtgtcatgagcacgcatgtcttgtatgtaaaagactgaacatctggtgcacatttgagtatttgacctgacacaatcgtatcataattatttttttctaagagttcagatagtgtgaaagtaaaataaaagaagcatataaaactacaagctaaatgtattgcgcgttcagagttaag

SEQ ID NO: 88046 - DNA, 1078 bp, Oryza sativa
cctttcgctagggtttctattggccgacggctctcaacgatgcggtcgacctggtccggcggtgcagggcgtgccagttccacgccaggcaaacccatcagccggcccaggccctgcagaccatacctctttcgtggccgtttgttgtctgggggctcgatatcctgggtccgtttaggcgggccccgggcgggttcgagtatctgtatgtcgctgtcgaaagttcactaagtggcccgaggcttatccggtcgtcaagatcgataagcactccgcgctaaaattcatcaggggcatcactgctcggtttggggtgcctaaccatatcattacggataacggcacccagttcactagtgagctcttcggtgactactgcgaagacatgggcatcaagctctgcttcgcctcccccgcccaccccagaagcaatggccaagtgtagcgcgccaacgcggaaatcctcaaaggcctcaaaaccaagaccttcaacatcctcaagaagcacggcgactcgtggatcgaggagctgccagcagtgctctaggcaaaccgaaccacgccaagccgagcaaccggggaaacgcctttcttcctcgtctacggcgcggaggcggtcctcccatctgagctcaccctgaggtcccctcgggccaccatgtactgcgaggctgatcaagatcagcttcgcagagacgacctcgactacttggaagagcgaaggcggcgcgcggccctccgagccgcgcgctaccagcagagcctgcggcgctaccatcagcgccacgtccgagcccgatcactctgcgtcgacgacctcgtcctacgccgcgtccaaacgcgtgctggactgagcaagctctcaccaatgcgggagggtccgtatcgagtgatcggcgtcccccggccgggctccgttcggctggccacgggcgacggcacagagctgcctaacccatggaacatcgaacaccttcgtcgcttctacccctagtgggggtcgggtgtcaggtctcgggctcaggccaaccccgcacccccccgggcgtgcagggttggccgggggctaccacatgca

SEQ ID NO: 88047 - DNA, 1190 bp, Oryza sativa
  unsure (1)..(1190): unsure at all n locations
ccccctgggcggcgtcgagcttcttccctagctccgcctcccagttcccgtattgaaggcggagggtgtcctgcgcctcgttcatcacggtggtggcaatgagggcagtctcccactcctcctccacctccttggcgatctccgccaggaccttcttacgggcctcaagctcggaagcatgccggcggtgtgccttgcggcccgcctccaccatggcctccaccgagcgccgcccctcctcgacacgcgcccacgccgcgtcgagctccgcccgctccgcctgcaggacctccatctgggcacttaacccgtctaacaccgtagtattcgcggcggccaaggcctgcagaaggggctctgcgctcggtggggcagcggaaggcagaggggagagccgtctcggtgagggtgccgcacggctcggcccgccgatcgacgtgccggacgcggtgtactcccaggtgccccgggcgcgccgttggagcggcgcgatccggcgacgaaggtagtcgccgaacaccatggcccccgtaagcccctgngatcgcagacccgccaggcggtcaagaatggcgtcgtagccgtctcccagatctaccgtcgcccgccagctggaggcctgcgccgggggctggctcggaagtcggaggcgcgcttcgtcggcgaggagggtgtagaaccaatcgctcttccagtcgtcccactttttgcggaggacgcagggaatgtagcggttcagcacctgcccccgcggctggaagtagcagccaccgactaccgacggcggcgacaccggctgtacggtgaagaaccaccggaacagccggagagatgggcgcaccccgatgaacatctcgcacaggtgcgcgaagatggccaacgtcattaccgcgttgggggtgaggtgcgccatctggagatcataaaactccagaatatccatgaaaaaagaagagaatggcgggaccagccctgccattgcgaaagagaggaagaagacggaccgccccgggtagtgtggcgccgggcgtccctcacccagcgcgaccacctcccggccggtgacagattccggcatgaatcggcgcggcagcccggcctgcctctcgctcacgatgcgggaaggcggcagcacgctaccgtcgagcggtgcggagccccgtgccatgatgccggcggaggaggagctt

SEQ ID NO: 88048 - DNA, 2606 bp, Oryza sativa
tgctgctgcttgggatgttcccttccgatgggtacacgctcattgaggagaatggcgccctgaagcttggatggaaggatctgtgccttctcactgcctctgcttggcgcccaattcaggcttcgggacgttagtactgagggggaatttatagagctgaagtatcacttgatcttacttaggtgcaattacctagtccttttgcttcttttagctgctcaatttggtcaattctgagaaaagaaaaataaaaaaaattctgatcactaattgccagatctccacacggtggtagttactgatgtgcagcttagctttagcttttattctgttcatgctccagttaaccattctgtccagtttagtttattttgcaattttgtagtgcttaatccttgctgacattgttttgggggaacacgcaaaaggatccttactgacattagagatgcagttcttatcgtatgatcattgatcacaaaatgaaatatctggtggttagtgagctcaattagattgttgatagtgtagcattgtcaatgatcaccaaataatattgttagtgtccatctactatgagaatttacatgtacatttaagttaatgttcctaattttctccagaaaatgacttagggttgatctgaatgccaaattatcagcaatgaactaatgatgggtagcacatgagttgtgtactagaaagtcaggatgttagtggttttaattcatgccatctaaatcctgctaattcttttcttctgaaatatttgaaaccactgacctacactgctcatttagacattggtgtatcacttttctaacatttttgcattacaataatcttattatgtaattcacttattcctgtatccggcatctactggatatacatggttttactttttaacatcattttcacctttccgtccgtgatggttattagcttgttaaaagtcttgcttcctggacacttcggccagtatagccattttgtatgatcagcttggttccatgtttctttatcacaaaggttacgttccacgattgagattctggtgattttcttatttgactatccccatcaagaaatcccactccactagttttgctatttattttttgttcccggctaacctaagccaaacaggcttcttgggcattgtttacctggatgtcgttgtcttgcatattttcttcattacaatatcatcacgaatgttttggttgggatttgccttgagttagtaacattcctaagtagtttcgcatgttttttttttccttctaatgctggtgttgtctaccatttgtttgcgtcttattggcctacccgctttatgcaaaatagtagtatgtctgaatgattgctgtttattcactgccagattactacacattgatactttgtttactttgctaaagattggcagtttttggcactgggcacacctgcatttccaaccaaccaatgccatatttcactattagaagtagtagtaactgatttagcttcctagtcacatttccaaagttggttatgtgccaatgtggcaatcttgaacatcactttcattcaagggttggaacatagatccacctgatgatgcaattaccctcaaatgaatcacttgcttctactttacactcattatggtgttgtggagtgagagagggattgggattgggggcaggcagagtggggagagaaggcaggctataaatttgtttcccaacaatgcctttagaccacctttgcctgcttgccatgatggggtgatgcatggcattggcttctttcttctactgctactactacaaaagcttccctctttctcatgttctctctcctgcaaggcttcaagggtccaagcaagcaagcaaagggcccaatcttttcttgtccccagggcccagcattgccattgcccccaaggagaaggactagtccttttctatcagcagaggggcctgttgtctcttgttctcttgtgctagtgtggggagctactggcacgaggtcagcttggaaagacactgacctctctaaccccctttggcttgtgcagtgcagtgcaatgcagccttggagttgcagaaaagggggttgctagctatagtttggggaatgatgatgatagtcaggaagtggttgttgaacatcttcaatccatcgcaggaaagagaagggcactctctttgcgtttgatgttcttcaccacctgatgtgatggttaacttccctctactccctgatgcttttagttataaagggtaatttgcaaggactcttgccagaagagagtacagtgattattagttgagcatttcttctgaaactggttgctgatagagttacttagaatgaatgaattaaatgggggatgatgattgtatgagtggggcaaaggaacatgcagtgccatggtcctgaatattccccaatcatggagcaacaaaccaaatcaaattgcacactgtgtgaatgtgatgtgtgtgagactgagaaagagagagagagagagagcaaacagccaagcaaacatacctacaacacagttgctcctggcttatcacattgtggacctggggtgttgggaggactgc

SEQ ID NO: 88049 - DNA, 1712 bp, Oryza sativa
cgcacactgtttaacagatgtgcttaagtccctagaagacacatggttccaccacatctagaaatatatggcatatgtggtataaaatccgagtaaataaactcataaaggatttaccaaccgcctggaaaatgaccaaaatatataatcagcctaagccataatattggtcaataaaagtgcacacttacatggcaaaaagcaatgatattgtatccaatcaattgctttatgaacccaaacagcgccttgacttatataaaaaagtcagcggggagctatataaagcattactgtttggcaccttttaaaatgcattgtaccaactcctaaaaagttgagtaactgcggtataaaaggattttaaggtattgggcacataatcacgcgcacttttgcctaagcaaaaagatgcctaagtccctaaaagaacgtgacaggccacacctgaaaatatgggctgcaaacatattaggcctaggccaaaaaatatgccttcgacaccctttaaaggatgacgcatgtaacatgctcccgagtaataaatctttcgggtgatatagaccaagtgtagctcatatgaatagcttctgatctaagtgattatgctttatgggatactccaaaatagatataacaattgaattccgactggcgcaagtattcggttgataatccttacggggaataataaatagtccagtctttgagcatagaaaatagacccatgatcatcaaattcatgttgcatgtatccggaacaagtccaaattgaaggtatgatacttatgtttgaggtagtaagcccctgagtatataacttgtcgttctgtcgtagtcacaattgtccattgatggtagcttacgcagttggcatagagacaagacgaccaatatagagataatattgcccaccagaggtggcaaaaatattggtagtagtgaagataatgataccaatcaaaagtgatgaagttgcatagccgtggaggcgaagaaaccagtcggcaacagtcaggtcagccagcaatgaatatgaaggcgcccagcgataaagttgtgtagccatggcagtgaaataatcagtcggtgacagacgatgcagctggtgaagaagatgaagatgcccattagtggcgacataataagccatccatgaaggcgaggataccggtcggtggtgacgaaagcaagccgacggtgaagatgtagacacgcatcaaaggcgatgacgaaatccaccaatcatgaagatgaagaaaatagtcggcaacgacaaacgcaaccgacagtaatgatgataagcagcaatcatagatgatcaaatataatgacgaagttgcccatcaatagcagtagagtgggctatgttgaagaggcttgataggatgttgatgaagataacgatgtcggtgatccagtcgatagcaaccatgaaagtgaaataataagtcggcgaagacatagtcatccattagcaacagagttgatgacagggccaatgaagcataggtgctggtgataatgtcagtgacaataatccatccaattggtgtcatagctgttacagatgcttcacttggaggaaagtagatgatgttgtccaactcgtcgaaactgagctgattggttgatgcctctgccctaaagcaaagacgaagataatgactcctgtcattgactcgttggctaattaattgattgcttcagct

SEQ ID NO: 88050 - DNA, 1193 bp, Oryza sativa
ttatttcagtatttcaataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccgcgccttttgaggactgggacctgggcacgaacccttaatcaagctaagacacaaaaggaccacggcacagatcatcctcatctcatacacacagcaagatgaaattgacacaaaaatttcttcatttttgattacagattaagttgatctatacaaaaaagaggcccgaaggccttagaagaaagaaaagaagaaaaaactgaaggatggcgggggtctgggggctcaatccgatgcacccgggtcgccggcctcgtcgtcactgttgtctgcaccaccggcattgccctcctcgtcggagttgggggcgaacgcgagccgaggggccgagccctcgaagctgtcgacgatatggtcggcggtatcccggacctgcgcgcgcgcgtggtcctcggtcccaggagggaactcatccagcgccatccatggagagaaattggggtccctggcctggtaactcgctaggacgagctccaccgctccttgggcgaggtccctcgaggatgacttaattgtcttctcgagctcctcgtggagccgttggagagccccggccatcttcgagaggcgctgggcgagacctccctggttggcggcgtactttacggtccgccctctccagaggcccacttgccgaccggcgcaatctaggcgggagacggcgtcccaaagcatgccgggcccaacctcgcctgccaagcggagggcttcgacctccccggcggacgagtccagcgtgccctgcagatcggcgatggtgcgttcggcagctgcgaggcgggcggctaagtcgctttcgcccgcggccgccccgccgctgcgcgccctcgcgtccaactccttcgcccgcgcctcgagctcagcggcccgttggttcagtgcggccctctcgg

SEQ ID NO: 88051 - DNA, 820 bp, Oryza sativa
caaaatggtagcagggatggaatggatgaggaacgtaccaacgatgacgtctggagttgtcagcacgtcctcggccgtcacgtggttcacacgaccccgaatgacatccttaccaccgttgttggagcagggaggcgcttggccttgctggcgcctcgacttcgggcatttatccgcaaagtgcccgggctcgaagcagttgaagcacagacgctgcggaccttgaacgtccctgcggccttgaccagactgcgcggctggcgtaggaggacggggcgcatgggtcccttgctggctctgctgttgctgcggctgtgggacgcgcaccacgaattgaggtcgaggcgcggagcgaggttgctgctgctgcgaggaagatccccctggatagggattggtgtagcggatcctttggttagcaccctgttggttgcggaaatcgccaagcgacgcttgtgcgactccagttccttgtgcttggcttccaagcggatgcttttgtccaccagacgttggaaatccggatagtcaccggagactagacggacagacagctccgggtccattcctgccaagaacttctcttgcttctcctcatcttcccgcacatcctccggggcgtaccgggccaagttgttaaactcatgcaaatactccatcacggagcggttgccttgcttcaactctcggaactcccttttcttaagggccatgactccggcgggcacatgggtcctccggaaggcggcggtgaagcgggcccaagtaataggctgcccctctggctgcgtagcctggaaatgatcccaccatagagatg

SEQ ID NO: 88052 - DNA, 1402 bp, Oryza sativa
caaaagaagcagtcctgacattgctatttctcatataatttgttatgaagtttaattgtacaagttttttttttttacaaacaaagcagaagatatagatttgattactaagatcggactcacaatggtggaagatcagcatctgcaatggtgtcactgagcatgcgttcatgctcttggatgttttgtttcagttcacgtgtaaatgtttcctggttcttcagctttgcaatactaggatagtgagctcttgccatgaaaagttgatccttaagcctcttcacaataaaatctttcatcacttccttatactcaacagaccagaggcagtagctaccatattcaagttcacaggatctggggttctcatgctcgacttcttggtcttggttctctttcttatcaatagtagtatcctgtcacagaacagattcagagccttgtggcagaaaaaggaaagggcatccatcgtacacaaacacctatcaggttattgtgctactattgtcttcaaattcatttataccaagggaaaaaaatctgaaatttgaaaaagccttttctaatgtatcattatgtccataatgcagttgtgatttgccaaagcattaacaaacagaagcaccaaacatgtgtgtccaagatttgcagagtaatacaaaattattcagtggttctgagccatagaataaacttgtaccagcgaaaaaaatgggcacccaactaagtttcagaggaaaattcagttctatactgtgctgcaaactatgtcaagtatgtgcattcttaactgattgaaagtactggcaacagtgagacatctaagaagcaatttttaaggtgtgaaatatggccaaaaggacaagtcaactgtatagtacaaaattattgcacttttaatcaacacaaatgtatacattattactgaagccacactggaaataaaaaaaaatgttcctactcaaatattttacattcactatctgtcttcctgaagatcccattgactgtaaaatcccattactaatcaacttatcatagcaagaagtacaaacattataactaactgtgctcacagacaagaataatccgttggttactccaaaccaatgaaatgcacatatattaaaatcctaagattgcaaataagcatagaaactatttcttacctttgatctccaggataagtcctttaactggtatcttctttgtgtatgaagttctgaaataacattggatactataaaatggatgctggtggtatcttacagttcttgttttacaaagtaaatgcagtaacactctgcaaaatctgatctgacatttcttacctttgttttttctggtctcattttttagctgaactaaagaggaaacgagctcgagcttttcttttgatttg

SEQ ID NO: 88053 - DNA, 609 bp, Oryza sativa
tacgccatgggcggatggaccggctatggtcacgcagtgtccggtccgtcccggaggcaactacacttaccggttcaacgtcaccgggcaggagggcacgctgtggtggcactcccatttttccttcctccgcgccaccgtctatggcgcgctcatcatcaaacctcgcggcggcgccaaggcctacccgttccccgtgcccgatgaggaggtggtggtcatcctcggtgagtggtggaagacgaacgtgtacgacctgcagcagcgctccctcgttactggcaatccggcgccccacgccgacgcgtacaccatcaacggcaagcccggcgatttctacaactgctctgcccccaaccgtaagttgctgatcgatcacatgcaatattcatggcaatcgagatgtgtcttggatgaattttgatgtgtttttttttgctggcagaaacgcacaagttcgagctgaagcagaacaagacgtacatgctccggatattcaacgttgcgctcacaacaccgctcttctttaaggtggccaaaccacagcttcaacgtggtggccgccgacgcgtgttacaccaagccgtacaagaccgacgtggtggtcat

SEQ ID NO: 88054 - DNA, 588 bp, Oryza sativa
tctcctctttcttcaacaactgtgtcatgggtcgagcgattttggagaagttctcgatgaacctccggtagtatcctgccaaacctaagaaactgcgaatttgagtgactgtcttgggttgcttccaatcggtgacggcggtcactgtttcgggatccacagcaactcctttagcggatatcacgtgccctaagaatttgacttcggacaaccagaactccacttgctaagtttggcgtacaattgatgttcccgcaactttcccaacaccagacggagatggtgctgatggtcttcctctgattgtgagtataccagaatgtcatcaatgaaaaccacaacaaacttatccaagtatttcatgaacactttgttcattaagttcatgaagaaggcaggagcattggttaaaccgaacgacatcaccgtgaattcatacagtccgtatcgcgtggtgaatgcggtcttcggaatatcttcttcacggatgcgcaactggtgatatccagaacgaagatcaatcttggagaataccgtggcacctttaagctgatcgaacagatcatcgatccggggaagagggtactt

SEQ ID NO: 88055 - DNA, 592 bp, Oryza sativa
gctggtactgtttttcagttttgcatcttagtttatagtcaggttgtatttgtattgaagcatagcatctctactcaattccgtcgtcataacattctgtttttgggggcacttggtgtttaccgtatttgccagttcaacaagaggaccacatcgcccaatcatgaacctccatgagagaagtttgagtgttttggcttgccgttatgttgatgaagtgatcattggtgctccatgggatgtttcgaaagatatggttagttttctgttctactttatcatgatgctctcttactgtagtaggaattgcttgatgcaactgctagtaatagttcattgaacatggcacaactatgcatgcacagttcaaagattgaacatgatatttatgctacgccagcaaaagccttgctcacagctattattgattttagatacagattaacagatatggtcggatttgtgcttatccatgattttctgcagatgcacgattgcacgtagcattaattttatgtcacagtcaaataaactaaaagtttaggagctggctcggttccaaaagtataatttgatgtagtctaagtttccg

SEQ ID NO: 88056 - DNA, 596 bp, Oryza sativa
tggcaagtggatatttgctttgacagaatttgatcttcggtatgaatcgccaaaggcaattaagggacaagctatagccgattttattgtggatcaccgtgataactcaatcggctcggttaacattatgccctggacattgttttttgacggatcagtgtgcactcatggttgtggtattggcttagttataatttctcctcggggggcgagttttgagtttgcctatactattaagccttatgcaactaataatcaagttgaatatgaagcggttctcaaaggattgcaattgcttaaggaagttgaagccgatgctgtcaaaattatgggcgattctttgttagtaatcagtgaattaacaggagaatatgaaggcaaaaacgatatattgatggtctacaatgagaagtgccgagaattgatgagtgggtttcggctggtaactttgaaacatgtttctcgagagcagaatgttgaagctaatgacttggctcaaggggcatcgggatataagccgatgttgagaaatgtcgaggtagatgttgcaacgattacagccgacgattggagatatgatgtatttcaatatttgc

SEQ ID NO: 88057 - DNA, 660 bp, Oryza sativa
gccgtcaccggcaacgcgttcgcgcgtgcgcgcagtcgtcttcgccgcggccggtaggccgagcttgagccaagccgagccgggtcgccagccgcccgtccgatcgaccccaagggcgatcaggagccgtcggtcctgtggaccggcggtggaccacccgcgtggtcccggtccgcggtgaaccgccctcccccttgagtcgctgaccggtgggtcccgcgtgccggcgcccctttcctccctctcccgagccgctgaccggtgggccccgcatgtcggcgccgcgcccccttgatgacgtcagccctgggatttattgcgcaataaatgatttaaggtttttctttattagtaataaacacagtgaatcttctaaaattcataactaattcatccgagctccgtttaagcccattcaaagtctcagtaaatcaagaaaaatgtgtagaatccattaaaaatggttttgttccctgtttcagtagtcttatagcctgtttgcaatgtttgccttgtatgtcgcgagattccggttccttcgacgctccagtgtacctcgaaatagtcgccgaggttcctccagcagcagagcaaggcaagtcatgcttgtcacttgaacatgttgatcctatattgcaaatgctctattgttttctttca

SEQ ID NO: 88058 - DNA, 570 bp, Oryza sativa
ttttcttttctggtatgtaggttgataattgtccgtgctgtaaaatgggtgcacgatatcattcaagatgcaccttatgccatgactgaagatttcatgaacaaactattcaatgagtataatatagattacattatccatggtgataatccttgtctgctcctagatgataccgatgcatatgtccttgtcaactagatatataatcatatttcctccaaaagtatatgaccttatcaaccaaatatataatcacatttcctccaaaagtatatgtccttgtcaaccagatatataatcatatttcctccaaaagtatatatagtcccaccatgaatggtagggacattatcatgcccaaaaacaccctttaacaacaaagacaacgacaaaagataacagttttaagatatattattaatatggtcatatataattaactctgataattaagtctaatagtagaaacttacgctgtactcaggacgtctgcatgcaatccatattccttggcaaatatgaaggatgaaatagactgaggtattgcagcctgcactcatttcatgagaa

SEQ ID NO: 88059 - DNA, 644 bp, Oryza sativa
caatgccagaatcattaacagaatgtacgataggcgaggcttcaacaaagtccgcctcgtcatccaacattgcaggaactggtgggccctcttcaacctgtggctcgctgcttgcttcagattcagcctcggctacgaatggctccaacttggtgccttgacgctctaccatttgtcttctgtcaatggcatccccatcaaatggaagcctcccattttcagaagctatctttcctggtagatccacggaaaagggtggcgtgaacccaatgaagataccaaccatgaagcacactaataactgcagcatggccctcttcaagctcattcccttggaccttgacctctccaaggaccgggcatgcttgtgggatgatatagctgcccaagcagacttgaggctgctcgacatcaggacaaggtccagcgaggccaccgatgtcagaagccccctcattgcaacataggactgcgagtacgccagcttgggagacggcgaggggtcaaattcctcccagtccttgactgacccctcccgctgcattgccccggcattccttcgggacattgcaggatcgcaacagtatcaagcatgtacagctctcgaaccaagcaaaggcatcaaatttgacacgaaatcgctg

SEQ ID NO: 88060 - DNA, 666 bp, Oryza sativa
actacgttagaaacccattcagcatatcggcatggccgtataaaaccagcgtcacacaaacgtgcaacctcagccttgacagcctcaagcatatcggctttacatctccttggtggttgctgatatggtctaaccccaggtttgatgggaagccgatgctcgacaatcgatcggctgagtcctggcatctcatgatattcctaagcgaagcaatctctgtactcttttaaaagctctatcaacttggttctgaattctggggacaaattcttactaatgaatgtcggccttggtctatctcctggacctatgtcaatttcttccaaatcatcagccgacatgaaaccctgtccttgcttgtcatcgagatcatctactgtgtccttggtgtagacatttgaaccctccacgacgccctcaaaataataatttgggctctccatcttcaatcagttgtatatcacaatcggacacttttagaaaatctccatcccaaacttttccagataagcaatcaataccatacatctcccaaagagctagattggcattagcaacattaactgacctgtcggctagtacaatttcaatcttgtcaccatgccattgaattaagcactggtgcatggttgaaggaatacaacaattagcatgaatccaatccct

SEQ ID NO: 88061 - DNA, 1170 bp, Oryza sativa
tttctactttattttatcatccagcgggacttggcacctgacgcggggctgcatcggtcttcgatctccggagaagggataagtccaatgtttcgtcggcccaggcaattgtctcatctacgtcggcattgttcaaggctgcatcagtacattcgacctcttggattgctctggtttggatgatatatttgcctacctatttatcatatgtctctattaatctagtcttagcatatcaatttagctctatcggctgcttctcgttttagggtttctgccggtatcggctaaatcgcgttgctagattagattaacttagacatctaccactctgaagactcagtcaacggcttgattgtctagatattatgtttcttttcatacttagttctgcatcagttaagtttgatctactaagtcgtgcttagaaccataatctctagcctgcttcttgattgccaataagggtttcatcggggtttcagccggtgagttatctggacgttgcatcggctcataaggattgcatatataagttggatttagcttatgacaacaaaggcttcactgtttaatctaatcttgtggatttcatgacatcggacctccagccgatgtgtgctttaaccttcggatcgatgcttatttgtcatatcattgctagccgattggtttatacaggattatattgttattgtattacatcatcatcagccgattgcctttatatcattatctacattggacatatagccgattgcttaaaccctatcgctatcggctggtatcagcatcggctattatcggctatcggctggaaatactccatcggcttgtcagccgatcggttgttttgtctactatttgcatatcttgtcagttgcaggatcaaactgactggcacgcccacatctcattaagatttggacctgcacaggagctaagcagatctcccaagccggtgtgttcgattttttcgtcaacaccagccaatcatgcattaacccaaacacttgaataatatttcttaaagtacttgccattgagcgcccgtccataaaattctccatcaagtccttgcaacatataggctcctttagacacaaccttatggatgtgaaactgtccttcccaatttggtgaccacttgccgaatttattatcacgagt

SEQ ID NO: 88062 - DNA, 1816 bp, Oryza sativa
tgaagcaagctctctttgattgcctctttcccttgtcatcatccttcctccctttgccatagccactcttgcgaagaaagtgcttgaatctcttgacaataaaagccatttcttcatcttcactttcttcacaacttgactcttcttcttattttgccttcaaagctacttcttgatttttgatcatggcggcattcttcaccatttgcctcacttcacgagcttccacttcttgcatctcatgagacacaattcttccaagaatgtcacttggggtgagcctcttgaaatctttcctttcccgtatcattgatacaagagtgggatttcttggaccaaaagcacggagaaatctcttgaccacaaagtgatttgtcatgtcctcactcccaagtcctttaatcttgttgacaaggatcatcatcctatcatacatctcttgtggtgtctccttgtcatccattacaaatcttccaagccttccttacaataattcaatcttggcctcacgaacggcgggtgatccctcatgagccaattgcaaagtatcccatatctccttggcctcctcaagaccatcaaacttgttgaactcctccggactcaaggcggagagaattgcattggaagcttgagcattgcggtggatgagctgctcttgctccgaagtgagctccatgtcatcatggggtacatcaacacctgtacaaacaattttccaaatacttggatgcaaagagattagatgcaacttcatcttgtgcttccaagcggcgtaatgtgtcccatcaaattgaggagcacgcccggaaggcacggagacaaagttgtgagggggaatggtaagtttgctgtaatcaaaaggtatagtagctcccttggataatgaagttcccttgctgctcgctccatcttcatttccattttccccgttctttccccctaaatccgacatcgtggattactcaaagcggcgaagcttgaatcaagagcaccttgctctgataccaattgaacgcgttgatgaagactagagggggggtgaataggttgtccctaaaaacttaaaaacaaatcaccgcggtaaagtccaaacagaccaggaacttcctggtaaggaactccagaacttccagcctgccaggcccggaacttggacagatggagtattgcaaaaaaggactccaagggaaacttgacacttggttcacactaagagcacttgatatatcttagagcatcacctggaacccctcttaaatagtacggtttttcctaaaaacttgatttcaaaagataaactatcctatgcacttctcgagttccggtccgctttgattttgtactttttggggggtctccaagcatccatcttccacaccttggactaatgcacctgaaagctactcaatgagctcattagtcccttaaccacatttgtcattaatcaccaaaacccactaggaggattaatgcactttcaatctccccctttttggtgattgatgacaacatggttaaaggttacaaaagattgataagaattttgatttgaatggttagaggtgaatgaaactcccccttaatgtatgcatatgaaagatatgagtggagctcatatgcatatatatatgggagcaaccgaggagagtttccttcctccctactcattcatgggatgcgaaaagcagtaagaatagatattatatacaaaagatacgacacggtgagcactcaaaaagataaaatcaacatcacatcacaaacaacaaataagacactcatagcataaatgaagagcagaataaataaaggg

SEQ ID NO: 88063 - DNA, 721 bp, Oryza sativa
ggatcccccacttgtcaccagccgatagatataatctgaacggcacccctttctgtggaggaatcagaaccggtggggaactaagatattccttgatattacccaaagccttctgctgctctgccccccaagtgaacttttgatcggctttcaatcttaacaaatgtgtaaagggttctaactttcctgataaattagaaataaaccttctgacaaaatttatcttgctgatcaactcctgcaacttcttcttgtcctctagaggttgaatcttctgaattgcattaacactcctttgagtcacctcaatccccctctcatgaacaagaaatcccagaaactggccagccgacacaccaaaggcacattttgttgggttcatctttaagccatatttcctggttctctcaaaaacttacctcaaatcggctatgtgattttctagttcttttgacttgactaccacatcatcaatataaacttcaaccaaccagccgatcagatcatggaatatgtaattcatagcccactaatatgtagctccagcactcttcaaactgaaagtcatcacgacccattcaaacaagccgattgcacaaggacatctagaggctgtcttatgaatatcttcttctgccataaagatttgattatatcctgcattgtcatccataaaacttaatatcttgtgtcctgaagcagcatcgaccaactgatcggc

SEQ ID NO: 88064 - DNA, 554 bp, Oryza sativa
gacgacgacttgcacgggcagaccaccacgacgtactaggctcctctcagcttggaggagctccagaggcgcacactcaggagcagccagaggtcacacctgtacaggcaggacgggttggccgtgccgtacccccggaccaactcacgtactcccacgggcacattagggcgcagggtaggagggacaggggtaagaggcctcgtcagtagtgtctacctcttcagtccttatgtgactgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtctacaacagcacacatgaaaagcggcagctcgagttatcactatcaactttcggcgctgcctgtttacataaagtgaatcacgcccacgcgtgatcgtcttgtcacatctaatgaataatgtatctcattgagt

SEQ ID NO: 88065 - DNA, 699 bp, Oryza sativa
caagaactgcaaattacaagtacaaggaaaattactttttctcatctggagttgacaaaaatttaaataaatgtaattcagtgctggagaaaaaaaaaatcatatgatcatctaaacagatgcagaaaaagcatttgacacaagtcaacattcttataaaaactttcaacaaattaggtatagcaggaatacttctcaatataataaaggttatatatgacaagaccacagcttacatcatacccaatgatgaaaagctgaaggctctttcctctaagaccagaaacaagacagggatgctcactctcaccactgctattcatcttagtgctggaggtcccagccggagcaattagacaagaaaaagaaaatgcattcaaattggaaaggaagttatgaaactgtctctgttttcacatgacatatatcttatatacagaaaattctaaagactctaaaaagactgttaaaactaacaaatgaattccgtaaagttgcaggatacaaaatcaacatgcaaaaatcagttgtttttctacacactaacaaggaactatccaaaaaagaaatttagaaaaccatactatttacaatagcatcaaaaataataaaatacttcggaatagatttaacaaaagaagtgaaacatttgtacactgagaactgtgtaagtcattgatgaaaggaattaaaacacaa

SEQ ID NO: 88066 - DNA, 549 bp, Oryza sativa
acgcttacgtacgccaagtacggcgtatggaacgccattttgacgggatagagcttcggcatgtgcccagacgggataacatgattgccgacgaactctcacggctcgagtcttcgcgagcccagaccccaccgggcgcctttgaagaaaggcttacccagccgtcggcgcgacctaaccccttaggggagacgggtgtgcctgaccggcccccgaggcccgtcggagtccaggcctcgggacccgaagggagcgctccaagctcccttagattgattgcttgcatctccgagatccaagcatacctcacagataagactctacctgaggaccgcgaagggagtgaacgcgtccaacgcatttccaaacgctacgtgctggtagaagggaccctctatcggcgcgcggctaacggaatcctcctgaagtgcattcctcaggaacaaggcgttgagcttcttgccgatatccatgaaggcgagtgcggagcccattccgcctcgcgcaccttggttggcaaggcttttcgtcaaggattctattggccga

SEQ ID NO: 88067 - DNA, 722 bp, Oryza sativa
tggtgtgccgataaagacacccgtatcagcaacagttttagaggaggcattgaatggatcggttatggtttctcagctccagcttggaaactctgttcacaggaaggtaggtaatggcaactagctgtccatcatccaatgcttcttttcttgatgttagcaactaaataattgaaagctgcatgtggccaggtggaaaagcaatcagctcatttttattctgttgacataacagaaaaggaagctaaaatggggttagtttgtcgtgtgaaatcaactgatagaagcaaatttaaggttggtttttgttagcaaatgttttatcatgtaacctgtgtttcgtaagtacatttcatgcggttctggtgttgtcagttctgttttaatttattttgatctagacttgttcaagttgtgtacatttatcctgcgtagtgaagctatccttgtttgacaatgagaaaatttgcccttcagttggtgaaatttagatgatttactttgacatatagtactccctctgtttcatattataagtcgtttgactttttttctaatcaagtttgaccaagtttatagaaaaatatattagtatattcaacacaaaataaacatattatcaaaatatattcaatgttagattttgtgaaactagtttggtattttgaatgttgctaattttttctatgaacttagtcaaacttgactaggaaaaaagtcaa

SEQ ID NO: 88068 - DNA, 691 bp, Oryza sativa
atgatgctacagcaagtatgtcactttctgacaatttttctgtggaagtatcagcttgcgatttatttgcagtaagtggtagttttttggcactttcacttatttgtgatgaattctctgtggtagcaccattgttctttttatcttgaatgatctgtgatttgttatcagcagtcacattggttttctctgcttcttcagcaagtacacggttttgtaacggtttgttgctagatatatccttctctggctctttttctctagacacgcttctttgccatggctttttcacaaccacgctgctttggagcgggttggtgctagccacactaacttgtgatggtgtcacaaccgacgcaccgctttgcgattgcttttcagttggaacattgcgctgccacaatcttttgcccattcccctgctttcaggtgtctttgcatcagttacactgctctggggctgtttctggaatccgatgttacgttgccattgctttttaaccactgctgcagtgctctctgatggctttacatcatctgcactggtctgtgaaggtttctccgtgattccactgtgttcctgtggcacagtgggtgttgtactggtttctgccagcttcacatcgatagcactgctagatgacttctcagtgtctgtattgttctgcagtggcttctccgtgtctatatt

SEQ ID NO: 88069 - DNA, 512 bp, Oryza sativa
caacatgtacttcgtcaacctccggcgaggcctcggcctcctcgccaccgaccaggagctctacggcgacgcgcggacgcggccgcacgtggagcggtacgccgccaacgagacggcgttcttcgccgacttcgcgcgcgccgcccggaggctcagccaccacggcgtcaagaacggcgccaacggcgaggtgcgccgccggtgcgacgcctacaacggcggcccgcgcggctgatcgcggcgcgcacggtggcggcggcggcggcggcggtgcctcgaagcattgatagtctaatcttagattagtgcaggaagataacacggagaattcaaattagtaggtataaaaagaaaatatcttgctgttcagagaggaaaaaaaaggggaaataatcaactttcacaagtgaaatcatttcgtagtcatatactttaggctgtgttctaacgattatcaaggcacgaacaaataaattaaatactactccctctgtttcacaatgtaaaacttt

SEQ ID NO: 88070 - DNA, 632 bp, Oryza sativa
attgctcaaaaaattttagaatacaatataataagtaagcacaatacatatattacaatttgcaaagtccgtagcccctatacatatactagacgccttctcttgcattcctcgtcgaagccgctggcatgatcggcttgctgagcggcacacgcaagcagaggcctcttcggcgccgccaccgccgcgtccatctgttccatggcgtcgtcggcgaggacctgctcggccagctgcgccacggcgccggctccggcgttggcggccgccacggttctcttgacgcggagcatctcccggaacgtgcactcgtcgccgtgacgcacctcgaagtcgttccaccgcctccagaagtcggggtgagccgtcgggtcggtgaagccggaggcgtagacgtacagcgcccgtgcacggtgggcttcgccgaggccaatctcgaggtcggcgaactggaggcagagcaccctggcgtccgcgtccgggaggccgccgccgtggaggatggcctggtggtatatctccctcgccttgagtacgccgaacagcgcggtggcccgtgcgacgtacgcctcgtagacggcgagcttgtcgccgccggggacggcggccgcggcctcctcgtacaccttcag

SEQ ID NO: 88071 - DNA, 638 bp, Oryza sativa
cgaattcgagctcggtacccaaatgggcttaactcgggttattttatcgcgtgaactgtctttagaggaaattgctgaaattcgtcaacaagtgccagaaatggaattagaaattttcatacacggtgctttatgtatggcatattcaggccgcagtttactttctggttatattaataaacgcgatccaaatcaagggacttgtaccaacgcttgccgttgggaatataaaattgaagaaggtaaaaccgatgaagcgggcaatattgttccaaaaaataccgtacaacaatatacacctgaaattcaagttaaaaacattgcgccaaccttaggcgaaggtgctcatacagataaagtgtttttatataccgaacctaatcgaccagacgaacagatgaccgcctttgaagatgaacatggcacttattttatgaattcaaaagatttacgtgctgtgcaacacgttgaaaaattaacgcaaatgggcgtacattcattgaaaattgaaaggcgcacaaaatcattttattactgcgcacgtacagcacaagtttatcgcaaagcaattgatgatgcggctatgggcaagccattccacccatcattgatggataccttagaatcacttgctcacc

SEQ ID NO: 88072 - DNA, 550 bp, Oryza sativa
cgttgtgctgtgaattatgaattgatcgctctctcactctgcatctcactgaaacaaacagagtacagggatgcatgcaaatcctaatcaaatcaccagtgttactactagacctcatcacacacacacacaatgttcgtcgcacacgtggagcaaagcaaagcggcggctgacatggcgtgcgatgcaacgcgccacgtgtcactcgctcacgccttgtggtcggcggggacgtgccacacccagaactcctcgttccggcaagcagcggcgacggcgggcttcctcgggctgcccttgggcgacgtccggaggcggctgcggcggcggtgctgctcgtccttccgcgtccgccggtgccgccgccgggccttgtcgtcctcgtcgtcgtcggccgcggcggcggcgtcggcctcctgatccggcgcgacgaacagcacgacggggccgagggggacgtcgtcggtggcgacgagcagcggcttgagcgcgtcgacgacggcggacatgttggggcggttcttggggctccccctgaggcaccggtagg

SEQ ID NO: 88073 - DNA, 696 bp, Oryza sativa
ccctcccgtcccaggtattcgggagagacggatccgaaagattctgtccatctacgaatccgtaattgcagttgctcacggcgatgagaataccaaggcgaaggtaatccacctcgtgctcgacggcataggggaatcgacaagggagtacatgcgccgattctcgcaagcacggtgccaagtacaagacataaccaaagcatccatcgtcaacgcaggttcggccggcttgcttgagggtgaactcacaaggaagatcggacgcaaggagccaaggacgatcgaacacctctttcgcataattgatggatatgctcgaggtgaggaagacaccaagcgaaggcaagagatacaagctgaatatgacaaggcggctgcagccgcaacagccaccgtgcaagctaacgctcaaactcaggttcaagcccaagttgtcagttcggcgcccgttctggttcaccctacccctccggcgaacccagcgcagcattcaaggccaaaccaagccccgatgacatggaaaaaattcaggaccgatcgaggtggcaaggccgtgatggtagtcgaaaaagtgcacgtcctctgcaaggagttcgacgcccagcaagcgggcggacatcagcaaccttttcgcaaaatgatcaagaaagacctgtactgcgcctttcacggatgctcttcacacacaacagaaca

SEQ ID NO: 88074 - DNA, 3839 bp, Oryza sativa
atctgggctgaactgaaccgagcgaaaccggtgctgaaggtcgcactgatccgaagctaggggcgctcgaaggcaaacgaggtcctgcgaggatggaacatcaagttacgacggggtgatgttttcgtacaaaaacagaaacaaaacttaagaaacctctgggctgagcaggaccgggcgaaataggtgccgtaggtcgaggacctgctccgacggtaggcgcgcgaggccgtggttgtaccggaccagctggaggtaccacgtccacggcgctgcggacaggagaagacgcgcatgaccgcacgcatcttctcctgcatccgggcgaaggtcaaccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaattggacgtaccgccacgaagtagtctcggtcacggtgcgtgggatacgcgtccgtgacagcggcaacgtgcggctctggggcgtctggagtgaaaggtcacacgcgcacgagtgcgaggaaggtaccagcgaaggtagtcacagtagttttcctccgtgtgtgggaagagctcgttgatcacctcttctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggatgtgagcgtaacgacgctgcaataaacatgatcggaattagacatgttatgtgaagaaaaaaaaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacgaccacaacaggtacgcctcaagggagcgtcggaccgagtaatcatcagcgtcagggtgcagaaggtccgcctacaattaagaatgaaatgttagtacaaaacactcatccggtcgcaaataagcacgtatgataataacaacttatttacttacagtgaactagagcaaccaagccttgctaggcccgactgtagagtacggaggaagggtgttggtcggtcctaggtgtggagggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcagggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcatgctgcgcgacgacgccttggccttgcgcgcctgcttgttgttccttcaccaggtggtcgcctaccatcacttgcctgtccagatggactagcatctgcgccgcttggaacttatgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactcgatgtctccgtgcctttttgattttatcttccatgtactttgtcactacgttgccaaacactatgttgttatcggccatggacggactaattttcttgtatcgatccctaaagtacgcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggatcgtcaccttcaactagtggtatgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaaaattaggccacttagctggaagtccctt

SEQ ID NO: 88075 - DNA, 1122 bp, Oryza sativa
aaaagtttcatcatgcagtatttcaaaaatatgttccagtccaatggatgtcagcacccggagcgcctcttaagcaaagtgaagaagaaagtaacagaagagatgaatgaatgcttaatggctcagtttattgtcgaagaaataaaggcatcaatagattcaattggagacctgaaggcgccaggaccagatggaatgccgcctgtattttacaagaatttctggcatgtggttggaggaaaggtgacctcaaaagttcttgatattttgaatggaggtcagatgccattaggttggaacgagacgacaatagttttaataccaaaggtgaagcagccggagcaaatcaaggatctccgcccaataagcctccgtaatgtcttgtacaaaattgtttcaaaagtgctcgcaaatagagttaaaaaagttttgcctgatgtaatctctcaatcacagagtgcttttgttccggggcacctaatctcggataatattttgattgcttatgagcagactcattgtttacggcacaaaagaactggtaatgttggttttgctgctttgaaactagatatgagtaaggcctatgacagagtggagtgggagttcctgtcagaaatgatgattaaacttggttttaaccaggtttggacgcagttaatcatgaagtgcattacgtcagtatcttataaaatccgagtgaatggagagttgacagaggagttcctgcctgggaggggtctgcaccaaggagaccccctctcgccgtatctatttctgctttgcgctgagggtttttcagctctgttgagtcaggcggaagaagaaggattaattcaaggggtgcgaaaatgccagggtgcaccaagtgtatcacacttgctatttgccaacgactctcttattttatgtcgtgcagatagaggtgatgcacagcagttacaaagtattttataggtgtacaaggagtgctctggctagatgattaataaagataagtccgcctgtgatgtttagtcagaacacatcgagagtaaagaaagaggagttcatgagggaattaaatctgtaaagggagacagtgaatgataggtatctgggactgcccgtttatatcggaat

SEQ ID NO: 88076 - DNA, 903 bp, Oryza sativa
cggctcggtctcggctgtggccggccggaggttaaagaaaggcccgacatgtgggccccacatgtcggcggctgagaggaggaaggggcggcggctcggcttgggccgcacggctgcgcaaaaaggggggggaaaagggttgggctgggaacaacccaacggcttagaagagggtttttttttactttctcaattaaaataattcgtgaaatgatgtttcatttattaaaaatactttccttgctcaaataattcccagaaaaatctagaaaatagataaataagcaaagtatttaatgaaattttatctagctcaattttatgttgaaatttttcctagattattagagtttaacttgtaagcttttaaaatagtttctaaaaatgcattaaagaatgaattactaaattaggcaattttcagggcgtgacagagcaatagttcgcttcttgctgctgggctaaccagagctggtgggctttgcagatactgctttagctcctcgaaggctgcttggcactcaggcgtccatttgaatttgccccccgaagggtcttgaagaaaggtaatcctctttcggctgcctttgataggaatcagctgagtgctgcaattcgccccgtgagcttttgtacttgtcgtacgctcgatggtggcttcatttgctgaatggcattgattttttcagggttagcttcaattcccctttcagacacaaggaaccccaataacttacccgtgcgaacaccgaacacacacttctccagtttaacttcatgccggctgcgtgaagattgtcgaaagtctcttgcagatctgacgcatggtcgaatgccttgcgtcttttcacaacaatgtcatcgacataggcttcaacatttcgccccaattgcgatcccaag

SEQ ID NO: 88077 - DNA, 569 bp, Oryza sativa
cgcctggaaataatggcgcagtttcctcgaagccatcagaatagcgtaaagcatcttctgggcctgagggtatcgggtcttggcgtcctggagggcctcactaacaaagtagacgggccgctgcacctttcggtggggccgatcctcttcgctaggggccacatccctggggcgctctttgtccaagcggccttgcggggtgcactcgtcttctgtgccgacgacctcggggtcggaggacggcaggggcggccttcccacagtggcctcggggccgtcctgggggtcgggggctcctggcgtcgttggacaagcgggcaaagggccaactccggccgtcaggggccttaggccaccgttcggctcgggggcctcttctccctgctgtctcccgggtcgagtcggcacagggttagcctcggggtcagagggcgataggtgcggccttcccgcagtggccctcgggccatcctgggggtcgggggcacctggcaccgtctgacaagcgggcagagggcctgctccggtcgtcgggggcctctcctccctgctctctcccgggccaaacc

SEQ ID NO: 88078 - DNA, 3960 bp, Oryza sativa
ctcttgaccgggacctccacggtgagcacacgcccccacctccccttgtttactattggtcgccgattaccccctcttctcctccttagcaccgccgtgccaagaagccgccgccgcgccgccgtgccgagaagccgtgcgccgtgcgccggccgggactcgtcgtcgccgtgcgccgcctcctctgctcgtcatctcctctccaggtacccctctctctctctctgatgccgatgaatggaatggtgcagtggatggatgaatgaatgatgcaatgcaatggatgaatgaatgatgaactttggatgaacgatgaattttggggacaattgtgctctttctgaattgaaaatgcatatgtataattgtgccattttgaaacttgaatgtggatttaagtgccattttgacatgttaccattcatggagtgtatactgctttatatgttgttttgttcccttttgctagaactattgaattttggggataatgtttacatttagctgaaaaaggatggattgatagattggcaacagtgtggttagctagctagaaatagtttgtctagctagctagttaggggttatgttcgcttttcatttttttccctgtgctttccctgtgccccttattcatttttttctgcatagattatctacacttgttctttttttaatgcataagatcaaattatctacacttgttctttttttctgcataagaacagatttcctcctagcagctgatttcctctttttttcccttcatgcaaatgatggtaattgatgcataatttctgagcaaaactgaggccatatctttcatagtataccccttattacattggatctaatgctatttagtataatggtaggaaatttataagctttttcgtaaaaattagaccatgacaacgcccggcgcaaacccgccctccccaacacctgcgaggatccaggaagaagcaaacccagccacggagacagttgccgaaggtcatccctcgacaacagcggtcgaacaacccgaaattcatggtaatttataggacaaattttcaccacatgaccacataaattttagctagcaccctttaccaaatgttgccttctgtttgtgctgcagaattgccgtaggaacaacatacgtcgatgtcgggcgggacaagtgcaagtaggtcgagtagaaatccccggtcacaaaatatatggccgaccacagtgcaagttataagagaggttgacgctagtggtaggcccacggcgcccaggactgtcattggaagatggtctaactgctgcgggctggcggcacgtgagaacttcgggatcctctataaagatatcggtaaggtcacagaagccgagaaagaacgagcttggacggcaatggagaaatggttcacatttccggctgaagcaaaggataggctcaagcggaaggcattccataagatgtgcaaagcttggaagaattggaagtcgaagctcttcaccaagtttgtcaacccgcccagcaatcatacgccgttcgatgaataccctcaaataaccgaagcggtgtgggaggaattctgctctctcaagaacacccaagagtttagggaatcaagcgaggcacatcgcctactgcaacagcggaatgagcacccgcatcggctgggcaccgcagggtacatcggcaaggaggcaatatgggcccaagaagatgcagccgcagcagcaacgaatgtccctcccccgttttcagacatccctgaacaaagagctcgcaactgggcgcgggcaaggggtaaggtcaacccggacggctctgtcacatttgagaacaaaattgatgccgtcgtctatcaggaactggtgagttcactacttaacctaactaatttctgttcgtataaagtacaagttcgtataaacgacttttttttttcctagttgggcttggttgctgaacaagcttcacaaagcgaggttgagtccgcgccgaagaggcgcgaatatgacatcctcagaaaggcgctcggaaccaaagaacatcctgaccggactcggggaattggtagcgatgtgccctggaagcatggactcccgcagtacagctcccaatacaggaaacggaaagtctccaaggaagagagggacgttcgtttgaaggccgaacttaaggttgaggtcattcaagaactagaagctagcatgaatgctagggtggaagaaagggttaacaaggtcctcgccgacatgaatataccctgaggcacaacacctgttgtgcatccaactcctcgtgcacaacacgacgcgagtccgtcacagcataggagtagttgtgcatccacagaggtgccagcccctggtctcccggtcgcaccactagctgcagtggaccacatcgaggtaattgatgttatccgatccatatctaataaaaaacctttacacgttccaatattaaattcaaactttcacatatgcagggcgcagcacagtgtgtcctactggcgagagtccacccaactttcgctcctgaagtcgctgagggcatggctttcaagcccttggttacagacaaggtccacggcacagacctgctagctgggtatgccaaggtgtccatcgattcagtaaaggacacctggttaggctatccgctggccgtgccccccaatgatgaaatcatgactttgggcgatgcgcgcaagacgttcatacaatggcccaaagaagacatagttgtgagtccaagtcgaccgacggagcttacacctcccaagtctaagctatcaattgaggctccccgtggaccggcattgtcagtacctcattctcctggtggagctgatatggacttggcagatatagctcaaagcttggctccaataaagaccacaagaaagaccaatagctccccaccacttgtcaagggccagaagcgtgaacgcggcaaggggaaggtcggggagttggcgccggagccaaaaaggggcaaggctgtgacgtcgatgccggtgagcaaagcggggaaggtcgtgagggcgccggcccaatttgagctaggcatgccattggtggaggacaatgtgttagccgtgatgggtattgcttgccgagagctacataagcaatacatggagctaagcaatgccaagcggaaaatgagggagtcatccatagttggacatcatgaccaccagccattcctatcgtcgcctgcctatataactataggatttgatgacctcttcgaccttttcaggatccggaagttggacactggtcttctaaaatgctactccttgtaagtgcataccttctatacttgtgatatgattggactatatctcctaattaaattagttctaatacgtaaatgttttaaggttgtgttggatcgagagtcgtcgccttggtaatcaggttgggttctttgatccatccatggtgaacgaggttaatttacgacagagcttcactgaggtggttgactatgtcaaccggtgtttatgggcccatcaagacaaggagtacatcatgtgcgcacacaaccaagagtaagaggacaatatccttcgtgtatattatttttgaagttaaggttcttagtactaacgctacataaccactgcgcaggcgacattggattctcttagtcatcatacctaagtggagtagggttacctaccttaactccaataatttcaaagattatgatttcagtgaaatcaccaaggccttaaatatggcttggggcccatatgtggaaaagggtggtaggcacaaggagggcaaggacgaactttatcatgacccaagtttgcatgcgcacaacagatcggagaccaatgtggtttccacgtgtgccacaacatgtcaacatttctaagacaggtgaaagatttcgaccctgaggttgttgctaatggcgaataagctcatttcaatacaaacattggtatt

SEQ ID NO: 88079 - DNA, 3730 bp, Oryza sativa
atttttgctaaaaatcaaggtaaaaaacacattattctccattccttctcaatatatcgatcatcatatatttttcttcgtatgttgttaatttcaagtggatcgtagatggatatactatgcgcatcgttcgtctaccgagtatagagagggggtcactgaatttgtcacatttgcggataatgacagaaaaagtaggatgagcatgcacatgttgtgtccatgtagggactgtaagaatgaacagatgatcgttgatagcgataaagtgcatgctcatttgataatgaatggatttatgaagaaatatacctgctgcaccaagcatggagagcaagaggcgcctgatgtcgcagctgaagatttgttggatcaggatgcagagaacaccgccgcagctcgagaaggcatgttcgtaccttctcctttaggtggagagaccatatatttggacactcaatgtctatctacaatgttgcatgacattgaagatgtaaaggacaacgacagagattttgagaagtttagtaagttggtggaagattgtcagatgcccttgtatgatggatacaagtcgaagcacagcaagttgtcatgcgtgttggaactcatgaagcttaaggctagtaatggctggtcggacaagagttttacaaaacttcttgagctgttaaaggacctgttgccagaggggaacaatttaccgcagacaacatatgaagcgaagcaagtattatgtccgttgggcctgaaggtcagaagaattcatgcatgtccgaatgactgcattttgtactacaaggaatacgctgacttggatgtctgccctgtctgtggggcatcaagatacaaacgagcaaagagtgaaggtgaaggaagtaagtcaaagaggggaggcccagcaaaggtggtgtggtatctcccaattgcggagcgcatgaagagaatgtttgcgaatatggaacaagctaagctagtgcgctggcatgccgaagaacggaaagtcgatagtatgctgaggcacccagcagattcagtacagtggaggacaatcgataggatttaccaggaattctcaaatgacccaagaaacatgcgtttcgcaatgtgtacggacggcattaatccatttggtgatttgagcagtcgtcacggtacatggccagttctgcttgttaactataaccttcctccctggttatgttcaaaagaaagtatattattcttgccatgctcatgcaaggaccgagacaacctgccaacgatatcgatgtgttccttgaaccgataatcgatgacttcgaaaggctatggaatgagggcacacgaacatgggacgcatatgcacaagagtatttcaacctccatgtgatgctgttttgtaccatcaatgattatccggcccttggaaactttctggccaaactgtgaaagggaaatgggcgtgttcggagtgtatggaggaaacaagatgcaaatggttgaagcattcacacaagacggtctacatgggtcacaggagatttctcccaaggtatcacccgtataggaatatgagaaagaatttcaatggacacagagatatagccggacccccggcagagctaacagggacagaggtgcacaatttagtgatgggaataactaacgagtttggaaaaaagaggaaagttggaaagacaaaagagaagagcacatcaaaggaaaaaacagaggagcatgtggaaaaacaaaagacaaaagagaggagcatgtggaaaaagaagtcaatattttggagactaccatactggaaggatcttgaagttcgccactacatagatttgatgcatgtcgagaagaatgtatgcgagagtttaatgggattactgcttaacccaggtactacaaaggatggtctcaacgcctgacgagatctggaagaaatgggtgttcgctcggaagtacatcccataaccacggaatccggcagggtttaccttcctccagcctgctacactctctcgaaagaagagaagattgatttactaacatgtttgagtggtataaaggttccatctggttactcatcaagaatcagtaggctcgtttcactgcaagatcttaagttggtaggaatgaagtcgcatgattgcgacgttcttatcacacagctgttgcccgttgaaataaggaatattttgcctcctaaggtgcgacacacgatccagcggttgtgttccttcttccatgcaatcggccagaagatcattgatcccgagggactagatgaactacaggcagaacttgtgagaaccctatgtcatcttgagatgtactttcctccaactttctttgacataatggaacatcttcccgtgcaccttgtgaggcaaacgaagtgctgtggtccagcattcatgacacagatgtatccttgcgaaaggtacctggggatccttaagggttatgtatggaaccgttcacaccccgaggggagtatcatcgagagttacaccaccgaagaggtcatcgatttttgtgtggactacatgtcagaaacatcttcaattggattaccacgatctcatcacgaagggaggcttgatggtgttggtactgttggaagaaagactattaggttggatcggaaggtgtacgataaagctcatttcacggtactgcagcatatgactgaggtggtgccgtacgttgacgaacgccttgcagttctccgacaagagaacccaggccgatcagagagttgggtcagaaataagcacatgtcttctttcaacgagtggctgaagaaccgaattgccaggttgcagaacttgtctagtgaaacacttcagtggttgtcacagggtcctaaatggagtgccaccacctggcaaggatatgacataaatggatacacctttcacacggtaaagcaagacagcaaatgcaccatgcagaacagtgggttacgcatcgaggctgctagtgacggtggtcgtcgtgatcaatactatggtagagttgagcaaatattggagctagattacttgaagttcaaagtcccgttgtttcgttgtcgatgggtcgatcttcgcaatgtaaaagttgacaatgaaggtttcaccactgtcaacttggctaacaacgcgtacaaggatgaaccgttcgttctcgctaaacaagttgttcaagtgttctacatagttgacccgtgtaacaagaaactacatgttgttcgcgaagagaaaaggagaattgttggattggacaatattgcagacgaggatgattacaaccagcacgtccacggtataggtcaagaaatacctctagaagaggaggaagaagaagatgaagttcaatatgcacgcgtcgaccatgaggaaggattatttttgtaatttatgtacgtagtttatgtctacatgtctgttatctatatgactctgatatgttcgcaatgatcaatagtatattccttatgaaatagtcaaataaaataattaagtgaagcacccactagaagtgaaataaaataattaagcaagtataaccattggaaataaaataataaaattagtaaaataatgtagtgcaattactactgttagtgaaataaaataattaagtataacaaaatatgtagtgtatgtggaaatatgttaaagaaaataaaagaactaagtgaaataaaataaaataaaattgttgtaggcaaactcatctgtgacgggctctaactgtgggg

SEQ ID NO: 88080 - DNA, 3007 bp, Oryza sativa
  unsure (1)..(3007): unsure at all n locations
accaagggcttacgtgcgcatctctaagaggtaacacgctagctccggctggagacgtgtgcctagaggctctcgtcttgacgggacggggcgaggcgtgcgtcagaccgccagtcgccacctaaccgttgatccgaccggtctgtgactggtcacagaccggataaaagagcgcgctgcattgcgctgcatgcagcgtgacacgcttgaccagaccgcaataaatgcggttaggtgagccctaccgtgttcacccaacctatgtacatagtgcaaaccccacagggggtcggggcacctcgtccctcggggccggggcaggagcaacccgacccccccttggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgttatgtcagggcgatcatccttctcaagggaagcggtcgggcatgacgccactcataaagcctggtgacaggtgggaccggtctccgtgattgggcagaaacccaacggtctcaaaccacgcatatcggtaacggtgtcttggccgtcagtcatgggcggtctcttcaagactgccacatcacttgagcagcgctcgaatctgggcgtgcagattcgtttcgtctggagacatggtaacgtcgcttcggtcggcgagcgtaattaacgcgcacacgatacgatctatctcgactgccacaaccgcatatccacctcatgcgccgcaagcgggcgaatggaattagtggaagcgtgggcgcgagaaacgagggagcgagatagcgagtaacgagggggcgagatagtgggcacgagaaacgaggagccggactcagcgatggcaagggtataaagccatcgaggaaaggacttgctcccttcctttcgccactattcccctttccttcgccgtttgcgccctaaactctctctttgctgcgcctcaccttcgccacacacgctcgttctcaaccctctctttctccgacgacatggcacggggctccgctctgctcgacggtagcgtactaccaccttcccgcattgtgagcgagaggcaggctgggctgccgcgccgcttcatgccggaatctgccaccggccgggagatagtgatgctgggcgaggcgcgcccagcaccagattacccggggcggtccatcttcttcctccccttcgcaatggccgggttggttcctcctttttcttctttctttatggatgttctggagttctacgatctccagatggcgcacctcacccccaacgcagtgatgactttggccatcttcgcgcacctgtgcgagatgttcattggggtgcgcccatctcttcggctgttccggtggttcttcaccgtgcagtcggtgtcgccgccgtcggtggtcggtggttgctacttccagccgcgggggccggtgttgaaccgctacatcccctgcgccctccgcaagaagtgggacgattggaagagcgactggttctacaccccccttgccaacgaagcgcgcctccgactcccaagccagcccccggctccggtctccagctggcgggcgccagtagatctgggggatgactatgacgccgtcctcgaccgcctggcgggcctgcgatctcaggggctcacaggggccatggtgtacggcgactacctccgtcgccggattgcgccgcttcagcggcgcgcccggagcgcatgggagtacaccgggtccgaggactacatgaggacccaccggggagtcagatgggattgggctcccgatgacttcaagatcgtggtccaaagggtgctgaatctcagctccgtggaggcgtctcttattcctcaaggactcctccccctctgctgcgatccagaccgcgcctccattctgaccatcatgatgggggtcggggcctcagaggaggtggctcctaagggccacgacggcgccggcgggagccaccaggaagaatcaaccccaggagggggccgtgcttctgggccccgcgtcgggggctcggggagcaaccgccctaccgacgcccgggggaagagcaaactgggaggaacacctcccccatctcctccccgagggggcggggcggtgcgtgccagcagcaggcgcccggagggggccgcgccaacctcgcagcccgagggggagcgcaagaagaagcggctgcgcaagatgggggagacagaaccatcccggggaaacctaatttcccctccaaggtggtcatttaaccgaccccctcgcaggttcgtcccatgctcattgcgaccgtcttttcttctattccaaaagcaagtttcttcttacccatcctgtttgccttctggtttttctttctgcttcagtgatgtcccgtcgcgttcctcccgccatcccaagtccggccaatccgaagccgaagatccggcggccgcagaggaacggaggcgagaatctgaccggcgagaggccgcnnnnnnnnnnnnnnnnnnnnaaaaagccgccccggaaaccgcccgggctcgccaggctgaggataccgctcgggaagaagccgcccgggcccaccaagccgaggaagccgctcgggaggaggccgcccgggcccgccaagccgaggaagccgctcgggaggaggccgcccgagtccgccaagccgaggaaaccgctcgggaggaggccgcccgagcccgccaaactgaggcgatggcgtctttcgaggcagcccacgacaaagctgctggcgcgtcgcttgggcctactccctcgggcgacgctcaggcgacagcctccgggacggctcgcgacgagcccgcgggcggatcgcctgggcccgctccctcgggcgacgcccaggaccaaacgggtccgggggacatccccaagctcagtgcgtcttctggcgggccgagccgcgtcgcattttttccaaggcggttctt

SEQ ID NO: 88081 - DNA, 5597 bp, Oryza sativa
  unsure (1)..(5597): unsure at all n locations
ccatgaggcgagagcttctcgccgcggcccctactcatgaggcgacgcgtcgggcgcggtggtcggaggtggccctcacctttgaccagaccgaccacccaccgtgcgttgcccggggagggcagattgcgatggtggtttctcccaccatctgcaatgtgaagttggggcgtgtcctcatagatggaggagcggctctcaacatcctttcccccgcggcctttgatgctatcaaggccccggggatggtgctccagccgtctcaaccgatcatcggtgtgacgccggggcacacatggccgttaggtcacatcgacctaccggtcacctttggtggatcagccaacttccgcacggagcgggtgaacttcgatgtggcggacctcagtctgccctacaacgcggtcctggggaggcccgcgttggtgaagtttatggcggcggtccactacgcctacctccagatgaagatgccgggccccggtggccccatctctgtccgtggcgaccttaaagtcgcgctcgcttgcatggagcagtgcgcggaccacctcgctgctgcgaccaagcccgagggtggtgacgagaggcttggcacctctgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgaggcttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggagaaaactgcgttcattacccccgtaggaacctattgttttacatcaatgcccttcgggttaaagaatgcaggtcctacttttcaacgtactactcgaatttctttgggtagccaaataggacgtaatgttgaggcttatgtcgatgacttggttgtaaaaacgcgcaaccaagaaactttactttcagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgcacggggccgtttacttggacggaggaagctgaacatgccctcactcagttaaaggcatatctcagctctcccccggttctagtcgccccggagccaaatgagcccctgctactttacttagcggcgaccccccaagtagttagtgcagcattggttgtggagcgcgatgaagacaatcctcatttcgtgcacccccattctgtgctaacttggcccgggagcgagcggggaggagaggcccccgagtcggacggtggcctacggcccctgacgaccggagccggccctctgcccgcttgtcagacggtgctaggtgcccccgaccctcaggagggccccaaggccactgcgggaaggccgcacttaacgccctttgaccccgaggctaaccctgtgctgactcgacccgggaaagagcagggagaagaggccccccgagccgaacggaggccagaggcccctgacgaccggagttggccctttgcccgcttgtccgacgatgccaggagccccccgacccccaagacggccccgaggccactgagggaaggcccgccctttcatcctccgaccccaaggtcatcggcacaaaaaacaagtgcgccccgaaaggccacttgaacgaagaacgccccggngatacggcccctagcagagaggatcggccccaccgaagggtgcagcggcctgtctactttgntagtgaggccctccgggacgctaagacccgataccctcaggcccagaagatgctttacgctattctgatggcctcgaaggaaactgcgccattattttcaggcacatagggtcactgtggttacgtcttaccccctcggtcaaatcttgcatgatcgagagggtacagggcgggtggtaaaatgggcaatcgagctttctgaattcgatctgcactttgaaccacgccacgctatcaagagccaggccctcgccgattttgtggcagagtggaccccggctccagagaccgtctcaatccccgaggccagcacgaacccctcgcagttgcctcacaccacccactgggtaatgcagttcgatggttctctgtccctccagggtgccggtgcgggggtcacgttgacctccccgaccggagacgtccttagatatctggtccgcctcgactttcgagcgaccaataatatggcagagtacgagggactccttgccggactcagggtggcagccggactggggatccgccgtctcctagtgttaggcgattcccagctggtcgttaaccaggtctgtaaggagtaccggtgctctgacccgcaaatggacgcctatgtacgccaagtgcggcgtatggagcgccattttgacgggatagagcttcggcatgtgcccagacgggataacatgatagccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaaacataccttacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcaggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagagcgaaggcggcgcgcggcccttcgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtctgtatcgagtgatcggcgtcccccggccaggctccgtacggctggccacgggcgacggcactgagctgccaaacccgtggaacatcgaacaccttcgtcgcttctacccctgaggggggggggggtcgggtgtcaggtttcgggctcgggctaaccccgcacccccctcgggtgtgcagggttagccgggggctaccacacatgcacagccttacttttcttatttcagcatttcaataaaagcagtttcaatttcctaaaggttgtgtctgtgccgtttttccttctgaagaatcttaacttgaaataaggtcactcgtgctcaaccttgccctcgggggctcggttcggtcagctaaaatcgccaagcggggcccagaaccgaaccgtgccccggggggtggtgaactccgggggggaatcggcaaaaacccacaattgggtcacccataaccctcggtccccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcatagaaaaataaagttaacatagaaatttttcatcatttttgattgcagattaagttgatctatacaaaaagaagaaagaaaaagaaaaaattggagattggcgggggcctgggggctcattccaatgcgcccgggtcgccggcctcgtcgccaccgtcgtccttaccgctggcgtcgccctcctcgtcggagctgggggcgaacgcgagccgaggggccgacccctcgaagctttggacgatgtggttggcggcatcccggacccgcgcacgcgcatcgtcctcggtcccgggagggaactcctccagcgccatccatggggagaagccggggtccctggcctggtaactcgctaacacgagttccaccgctccttgggcgaggtccctcgaggatgacttgatggtcttctcgagctcctcggggagttgttggacagcccaggccatcctcctaaggtgcggggcaaggccttccagattggtggagcgcgaaattgtctggcctttccagaggcccgcttcccgaccggcgcgatccagccgggagactgcatcccaaagcatgccgggccctatctcacccgacaagcggagggcctcggcttccccggtggatgagtccagggcgcgctgcatgt

SEQ ID NO: 88082 - DNA, 511 bp, Oryza sativa
cgcgcctgctcctcctgcgctgcctcgcggagggacaggctgtccgccagccgttgtgtcgcggcctcggactcctcaagagctcgctcccgctcagcaagcgcgtcctcgcggagccggagcgcggactcctcttcggcgcaggcggcctcgtgcgccgccagcgtcgcctcacggatagcggcggcggcctcgcggtccgccaagctggtctccacggcgccggcatgatcttccagcgccatggcacgggcttcaagggcctcttcgcgccgccgggacgccgcttcagcctccgttgctcgctgctctcgggcagcggcggcgtcaaggaccccctgggcggcgtcgagctttttctttagctccgcctcccagctcccgtgttgaaggcggagggagtcctgcgcctcaatcatcgcggtggtggcgatgagggcggcctctcgctcctcctccacctctcgggcgatctccgccagcgccgccttgcgggcttcaagctccgaga

SEQ ID NO: 88083 - DNA, 626 bp, Oryza sativa
tttacggggtgcgcaagatcaaggagagatggtgatgcaggtgtttatcctggttcaggccctcgagaagaggtaataccctacgtccagtgtgtttttctctgtatttgggtggaaaaatgaactcagaagccaagagagaagaaggtagaagtctcggaaatcctccggcctagggaccccttccccctcttatataggatgaggggggagggttacaaggaaagtatctagttgattgcaactagatcctcctattccatctataaagatatgcatgatacccgagatttatatcttatcccggaaatctctctttctttatttacaagtatgccgcaggggcctagcacacttggcccaccccatgcgatgcggcccaaggtttgttgttgggtacctgggtatcgtgtaccccacagctgccacggcacacgcgatgggttgctgcttgtctgtgctgagagttctgtagttcggaaaaacacccccaggcagaaaaactgggccctgagtttgatgctcagctatcgtgccgtcaaaaaacccccccccatagatttgatcatgtaggtcaaaggtattgaccagcattcccgattggttgaccaaagcatgatgaacgg

SEQ ID NO: 88084 - DNA, 512 bp, Oryza sativa
tgctcccgggccaagtcggcacagagtgggggtgcgcgtaatgagaattgtcctcatcgcgctccacaaccaacgctgcactaactacttggggggtcgctgctaagtaaagtagcagggactcatttggctccggggcgactagaaccggaggagagctgaaatacgccttcaactcccgagggcattttcagcttccttcgtccaagtaaacggccccgagcgcttgaggagcttaaataagggtagcgccttctctcccagcctcgatataaaacgacttagggcggccatgcaaccagtgacgcactgcacatccctaagtttgctgggggggcgcatccgctctatagctcgtatcttctcggggttggcctcaatgcctcgggcagagaccaagaacccgagaagcttgcccgcaggcacaccaaacacgcacttatcggggttcagttttatgcgggcggagcggagattctcaaaagtttccgctagatctaaaagtaaagttt

SEQ ID NO: 88085 - DNA, 653 bp, Oryza sativa
actgcagaaatgtacacctcagatgttagtgttatggcatggagcataacttggaaaggtaagtgttcatataactacatttttttataggaactctcatataatatcatgagcattgccactatctgaaaacgaggcgacagtgtgaaattttgcttaccaggaggctcagcaaggcggaggtacaggttctcaccaaggctggccttcttctctgagtcgacaagctcccctgtccaaaccaagcatcttgacgggtcagccatggtgccgccactgctcaagttggcgtaagcatatgccttgcaagagcagttgctgctgcactcggccgcgcactggtcgaagctcctgttccggatctgcaagaacttgtcggggaccttcatgtcaggcaatgacacgaagcggtgaccgccctctccgcatctcagctcttcctttctccggcatcctgattgcgagatgctgggatctacaggctcgaacccatcgaggcaccggcacgccgggacggcccccgtgaagtcgcagtagccaaacgggccgcacgagccatagacctcgcagctgccggcggcggggcgctggaagatcaacatccatgacgacgagctgttgtcccagctcaggaacatcatcgtgcccgtgct

SEQ ID NO: 88086 - DNA, 818 bp, Oryza sativa
taggtattaaaaccaattatgatttttatcccaagttatatatatatttttttgaaggaaaggcaagtaatcgtagtctttactgctctcttttagcttacctagttttgagcacagtggtttcaattctccactctcttttttcttaatcgcctagtgcagaaacttccaactcaccaataattgagcgaaattgcttatggaagaatttccttttttttttttttgtaaaccattgaagatgaaccatacacccacaaagcaatcatattcctaggttcttgcacaattgatcaagtggtgaattctacagccagctatatctgaaatttaaacatctaacgtccttgtagtgtggtaagacttgtactgttcacagacttgttggcatcctctcttgccccttctgccatgcaattccttggcacaaaatatgcaggttgcttagaagtaggaagtgttgtggcttcattctcgaacatggccacaactgatgacatgagtggtctagcatttgggtcttcctgaacgcataacagtcctacatggatacagagcaaaaactcattaagcgaatagcactccagaataggggatccacaaatgtcgctgcctttccatctttccacaagctccatgcctgaacaaagagaggagatatcctaatcagtgctaaatcctagctgttgaaattttgttcatctcaatatttcatagaacttacacaggctataaggtttggaaaatccattataagatgagttgagctgatcttacaaccacttataagttccaagactaaaacaccaaagctatat

SEQ ID NO: 88087 - DNA, 835 bp, Oryza sativa
cttgtttggttattccttgacttgtaaggtgcccttactgcaaaatggcgagttacgcggttgagtaccgcggtgtcaagacgaaggaggaaaagggcactgagcagattgtgagtgtccgcaagacatgatttcgttcagtgttgtcttctatgttttgtatttttgccaatggttggagctggaacttgtggtgtggataggaggagcagagggtgatcgaggcgcagatccggatgcggcagcaggagctccaggacgatgctgagcggatgaagaagaagcaggctgctgctttgaccgatgtggtaacaactgcacaagtagaacattgtgatactggtggcgcatccaccacaggtatatgcactggaatgtgctaactttgtttctcagttattcttttgtcatgcaatctctaaccctgtctattatgttgacagtcaaaagcagtgggcaaggcagtgatatgctctcatctcaagtgcagcatgcggagttactgctgaagacttctgaacgcttaaagcagatgcggttcgtactgcttactgagttgtgcttgatattctgtaaaagtagctgcttattgttgcatcagtgcaatttagatcaaagtcatgacagtatctcaatgactgactaccgtttaagatctgaaatgtctatatctggtccctccaatcctcaaatagtttaagttttcgtccctcaactccaatattagccagaactcatcagtcaactatcaaaacgtctaaatatgttcttgggcatgttttccaagtggttttgagtgccgcgccatccttttttgccatgtcttttaccacat

SEQ ID NO: 88088 - DNA, 646 bp, Oryza sativa
gattttaaatttaagctcaaattctaaaaagtggtcggagatgtaatttatcttctgttatcttcttatctctactctttgaaaaccagtcatccttcttctctcaccctacaacgcgcgccaaaaaaaacctgtaaaaaccgatcggcccccctcccatcgtactgcaaggtttttttttttcttccaccaaagaattaaccgatcagaaaaagcaaatagagaaaactaaacctataatacaattattttgtcttattccttcatatatacttatatctcattgtaaagcacagccatagcgcaatggggaaggagtcgtttcgggtctcgttggttgccgatggaccctgacccgaactttagcatcaacggctaagatggaatactatactgttggaagtattttttagcacactggagctctcccattagtttgttgatcgctttattaattgtcttctgtgtttctcgcgaaaacttgttggtgatgtagcaaaacttgtgaagtaacagcaatagagtttgctggttccgaagataataaagatgaagtcgctccaccatgatgacaaagttgtgttgccgtgatgaagtgaaccggtagtgaagacgcgcagttgtgaagataaaagcaccagtcggc

SEQ ID NO: 88089 - DNA, 543 bp, Oryza sativa
aggcggggacaccagtcgccggcgacgaaggcaagccggtcggtgaagacgtagacgcccaacaacggcggcataataggccagccgtgcaggcggaaacaccagtcggcggcggcgaaggcaagccggtcggtgaagacgtagacgcccaacaacggcggcataaaggccagccgtgcaggcgaggacatcggtcggcggcgacgaaggcaagccggtcggtgaagacgtaggcgcccaacaacggcggcataataggccagccgtgcaggcgaggacaccagtcggcggcggcgaaggcaagccggtcggtgaagacgtagacgcccaacaacggcggcataataggccagccgtgtaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaa

SEQ ID NO: 88090 - DNA, 603 bp, Oryza sativa
gtcttcctcctccttccctatcttgtcaaggacatcaagatgacccctataaactggatcatatgacatctgcatccgcaccacctccagtatctgtcccaagtgtccaagttgcttctctgtcggtgccttcatcgtactcacatacccagataaaaactcaagcaccgagcccgaatcaacctcatcatcatcgccgctctctgcggccgcaaatacagctggcagcacctcttccagcatttccaatgccgcggctccatcagcatcactagagccaagcttgcgataacactcgagagcctcgacagcgtatgccgtcaccaaatgtgccattttcaaaccgctgtcagggctaccaaaccccttctgggcagacatgagcgacctcagcaacgccacctttgccctcgcgtccatcctctttgctgccacagcagagaggcaccccaccgccgcggcagcaagaggagccacgctccccggggacagcgcaatgtcaaagagcaagggaacaaacacgtcattcgcgaccagggagacatcgatccaggagatgcacctccgcgccgcatcgagggctactgcggcgacggcggggtc

SEQ ID NO: 88091 - DNA, 575 bp, Oryza sativa
aactcaaaactcatgtacgctacatcccataaaatgtggtgtatgaactggccacattatcatttcatggagttggtatagccgtgtaggttgtgaactcgtaatgccatctccatctgcgtcgtatctcaataatgcaagaatgcaacctaactaaataataaaaataataataatgtttcactaatttattttcaactgtacgtctgtgcgaaagaaaaaaaaaagcttttgtggacaaaaatacagtaactagctagttttctatatccacactaaacacatcgaacatactccatccgtcccaaaaaaaaaaaactcaacatagaaggggatgtgacccctcctagaacaacgaatctggattatccttaggttgagtttttttttttgggacactgcttactactgagacaagtcctacactcctactagagaggcaaaacctttgctttggttatttaggaaaccatagttattatacttctgaccatgcagcacaggggactgaagatcttataagttggcacggaaatatttccgtgactcctgctgttttatgctgtccgccacat

SEQ ID NO: 88092 - DNA, 729 bp, Oryza sativa
ttttaagatagaaagtaacaactgcagtggatacttaaatatatttgtagagcatctgtgcatgacttctatattactaaatcacatgcaaacctaaatattttttttaaaaaaaaaaactatgtcgatcctttttacctcttgatccaccctaacctaatccaggtggtataggtgtgtcatcactttattcttaatgcgtgaattgagcatcattcttaactcataggtgggaatgttgaaagagtcattgccttgtggtgttttctaatgttgaaaatgcattgttccctgtgtcaaaacttttgacctgattttctctgcatgtttcatattactgaatgcccccttatcttttctcctatttcttcttatccagttgaaggtgcccttgcacatccttacctggcatcactgcatgacataagtgatgagccagtctgctcatcacccttcagctttgacttcgagcagcatgcattgtccgaggaacaaatgaaggatctaatctaccaagaaggccttgcgttcaaccctgattaccagtagctggtgttctatttcaccttggattgattctattcatatggagttttttcctcctgcgccacaaaaggtcgccgacagtgatcactagttgtaaataattgcctcacctgaaaaatcctccctggttcaaagctgaaggtgttgttctaagagtagaaatgtactttgtgatcaagttcc

SEQ ID NO: 88093 - DNA, 688 bp, Oryza sativa
tttcttcacccatgaatccccctcattgtcatcttctatcgaacagaaaaaaaagagaaaaaacccaaattagtccccaagatcatgatactgtcaagagatcaagggaaggtgaggaacatgtagcgaaactgaaattgaaggcaataactaacctcctctgccaccgcgcgtcatgatcttgatctcgaatcgatcaggctcgctcgatgatctcgaggtgatctctcaactgggttgaggtgatcgagaagagccgtgccggtatatatgcgccaacagtacacaggggtgtttgatttcttatcggattcggagttggaaatttcaaatttcttgatcgaccattttattttttggcccatccaaacaggattcactcccattgcggttcggaaatgtgtatgaagatctttatttgaatgagtactatccattttgaatttgaacggactgttttcgtgtgaaatttacagcttctctttcgaacgcaagcaatggcgttgcaacgatagctcctgcatctcctctctgaagcagtgcgtcgccatcgccggcaccgcgagaacaccttgaacccgcgccgccgcctctcgtcggctgcgccgtacggcacgaagaagcacggctccgtgctcccgagcagcctccacgagagcggcagcacggccgccggcgagccccaccc

SEQ ID NO: 88094 - DNA, 2203 bp, Oryza sativa
ggtttgatacctataagtaccggattcgatacctaggtcgggtttgatacctatgagtaccggatccaatacctatataccaggttaatacatattagtagcggatctgataccaaatatagggtgtgatggtaggagacttcagacgtgataccactaattctgatatttatgggttatatacttctattcaaccatcaaataaaaagatggaccatgcatagctaggccagaaagtacagccaaacttgctcatgtgccgctgagtgcttaattctaacttgctgacatgctttgtttaggctcatgctactagctctagtgcttaattctaactttgctagttgaagcaggtgtgagacccatatggacctaaagaggtgtagaagtagtgttgtattagagtatttcatagctattttgtactgtaggagaaaagagacctctcgtcagtcgtcactagtcagcagcctccatgtgaaaggacagcacacgacatgctttcagagagaaagaatcgatgagtgattggtaagtataaattataaactataccgttgagacggtacaccatcccatagtttttctattttattaaaaccggtacaatttaactcggtggttttcaagagcggtttcgttgatgtggcgtctacatgacggtattaatctggcatgtggcattgactttatgccatgtcaatgccacagaccaggtcaacagtgccacgtggacgtcacgttaatgaaagcatcctccaaaattatcgagggagttaaattacaccgatattaatagttatgagtcgagatatctagtattgtggtttaagcactggtttaagagtttaagagagtcaaagtaaacttattccttctgccgttgttgtcacgtacagccgtacaggagagaggaaattcggatggttattggtggctcatctgggtacacactacacagtattcaatggcgattcagagtactacacggcattgcatcattcaatcatatgcaacctggtagatcgatcagggagaaggcaccgcatttggaatctatatctttactcttcataaagaaactgattttaagccaaactttactctttagcatgtaacagtagtagtaagtacaggcttaaagatgcttaattttgttcttgcagaagagtttgttagccttggacagtaaggtggagaagccaaaataaaaaaaaaaaacagacagaaccaaaagggatcctgcattattttggtttggtatctaaaactggggtgcatgcatcatattcagacttaaagttggccaaacttctttaataaaagaaactgtttttttttttccctgtaaataaactccaaagcaacatgcacagtcactcactctgtgtagcatagtttctgtaccagaaaagaaggtgaagcattcattcactagttccatacaagcatgtggtcatgcgatccaggattcctaacttgtattaaagtttttttctttctttttttgagatggcagcaaaccaagttgatgagcttagataagatcttgctcgcatttatgatttcatccggatccagcatgtgcgtatgtgaccatctccaaccaaaccatgcaacaaattactaagatttaattaattaattgcaacacataattaaattgcctcccaatctcatacatactacacaaatgtgcattacctaaaacaaaaacaaattaaccacccacaacgaaaatcaactaatcaccatcttattcatttcccagtcgatcgcaagatgtcttcttcttcctcttgctatccatttttcttctcttcttctgctaaacaaatcaaatcagcagcagctagccggccatcctccggccgccgtcgccgccgccggcgatgatctagggcatgatcggcgggtggcagtagggcccgttgacccacccgtcggcgatctgcttgtacgccgcctccgtgagatggatgccgtcccagctcaacgacgacgacgggttggagcacgcgtaggctcccgacatgccgcacctcgcgccgttctggtagttgtacttccctcctcccgccccgcagcacgccctcaaattcgtgctaaaccctgcgcaaattcatcacaaaaaaccgtcgaattaatcattcataaacttcaaaccatccagggtaccgagctcgaattcgcctatagtagt

SEQ ID NO: 88095 - DNA, 613 bp, Oryza sativa
gttccgtgctttaaggaccattatggcggagagggagttaatcgacagggataaactcgtgcttataatttgcagttccacggtttccatggagtgaaatcagaagagaaaactctaggtcaaaagttcgttgtggatgttgatgcgtggatggatttgagtgttgctggggagactgacagcatatctgatacggttagctacacagatatctacgggtaggagtaacaaattaatcccgatttgtttttatttcaccattttactagaaatgtcttgattgattgttctttttaagatattaaatcttgcttgtccatttcagcaatgtaggattattcagtttattttattgttcttttactaattccaatcattggagaactgaaatatgttcatgctctgcacttacaggattgccaaggatgttgttgaaggcccatcgcggaaccttttggaagcagtagctcatcgaatcgcaagtaacgcattgcttaagttccctcaaatctcaaccatcagagtgaaagttgggaaacctcatgttgctgtacgtggaatcgtcgattatttgggtgttgagatattgaggcataaaaaagatgtgggaggc

SEQ ID NO: 88096 - DNA, 692 bp, Oryza sativa
agccatcttaccctcagcgctcgtgcaaacttttctaggttgaacacccctagcccttcataagctgttggcatacaagttcttgcccagttggccctgcatttttcgcctgtgatgttatcggcccctgcacaaaggaaccgtttcctctgtttgtcaagcacctcaagggattccttcgtaacttttagagttgtccagagtagacaggttgctgacgtgaggattgacttgactagtgttattcccctccccccctatccctatgtttcttcctcgctagcctactaggtgtcttgcggatttgtcaaaaagtggctggaggtctgccttgtgtagccttgtcatggctagggagagccctaagtatttcattgggaagcttgctctggtcgtcggcgtgctttccaacaagtcgtcgaggtctatgctggcacacctaattggcttcacctgagatttttgtatgttggtgcatagccctgttgcttgtccgaagcattcacagaggccagcgaatgcatctacatcgtccttctttgggttgatgaagaccgttgcgtcgttggtgtacattgagattcagaggcatggtgaccgaccctagccctaagcttgctgagcaaattgaggtatgtggcttcgggcagaaggcatgtagtgggctgattgctagaataaagaagagcggg

SEQ ID NO: 88097 - DNA, 583 bp, Oryza sativa
cttcggctgttccggtggttcttcaccgtgcagtcggtgtcgccgccatcggtagtcggtggctgctacttccagccacgggggccggcgctgaaccgctacatcccctgcgccctccgcaagaagtgggacgactggaagagcgattggttctacactcccctcgccgacgaagcgcgcctccgacttccgagccagcccccggcgcaggcctccagttggcgggcgccggtagaatctgggggatggctatgacgctgtcctcgaccgcctggcgggcctgcgatcccaggggctcacaggggccatggtgtatggcgactacctccgtcgtcggattgcgccgctccagcggcgcgctcggggcgcctgggagtacaccgggtccgaagactactgaggacccaccggggagtgagatgggactgggctcctgaggacttcaagatattggtccaacgggtgctgaatctcaactccgtggaggcgtctctcattccccaaggaatcctccccctctgcagcgatccagaccgcgcctccatcttgaccattatgacgggggtcggggcctcagaggagg

SEQ ID NO: 88098 - DNA, 809 bp, Oryza sativa
ccattattcctattaatcaaaggaggccagttttctattggtacatgtacgaatggttaaaaataaattctttttgggacagagatatagtatcaatattcggtagaaatagttcaaattattgatttataaattctattaattatgattttcttacacctcagtagaaagatattttattgttggtagtaggggtgaaaacggtacggaaacggacggaaacaacctttatcgttttcgtttccatatttttttcggaatcggaaaccccaaaaacgaaaacggaaacgaatattatcgaaaccgaaaacagagcgaaaacgaaccggcgcggatacggtaacgaaaatttatcggaatacaaaaacccctcaaactgagcttcaaacttttgtcaagttcaattctcaagtcttaacagtctacaattcatcataaaacacaattatatgaagtctaattgttaagtctcaacagcaaaatatattcttctataacttcgtataatttgcataacaaatattctaaaaaaaattacagcaaaataccatggtataaggtataaagtatacactattagcccgcagcccgcagcctctctcttcctccacgggccggcttccccttcccctcctccctcttcgggccgccggcccagcccttttgctcctccctcgccgagaagtctataatgcctccttcctttcaattcaaatattttttagggtagtaaatgatttcaaatgaaaaaaatgtcattaccaaagttgtataacttatcaagatcaacaacttttgttttggtcatt

SEQ ID NO: 88099 - DNA, 679 bp, Oryza sativa
ttaatgaatatgaacttagtgagaatatagacatctattatatatcaaattccaatatagagtgcataggattacaagcatttgcaccaaattggtatagggatattaagtctaaaaaggatatagaaaaaattgttcaaagattagaggatatccaaattataggagaaattcctatgaaatattgggagaaaaatgctctcgagtgtaaaattaatataataaacccagaatatattattaagaccagcccaatagaagcaactccgaaagatatagaagaatttaagatgcatatagaagaactgctgaaactaggagcaataagagagagtagaagtccacataggtctgcagcatttatagtaagaaatcatgcggaagaagttagaggtaaatctagaagcatagctgattatgaattttctttattaagagatatagcataacttattaagagatatagcagatgaatataataactctatgaaaagtgagtggcctaaaattagagacaaggaactttatttctatagagaactatccaggattaagaaacaaaaaaaagagaaaagcttggtcatagaaacccccagaacccaggaaattaaaatagaacaaataaagtcagaagaaccaagagaagaaatccaaaagttagataaggtattaagtgagg

SEQ ID NO: 88100 - DNA, 668 bp, Oryza sativa
cctgcattaaacacttatttcccatggcttgctgagtactcccgtactcacccttgctctatataaataatcccccctagttgctgaagaagatgaagcggatcccgctgacgaggagttcttccaggagcaagccggctacgatgagttttagggtttcggcctagttcccaagtcgtgcctgtgatgtttggtccaagtcttggcttccgcttcccttttgtaatgcagttgtgagctcgggatctgtccgcagcccaacatgactggactcctaccttataataaagagacctctggtgctgggatattctgtcttcctgtgataccagcactgtttcctgggattggtatcgattaacaggttaatttggagcgtcacgggctagttccgctcgggactagttcggggcgtgacagtctctttggtggacgaccgcctggtgcagtggttggcctcgctggaaccctgatcttaatgagggccctgggccattggatgaagggaccacgggcatttcctagtgagaggaccctcgccgttcggtggatacttcagagggaacagctcgtattcgggcttcaccaagtcgacttgaactttgcacaggcgggcctgggtgggctccatgcccttttgtctctggggtcgggttgacgcaagtccc

SEQ ID NO: 88101 - DNA, 522 bp, Oryza sativa
tatatatatatatatatatatatatatatatatatatatatatatatatatatttattatatatatatatatatatatatatatatatatatatatatatatataaaccatgcagcaacaggggcatgcaaaaaaagtcagctctatctttagtcccggttggtaacaccaaccgggactaaagatggctcagccacgtggattttttaaaatagggcaggtttcatagtgtccctggggacaggtgaatgcagtccattctatagactcttctgtcatttttacttgccaaaacccagcttttaagtcaaatttcgagaaatatttgctaccttgtatcctattaatccattcttgcttatttgggatattataggcatcttctatagtattatcatttagccttttataatttatgaccatcctagatttacctctaacttcttccgcatgatttcttactataaatgctgcagacctatgtggacttctactctctcttattgctcctagtttcagcag

SEQ ID NO: 88102 - DNA, 2632 bp, Oryza sativa
gccttggatgtcttctggtttcatcgttcttcttggaataccagcttctttctacaaataaaaaaagagaataacaggaataaacctgttaaatgccatgttttgatcgataaggttaaccaagattgtgtacagcagggtcagaaacaacaatgcaaaatacattatatgtgacttacaccagttatagtccatttgtttctgtcctatctagtacaaacccaaaatgaacaagataaatgtgacgggcactggttgccagtaaaattttttaaaaaaattcctttatttccctagatgatgccattacctaacaagatgcacactggatggattcctcgttaatcataccaaggtgtgcctcaaattttactaacatgattagttattccatttttgagaaataaaatgtgcaagtgacacaccaaaactttttgcaatggattcattggcacaaaattgaattgaagtctaacatataatagagacaaggcatgtttgacaaggatatcaactaaaacaatccttttttacctaagactagcagttttttctccaacagcaggttcatctattgcacatatcaaactgataatatttgacagaaatagattccaaaataagaaggaacaactaaccttttggaagtcaattccagaataaacaatatggcagtttgaaagctctctgattttctcatcaattgcctgttcagtcaaaatacagtcagttgccaaaacaaaaagaaaacttcaattggcttataatgatatgaatatcccagttgactaatgatttgcacataaagttatcaagtgctcaggagtcaggacagctgaaaaggagtaatattgcttccagtttatgtttaagcagcaattagccttttatgtcacctgtctttgacgcctaatcatcgttgccagatcaacatatggcaacttttgatcaattctgcactccatcaatattcctccatcatagtctttaatgtacctggaatcagcaactattgagttcaacagataaaaacctgctgtagcctagtacaataatactctcagacaacaagtagtgttatcattgttacacttttattaggagttactgactcactttatacttcaaggaaatgataaaacaatataattgacaataaattgcttacccttgccatctttctttgtccaatgtgatctcctttgtgaaaccctacaaattgccagcagcaaaggacaataaaataaaccaaattattgtttgcaagacatatgctaattgatctcttttgtttaaatcgtcaagaattcttatgatcaagaaactactaagtacagaaactgttgctgaacatatgcctaagggaactaatttatagctgaaacaaaactgtaggacttaggagataagttgaactattaaagattcaaagttagtcacctgatacaatcttacaaagactgctagacaatgttggacacaacatgtttagaaataactttataaaccatgcattgaaacattctttttgtcgctaattctatgaagtcactatttcgttaggttcaagtgtatttcgtagctgccacttgagaacaatcacaaaacaatgaaattttaagaaagaaagcatataaaagagttcagtcaaatagtcaaacctgctttacaaaatagccaacggcattgttatctgcataagttaagaaatgagtgagcccatcagcatctcgggcatgttgcttcaggtgattcattaaccgtgtcccatagcctttaacttgctcatcagctgtaattgcacaaaatgctatttctccaaacttctggctacaatttcaaaacctatattaggacagaaacttatgctgcagcagaaaaggaacatctctggcatggtgcatggcatgacgcaacagaaataatcaattgccagacaaacagaagtgtgcatgctgtcctacaacataacctttactgctttgagatcactgaacaataaatagtagaatcctataacacaatctcattatcaaaaatcaacgttagctacaaaaacttaaaagaacagctcatagcttccattagatttcattatcaataactatcagatatctaaacaaaaaagtaccacaacttgatcattcatgcaagtgcaaatacatataacagatgtcaatacatcatacaagttctagcaccaaggtggaaatattaccttgtataaggccggtaagtaatgcctcctacaacaatattattcctgataaccatcattgatttgtgagttctgcaagacacatcacaataatttcttttataagcactaacgaagagagatattcttgtcctctgcttccaaaatacgtagtaggcacattacactgagaattacctatccataacaagacggacaatgtactctttgggcatgttaggaagctgccgagcaaagatattcttcaagcctaccaacctggggaaaaacatcagtcactaacaaatctgaggttgtttggaacaataattttagcatacaaaccaaatcatatgttcatcaactccatcattagaatagcatagaaatttcagcctccctgcttcttcctgcagaacaatccaccaattttag

SEQ ID NO: 88103 - DNA, 541 bp, Oryza sativa
ggtgttcgtcaaggcgcaggtcgggaaccagatcctcaagacgtcggtggtggcggcgccgacgctgaaccgcggtggaacgaggacctggtgttcgtcgtcgccgagccgttcgaggagcagctgttgctgacggtggaggaccgggtgacgccgcgcaaggacgacctcctcggccgcgccgcgctgccgctcgcgctgttcgagaagcggctggaccaccggccgttcgtccagtcgcggtggttcgacctcgagaagttcgggatcggcggtgccatcgagggggagacgcggcgggagctccggttcgcgagccgcgtgcacgtcaaggcgtgcctggagggcgcctaccacgtcatggacgagtccaccatgtacattagcgacacccgccccacggcgaggcagctctggaagccgcccgtcggcgtgctcgaagtcggcatcctcggcgccgccggcctccagccgatgaagaatcgcgacggccgtggcaccaccgacgcctactgagtcgccaagtacggccagaagtggg

SEQ ID NO: 88104 - DNA, 833 bp, Oryza sativa
atgtctaccgtccagaaaaccaataactctcgacagaagaatgattatgaaccatctacaacaggctctgttgcaggtaatatatctattacaccactatttccttctatattatatattattacatgttttgagaaatatttacatgtacttaatgttcctatcatgcttttttggtttagatgcacataggggacatgcatatgaagatgatgatgtcgaggcattcacttatgtattgcatggtacatatgatgatgggttgccatcaaaatcgagtcacaaaaggaaacaccttatgcagcaaaagatgaatggcacaaggcattacagtactggtgttgacatgccttatgatccatatgtggagagcaagccaggaaaccaaccatttttatcaaatggaaaaagaccttcagatttctttaatattcctacaaaacgcatccggacagctgctagacaacgagttgtaagcccatatcctgctaatgcttctggagccactgcattcacaagtaaaacagatgcttctagtggagacacaaactcttgtcaagatgaccaaagttcattgcatggtggatcttttccaaggaagaatgtggatattgaatcgacagttgattttgatagacaattgtatgatggcagtgaggtatctactaagtcaaaaaagaagaaaaagtctaagccccttgatacaagacacctcaaagtgtcgctgagtcttgctctttgattgctgggaaggttaagatctttatgccaactctctctctatcttgttaccaatgttgtagagtaagtgattctgctgatgtttcagggca

SEQ ID NO: 88105 - DNA, 955 bp, Oryza sativa
tccgtgctggaactacagataagcacttggttgattaactacaagactgacaagtactgggataaggttgcagcagaatacaacagtgcaacccccggagctcggagaagggaagtgaagcatttgaagaaccgctggcagaggatgatcaataaggtggcacatttcaatgattgttggtgccgggtcatggcaaaatatcctagtggccagtcagagggcatgcaacagatggacaaaacttggctgatgtataataaggaagcacatgtgatgtatctcgaagaagcgaagcataagttcacctttggccattgctggaacgctgtttgggaccaacccaagtggaaagaatacatctcttctttctccgcaaaaagagtgatgcgatctgagtccggtggttacgtgtcatcttcggaagactctgaagatatgcaagaaggaaaatgcttagtggatcctctggacatgcttcccaagaaccatgaagatatgacagaagtccagccgtctgtctcaaatcaaaagaagcaattagaactattgacagctgatgcgtcgtggcctattgaatttcagcttgggaggcaccaattgatgactggaacatcaaaattgaacgaacatcagcagggggtggcagtgagggatgaaatgcttgaaaaagaatcgggcccacaagattttgaggtgctagacaatgagagagtggcaagggaagatgaacctaaaaaagaaacacagcctcatcaaggtttcaaggcgcgaaaggtcaatcggaaacgtaaaggcaaggcatcatcttcttcatgtgaggtgcaggaagacatcaaacatgcattatatcttcagaccatgcttaacaatgatcgtgagaaaatgtcagaggtacagctccgcctctcgaaagagcagcttgaattggccagaataaagcaggatgaagcgaatg

SEQ ID NO: 88106 - DNA, 671 bp, Oryza sativa
gaccgttccggcgatgagggtcatgtcctcgccgtcgagggcgctccgcgggccacccgaaaggggaggcctgcgagcgacaaaaagaaagaggctggtactcccagcaaggagcgccccgccggcaggtggtgctccgtccacaacacctccctccacgatctcgcggactgtcgcgcagtcaaaaatttggctgagcgaacgaggaagtgggaggaggacaggaggcaggaacgccgtgagggcaagtccccggcggttccttccggcaaacggcgaagtgaggccaagcagaaggcccccgctgttgacatcgatgatggtgatgatgacctaggtttccaagaacctggggccaccattgccaccgtcgatggaggagcgtgtgctcacgtctctcgccggagcttcaaggctatgaagcgagagcttctggccatggcccctactcatgaggcgacgcgtcgggcgcggtggtcggaggttgctctcactttcgaccagaccgaccacccaccgtgcattgcccggggagggcaggttgcgatggtggtttcccccaccatctgcaacgtgaagttgggacgtgtcctcatcgatggaggagcggccctcaacatcctttcccccgcggcttttgatgccatcaaggccccggggatggtgctccg

SEQ ID NO: 88107 - DNA, 627 bp, Oryza sativa
gtataaaaggaggaccttgcccacagagtacagggttgattctggcgagattgagagcctagaacaagggagagtttggctcacactttgtagctcattcatacacaaatccacaaaaacacaggagtagggtattacgcttggcagcggcccgaacctgtatacatcgccgtgtctcgcgttcccttgctagcagacaatctttccacatacagagagagcttgagatctcaccctaagcccccggccgaaccggcaaaggggggcctgcgcggtctcccggtgaggagccacgagctccgtcagatagtgatattcaaagtatggccgttggtttatttgcataaagctagtttcacaattcttttcacaagcttattatctagcatagactagtccagttttaattccagtatttattacacagcaacggttcttttcaccatccattgtcttcccaaagatggcttcccgttactggctgtaatggttttctggggtttactccttctcgtctctcgagaagatgatccaccagtataaaatcatcatgcatatcccatctcattcaatttaagaatttagagtctagccaagtgcaatacatgtcctgatgctcaatatccc

SEQ ID NO: 88108 - DNA, 576 bp, Oryza sativa
agtggtggcctcgcggtccatcaagcccctctccacggcgccggcatgttcttccagcgccatggcacgggcctcaagggcctcctcgcgccgccgggacgccgcttcggcttccgttgcccgccgctctcgcgcagcggcggagtcgagaaccccttgggcggcgtcgagcttgctcttcagctccgcctcccagcttgcgtgctgaagacggagggtgtcttgcgcctcgaccatcgcggtggtggcgacgagggcggcctctcgctcctcctccacctcccgggcgatctccgccagcgccgccttgcgggcttcgagctccgagatgtggcggcggtgggccttacggcccacctccaccatggcgtccaccgagcgccgcccctcctcgacacgcgcccatgcggcctcgagctccgctcgttccgctcgcaaggcctccacctgggcgctaaatccatctagcaccgcggtgtttgcggcggccaaggcctgcataatgggctcggcgctcactgggggggcgagagaagaggagaaaagccgccttggagaaggggatcctctaaagtc

SEQ ID NO: 88109 - DNA, 1567 bp, Oryza sativa
aagtaggttgatgctgattgagtagaacagtttgcaaaacaacgctgttctattaggcactacactacatcaaaataaaaaataataagactgaattgtatcagtgacttgatgatttgatctttacatagttcatttttcagtaactagaatcttcctatgagctaattatgataagttcaactgggaaaatgcaaatgtatctgttacagagtaaagactgctcgcgagtgctaacttgctaactgctcacatgaactgtctgaagagataaggaaggcatgcaaagatgacaagaatggaatatttttgtttataagaatcatgcattaaatccctttgaatttgatttattcaaattacacgcaatagctcatgcgaagagttagcaagtaataacccaaagatgtgtgaactatgtattccatgttttatcagttgtaaattactaacttcacctttttgccatagattcaataatccaaatgtcacatagatacaatattattgtgttaaaaacataaacatatatatgccaaatacatcaaacaccttacttatgtcaatgtacactatgtgattggccaagaaaaaaaagagcgagaaatgagacataatagcagagaaacacataagcccaaaatgtttggcataattgctcctttacagttcattttattaagcttggattcaaatgatagtacttgttacataccagttgaaggaagcctcagtaagagatgccaatgctacaccaccaacaatcggaagaagtgaaagtatcacccaaactgtaggcaactgccatgccattcaattattgaaagaaaacccaggtagttctctcagatatacataatatattgcagcaatcaacattatataggacactacaagttacctcgccaaggaaaattgcagagaggagaacagaaaagaaaggttccatagctttgatggtatgtgtgaatgacacagcaaccttccccaggctcatgttagtgaaaagattgcccatagtatggaccacagctagaggaaggatggcaaagagctgaaaaggaaaacacaagagcaacagatactccttgttaatacaacccatttaaacaatgaaagtgtgtcaaacaatatcaaagatctacctgtgcaccagaaatctttggtctcctaaggataccagtgatccacatgaacaaagcaacgacagtaccaacagcaaattgaactgttgtaatgtttattggatatgggaaaaccttcaggacctgtcaaacattataacagaaaacaagagttaatagtttatctgcgaaaataatcaatataacaatatagcatatcctgcaggaagaacaacacaatcaaaatacaaaatgcttttagaaaagaaaggctgtatgatgataatcaagaaaacccatgcataccaaatcagatttgtatgatgaacagaaatgcatctagggaagtttagtaggaagattatataatctctagtaactggaggtactgactgcaaggcagaataagatagaagaatgaatgtataatcaaaggagataaa

SEQ ID NO: 88110 - DNA, 5679 bp, Oryza sativa
aaagttttgctaaatctggtaatgccaggactggggcttgcattaacgattgtttcagggcttcaaaagcatgctgctcagctgtgcaagtatactctctgtccttttttagcaattctgtcaagggttttgctatcatcccatagcattgaatgaatctcctgtagtaccctgttagtccaagaaaacctctcaactgttttaacccctttggaacaggccaactttgaacagccttcaccttggctgggtctgtagccactccggcactccttgtatgccaataatgtgccccaaatactccaagtgctgctgggcaaaggaacatttgctcattttgacaaacaatttatgcttatgcaacacagtcagaacctctttcaacatctgcacatgttcctggagacttttgctatagatcaatatatcatccacaaagaccaagacccccttcctaatcagatggttaaaaatagtgttcatcagcccttggaatgtagcaggagcatttgttaatccaaatggcattactttgaattcataatgaccttggtgagttctaaatgccgtcttatgctcatcctcttcctttaaccaaatctgatggtatccagatctcagatccagttttgtaaaccattgggcacctgccaactcatccaacagctcctcaaccacgggcattgggtacttattctttattgttatcccattcagtcccctgtagtccacacaaaatctccatgtcccatcttttttcttcaccagtagaactggtgaggcaaatgggctcacacttggctgtatgatgccctggttaagcatttggctcacctgcttttctatctcattcttctgaattggtgagtacctgtagggcttcagaatgacaggcttggcctaggactctagaggaattgcatgatcgaaatccctctttggtggcaactcctttggctcaccaaacctgtccttgaacctgtgcaacacttcttgaatctgtgagggcacctcactttggttctgctgttcttctatggtacacagctgaaccacttgagccactgccccatccttcatcatcccattaaactatttagctgacatgatcttgcactgatttaactggtctttcaccccaaatagcataatcctgttgttcttatgactgaacctcatcttctttctcttccaatctatccacattggactgaattcctctaaccaatccattcccaaaatcatatcatagcttcccaacggcagcagcttgagatctgtcacaaatgattgtccctgacaccaccactcaaccccaggagctacttttgcacaggtcatcttgcccccatcagcaatggttatttgtgacagggttgttcctcttattggtaggttcaatttttctgctaccctttcagccaagaagttgctagtactcccagaatccaccagaattaacaaatgatgcttctgaatcaacccttccaatcttattgtcttccttccagaagaacctgtcatggcacattctgatatgaccaattcttcttcacttccagagtctccctcttcagcctctccctcatttgcatctctaatctggaacacctcaagcagctcttccaggatgtgaagctggactgactttgggcatttatgtcccggcccccacttctcaccacacttgaaacactcccctcttgctcttctagcagacttaagtgattcaaacctgtcctcccatttcggcttctcctctaccttcttaggctcctcaggggttggacctagaatccccttccctttgtaacttggcttcccttgaggcttatatggctccttgaatacagtcttgctgtaccccttcttgcctacttcattcagcaattcttcctgcgtttttgcaagagatagagcagcatcaaccgttcttggtttatgcaacttgatcgcaattttaatttcagttttcaagccccccacaaacttagtgacaaaataggtctcatcataccccttgttatacactaagactcgatgcataagttcctcaaatctagaatggtactcctccacacttcccatctgcactagcccatctaactccttcaaatgctcctgatacttatcccttccaaacttactatgaaccgctacatagaattcagcccaactctccacactatgtagctcttcataggtctgcaaccatagagctgcattcccagtgaaatgcaaggttgcaaaggctgcccacgactcaaaaggaacttgatacatgtggaaatatttttcacaattggttttccaaagcttagggttatctccatcaaacctaggacagtcagttttgggcaacctagttcccccatatctaaaacttccatttacaccatttcccctctctgaactttcacccaactcgaaaggaattggagagtgaggaaactgtcgtttacctctgcccagggttcgctcttgagccgcaagggactcaacagcagccccctggtgttgttcttcgacgcggggccctacgggcgtcttcatgttcatcggcgtcgacgcctccagagcggtgacgtgcacttcgatcccctccatggacttgttcagctctcggatcccattgtcgacgcacggaatccacttctccatcccttgaagagacaccaagatgttgttgaggcttgcggtgagatctgccaccttcgtcgccattgactcggcatctccttccgctacccccatttcttcctgtagcagcggatttgccttcttcctcgccagaatttgggttgatcgaacggctctgataccagaaatgtcacggctcatccaatccttccggcgtctcacctagattgatgtggatttgacgaactcgtgaggagatttcggtggaattttggggtagagaggaagaactcgagctgaggttggaggagaggtagttgggaatttgcttttctcttctttgatagccagcccctgactcagaggtctgtatttatctagttacaacccaactgcctcagcccatatggccgacccaatacatccatctaatggcaacacaagtctaatacacaggccaagcctaacaaatatgagttgtgccacttgtaacatgctcaccgatctaattttttgcactgtgcatagttagtatttgaaggccagatgattcgatcgattttttagatagggaataagtgctgaaattttgtgaaattttaggagaaggctttgtgcttggtcttatatgtttggtaaagttttcagaaaattttaaatcgggtgacgaaaatttgtgaaattttaaaagaaagtgtttttgcactttttacctggccttaatttgttcacttttttgcgtttcatttttttgaaaacaagcaagcacataacaacatgacaacactgagcataggagattaaaactacggctgttacagctaggatctatctgttctgtaccaaaccatgcaaactagttctgattatcttgaggatatgattgatgacgaatcatatgattcctgtaaacctgccacacacaggcccttacaaaatacaaagctccacgtttggtgaaattttaccaaggagaaaagatctcgcagctgtagcagcgtgctcgaaccttgtatcacgaattttgttgtcgatcttatcttcatatagtactagccacccagtcgtgcttcgcgcgactctgagtgcttgcataacctgctagtaagagtaggcaattgaaatgaccttgttactgcccattcattctcatccgcaaaggcgttggtggggattgcgaggctccgaccgtagtagaggaggaagagatgttgtcggcgtccggtggcgttgcagatcaggagtaggagaaaaatgttgattagtggttgaactcactagtgtcgtcgatgttcttgacagggttgttttgttgttgttgttctgctgctggtagactgcgatggtggtgcatgactgcgcgtggagatggcaatggcgttgagctgttggtgacgttgatgcagcggcgcgtggagatgtgatggtgttgggatatgcggcgatgatgcaagggagcctctattgatgtggactgtgctggagattgctggagatggggggatttggatagtcttcttctcgttttttatcccctgcctttttctgctaccttccggatggttcttttttaaaaaaaaaattgtttgactaagctactttgactagcgggaactatgctgatagctattggtgtattatcctaatgatctaacggtccacttttcttcccactatcatcctagggctattattatttaggtgacgtggctcatcctcattggagagagcttgctgctttcacatatgtagatttgagttgtctctatagtaacagactccagcgcagggacattttccacaacatctttaagaaattcaagctgccctctctcccctttatacccagtgatgtgcatgttcttcagataactatattcatgttgctcgagatggggtgcaacataacccttatccgaaaaccatacatgatgagggcaaccaaactgcaggttttgaaacaaaacagtatatgatcagcatatggtatacatggtcatatgataaagatttctccaataaaggagtatgatcggcacacaattcagatttttacttattaatactcaagtcactttgcttatgacatagaattctgcatccaaactcaaaacaaaaaacttgatatcactacggtaacttcatctgggctttcatccttgaaataggtagtagtagatgataaataaaaataatgctgtgcccatcgtgaaatagtattatactaatgacttcatattgcaaatcaaatgcctgaataataagtgaaaaaaaattcctgaaaagtgctagatgaaaagaaaaggtatgaagcgctgaaggtttatcctgtgctgatatctagacttctaaacacagaaacatcatgcagatgactgagaaacgtgctaaaaacaagagttacaaatgaaaacatattcgcatgagtttgtttagcacactattccatcgtggaacaataaaaacggagacattggacaacaccatataacttgaaagcaaaaaaaaaaaaagacagaagggccacttgcgaattagatggatatcaaagatataagagtgtgtatcttgcacaccagagaagtatggcagagaaggaatgggagttacttacatggacctccaacttttcaatgaatggagctgccctaattaaggaaaccgcgtaatgtatcttgttggcatcttcagtttttaagttcattaacaactgcagatgcctaagattggaaaagctgtgtcggttatccaacagccatcgtgcctgtaaaacaaaaaagaaaaaaaaatatatgccatcaactagatgatggtagatacattaaaattgcagcttaattcaacgattttccaagagcaaacctctatttgttggaaacaaacatgcaatgtcagattccgcacgattggaatccctttgagaagtgttgcaacagcatcctggaaagcagccttgaagaaccaaatgtgtgcattttccacatgagatgtatttaggataataggaacaaattaagtgtccgtcaaatatgaaggtat

SEQ ID NO: 88111 - DNA, 2240 bp, Oryza sativa
gagcaagaaactcatggttaaaaaggaggtaattgtgaatatataaatgtgttacaaaataatgttatatattggataggtggctttatgtgtgaactatttattgtgttgattatcttgcattgctgtactacttcctaatccacttcattattcctactcaagcaggaatctcttgacaacattaatcttttctcaatcataactgtgatgtcatttttccttttggcccctgttgccttcctaacagaaggcatcaaaatcactcctacagttttgcaatctgctgtgagtaatacacaactcaattcatttcactggttattagaaaatacaaaaacaaaataagcacctttctcacctttcatgatcctaatgaaatttctgactgatttcctgacacatgatgtagggtctgaatgtaaaacaggtgcttacaaggtctttacttgctgcactttgtttccacgcgtaccaacaggttagtcatgcatgctgtcgttttttcatgtttggtcatatacatgtttagttgggatagttgatagttctgtttatggttcaaatgccagaaagtgcatattttaagtctgttggagttaaagtattcttcttacagcactacattcaagtgatatgaataaccaatcccttctagttatttcgtggcttaagttcatactcctatggaaactgaacgtctaatacctaatttagaacccaggaatttcctgccaaaattgatacttccgtgataaatttctgcattagaaacagtgcctaaagctctaaaggaaaaactgtgcagattttgatctgtacttgtggagtcatggggtcgaaatactcacatgttctagataatttgtttttgcagattttctgcacaaaactaatgcatatttgcaagattgttgaaaaattagaaccattttggcagtagcatcaattccatgtaggagaagttctgaatcaccattgagaatacgataaaatttcttctccttcaatgtagtgaatgctattgcactagagtattttctgatcaattgatttattagtgtagaacttattttgttggtatggcaggctggcagctagcttgttttcacttcaagtggcagttggattccatggcatcatgtcctaattgcatttgtgtacctgcagtacttgtatatagaacaaactctattatggcagcagggagagtgaatagacataaggactcgtagggatgtgaacggtcatgtcatgcaatcttgtcctgcatggccggaggtcggcatggtagccataggggaaatcccttttcgtattgctttataccctactagctaaatgcccttgcattgcagcgggttattcaagataggaaaaaaataaaataattttatcccttgttgaaaaaaaattaagcttctacttggttgaaacaagattcttctacaaaaacaaaaagaaaaatgctatagttaagactatactccctccagttctcaaattcttgatgttttgggtgtggaaccaaaggcctctaattcttgacgttttggcatttggctgtgtgcatcggaggtgattgcccctgcatgctgcatagccattactgatcccaatagcgcagtagtacaattaatatggataaaacagggattatgccccctaataaatctctccttggtatatgtgattcactccaaaacgtcaagaatttgataaatcgagggagtatttctcaatatgagacataaatccatatgcttttcagtacttaaatatagattgatgactccatccgtgttaacgaaatgtctatttcatatgataatgtgtacttattaataaattttgttgtataactcatttagaattagaatagaagccttaagatgagaagaagcaaagcaatagaaatttaaagagctgcaccaaacagagtattggggagcaagagcagttggagactaactaaacaagtacacaagtacataaagtggtagcatagcactcacatgtgtaatagttacatcatggcccacacgttagtgttggtggtgatggcatactcaccaccatttgtacaagctatgccaaccttttacactcaggtggcaatgtacataaggaaactagagataaaatagcgatccaatctaaacaaactaggagatataaggaaaactttttttgcaaatatacttattatttcaataatttacgtttatatacatgcatgg

SEQ ID NO: 88112 - DNA, 11571 bp, Oryza sativa
aatataattacataaatactatagaacaacctcccatccacacgggatgactaaataaccatccagctgcacatcttatccatatcagtaaatcacgtattctccttcccctcccccctctctttctccatctccctctatccctctctctcccccttcccccctcctctctctctctccccccttcaccctcatggctcatcggtggtgggcattatgcagccatcggtccatgtggtcaaagacgaccagtgtgctaccgtgaaaggccgatccactcgaggtggagggatcgtgggcgtgattcttgaggcttcttcgaggtggtgacaaatcagatcggcgagctttttgttggttttttatgtggtttttaagcatttgagaggtgatttctcaggttagtttagctcattgatttgagttagctagccatattgaaggattttgtgtgccttttcctatactcgattacttgtttttaggggcaatggaaacgtgtaggaatgttctggctatgggggtagtttgttcttgtttttattagattttttctagagttgaaattatttctgttgatttttcttgagttttcttttgatagatggatgtccttttagatatctcagtgattctctaatagtatcatgatactatagtgtatcacgtcggtgatatcatgatactcatgtatcagacgtgatacctaacgatatcataggtgatacctacaagtatcatgcttagtacctgggtaccacggtctagtacccaggcaccagactttcgataccaagatctggtacctacggacccgatacctggtacctaggtatcaggtatcggatctagtacctataggcatagttattaagaccggaccggtgaatgaaccgcttgagctcttggttcactggtttagtggtcggaccagtggttttactggtccaacctggtttgattagtaatatagaataaatgtttttctactgtcacgagctgtacaatggtcacttggctagcgcgtggtgcactcaacccatgacctgaggtcgaatctccatccccaccagttttctttggattttacgtgcgcctgcgttggtgccaactagttgggcccttctctcggcccattaaccgaacttggctggttcaaccagctcggtttaacctccggttcatacaaaaaccacccgggttaaccggtttcatccggtccgactgcatgcccgaccttttcaggggaccggaccggcgggggtcctggttccagtttttacttggtatcaagtcgaggggagagacgatcgacatgccactagctcttcttctcccttcctctcctcgatgccgagaaagggagggagcaagggagagcgttgctgcttcattgtgttcttcttctcccttcctctcctcgatgccgagcaagggagggagcaagggagagcgtgtttggtatcctaggtacttggtattaagtcgaggagagagacgatcgacatgccactagctcttcttctcccttcctctcctcgatgccgagcaagggagagcgttgctgcttcattgtgttcttcttctcccttcctctcctcgatgccgagcaagggagggagcaagggagagcgttgctgctttattgtgttctacacatggttgtgcaggcatgtaaagaaaagagaagggttcattaaatgtaccattctaacggtatcccgtaccgtagcagtcatgtataattatctatctattatatattaaaactttcaacaaatgcttctaaaccatcacattgtgctataataaattagaaaaataaaaaatattctaaggaaaaaaaaagcaaaacatcaagcccactaatgaaattggtactgatacttttcgtccatccggatgtttttttggaatcagataggttcggttggatagttccggatattttcggattcggaaatgaattcggattatttttcctcgaaaatagaaacaaatacggtaagtgcactatccgttggaaagtattcggaatttttgcggatatccgcaaatcctatcttactataaagttgatggccactaacttctaaaggtcaacatgaaagtgtgccacatcatcacacactagaaattattatctagagtactttaaattacatgcaagtgtaccacatcatcacccactagcaattattatctagagtattttaaatatcatgcaaatatgacatatcatttacaattttgttgtatttttagaactcaatattcaagcaatgtcaaatcattatctccacatcattttatattatttaaacatatacttttaccatttttagaaatgtataacatatatacatatcccgcagtaaagagcggggtatcaaccagaatattatataggttcaggtcgtatatatttgctggtggttggtttttttttttttagaaacacagtacaaacgcaggcgctcacaacgtgcgcacactcacccctatgaacgcacacacgcacaccctacccctatgagcacctccggaagactgggccggcatatcttggacctccggaagactgggccggcatatcttggttttttttttgagaaacacagtacctccggaagactgggccggcatatcttggttttttttttgagaaacacagtacaaacgcaggcgctcacaacgtgcgcacactcacccctatgaacgcacacacacgcacaccctacccctatgagcacctctggaagactgggccggcatatctacgcacaccctacccctatgagcacctctggaagactgggccggcatatcttgagactgacgaagtcaccacaggcgcctcgctgtcgacgggtacaacgcctaccactgaaagaataattagccgtaaatacgagcacccgtgtcaaatctaggatttgaacccgggtgggctagttccatcacaaggaacctaaccagttgagctatgctcacttcgcttggtggttggttttttattgatttaggaagatggttttaagggtatatgtggacctattctaggcctctatgctaatgttgtgtaacgccccgattttcgttcgggattaaaaatcatttaataatgcattttatagaaattaaataaaagttaaatcaatttaatcaagtgaaatattgagggaattaaaattttcctttaaaaatcattggccgggaatgttttgtgatattctttgtgccctaaaatactctctgaaatttcccgcgaattttcggagcttaatagctaattttaaagtcacaaagctcattgcatcaatttaaataaattgaaaaccaaagaaaagctccccttccttccttgggccgccttcggcccatgcctccctcctttttgggccgctcggccgttcccctcctttccctttgccaagtccgcatcacctccctcccctctctccctctggctgacaggtgggacctgtgggccccgcctatcatccccgagctccagccgggtcggcaaccgccgccatggccaccgattttacccactcctctcgccgaatacgcgccacctcacccaccgcatccaccccgcacgcgcgcgcacgcccgtgcgaccttctcgcgcccgcaaccaccccactccccctctatcctcgcaaaaaccggccaccaatctcctccacgtcgccgcccactccatcgccggttgcctcctctcctgggctcgatcccgccttcccgagcctataaaagtgatcctcgtgctcccctcctccgtttccccctcctcccgagctccccgcgcctccctaccgccctccccacgctgctcccgcgcaccgccgctttccgatgagctccggccacccgccaccgctgctccacccaccgccgcgccaatccgccaccaccgtcggcttcgcggcgccgtgccgcagcccggcccctactccatttcccctctccgcctccggaacaccgccgcttcgcgcaccacctctctccgccgccgccaccgactccagccgcgcgccaccaacgctcccaccgccgttgtgctgcgccgtttccattgacggcttctccgcatcaagctccaccccggcctccactccaaacccacaaaaccaccaccaaaacaccattccaccatgcatctgagccactgccgcctcccgtcgcgtaaaaccggccaccaccgccaccctaaccaccgcaagggcaagctcggccaccacctccccgtcgatggaaactcgctgaacgttcgcttcccgtgcaccgccgtcgcttgtcaccggagttccgccgcctccctccgcctcgagcttcgccggccgccgcgttgcgccgccaccgccggtggccatccggctaggccgccgccgccactgttcgtcgctgctcggccggccggtctaggccacgcccgccctgccctgtggccgcccgtggaccggcgtggtcctggtccacggtgcgcccgaggccgcggtggtccgcgtccaccgtgggcctcccccttgagccgctgacgcctagggcccgcttgtcgatgccacctcctcccctcggtgacgtcataaatgattaataattgcctcataattcgataataattgtagaaattgatttaaatggctcaaaacttctaaattcatatctatttcatgcgaactccgaattgagccattcaacttgcaaaattcatataaaattgagatctacatgtttgtttactttttatgtactatttcattggtgtttattagagtttttcctcattttgcgtgccagcgtgtagaatccgttgtttcggaagatcgcggttgcaaggaaaagtgttcagaagatcgtttgaagaagcaaggcaagtcacacattccccttgagcatgttgatcccaatttacaaatgttttaccatttgcaaataaatatgcatgttttgctaattacatgggatcagggtttacctatctgcttgcttgtgccatgtttacttgatatctgtcctttgtcaaccttgggtaataaatcgactagctcaggttacttatgtgacctagctagaactatatgcttagccatgcttaattaccactagctcagttgatgtgataattgcagtattagatctttttagtatcagaacgacctgcgtgctcgagacacctgaccatgttgcattggtcgtaattatccaactaaaatacgactgaatggtgggctgtgggtgcatggtttcgctggtcgcacctatggcaattaaggaccggttcgcgggatgcactggaagacatacagcgcttgccacaagcgggaatgggtaactgtctgacttgaagtatagctttcctctagctgacattcctaggcaagagtgggcgtgatggagttgggtcggccggggtgttcggttgatcggcttctggattcaccgtggcatgagaggggactgcccgccgccttgcgaggagtgggggtgaaacctgaggtgtggtgcgattggtcaaagggggttatatgaagggtcttgtcacaatcactcgacatggtgatgtgttcatcatgggcgcatgatgatgcggtgacatgccggtggattgtgtcttgtgggtacagttgtgcacctctggccagagtaaaactattcgaatagccgtgcccgcggttctgggcgatcgaccagattcaccgtgattagtctcacacttaataaatcgactcaatgcactgtagttcaggtgtgttggttgggcctgttcaacatggtgttgtgttgatcagtagagatttaatattactttaattactcaacagttttattgtttgctcaataaaatattttacaaccgcctttatgcaaatagccaggagccattcttgaatccccttgcacgtctgcatcattggtgtggcttgctgagtacggtggttgtactcagccttgctattattcccctttttcagaagtgtagtgcttctgagctgaagacgaagttaggggactaaggctcagactccagttgagttttgcctgtggagtggagctgaagccccgctaggatcgtctttttctgctgctgctgctttcttttcggtgtgaggactaagtgcctcttctgtaagtattttatgctttatttacatttagaactgtatattacttgtcgttttgtataccctggctggtactggactgtgatttaatacacaaaatagtctgaaaatttagggctaaatttctgggcgtgacatgttgttgggaattctaatgagggtaattggtgggtgcatcgaggaactcatcatctctagctcaatggtgtagggagcaatagggaaacacctcacacccgatgttgggtgttgaccatgtactaatatagccaatagtatgtacaagatcctcaattagagccatgttgacgattattatagaccaattttgaccgtcaatataattgaaataaaggagaactagctatacttgcaatgcatatttatttttagaataatctatttacacttgtactttgaatatttttttgtttgcagagattgctacgtaaacggaggagaatcgacagaaaataactgaacaatcaatcgcacgccatcgagaagtagacttatgggtaaatggaccgacattttctgagtttgtatccgtactcgatactatccgtgtccgacctgattctgattataaaatttgggttaggatatgggaagggtgagatccgactgaacccgacccattttcacccctagctgccagggaagaaaagagataaagacgcatgcaccacaattttttttattttaattttgctgactaggatgccatatcagtgaaaccgtgcatccatactgctatgggacctaaattgtacggttttgtatagtttaggggtgaagatttctggtattgaggattatgttggctggtgaacttaatccattttttttttatctctgacagcatccgaaggagcccataaccaaagcagcccaaagcccaaccgattgacggtgccctgccgaagtgccgagagctcgagagacgaatgcaaaattaatctgtccgtacggctgaataatccattcccccttccctttcctcccccccctccgatccaaccgccggcggcggcggcggcgaccggcggccagagcgagctccgtcccgatccggcggggaggggcctccccgcccccacgcgctaacctccccaggcggcctcctcctcctcctcctccgcagcgatgggctccatggagccgttcaaccggtgagtcccccctccgtttcgcacgggccctggaaactctaaccctagcgggtggggggtgatgagatgtgcccccaccctcgcctgcttttcgtcgctgacctcggccgatcgtgcccgctgatgatgatgatgatgcaggctggtgaggctggcggcgcgcgccttctacgacgacatctcgatgaagggcgacaaccagcccaagacctcccgcggggacaaccgggggatggctgtcgtcgtcctcgacgcgctcaccaggtgattgggtctgcttcctgaagattctgtggggggagaatttctgtgttcgcgaattcgtatacctaggtctgggttgaaggcgggggttttcctctgttggtaggatcgtgaggggcgagtggagttagtagaacacagttcatttgggtccatccggaaatgaattgataaattggatacttctaatgagcacacttagatgatattgttgctgctgcttagggacatctcgatggatgaaaatggtggaggtgtttgcatgaaccagaattcccccaattggactgttgtagttaaatttaacagtgatgtgccacagcaattttatttgagttttgactctttcttcctttgactggttttatatgttttttttaaaaaattggaggttaaagatgataacaattgttaaggaattctgtactcaggaactgcaaatttactaatggatcaaggataaaatcctagatgtcctcttttcttggttgttaagacatgtagattggagccaacgaatgaaatgtctaaatccttataaaacattctttcttaagaagtttttatccacaaatctttggacctcagcacttcagctacatcatgtttgatggattgttaattttatttattagtcctcatgttttccatccacttatttgtgccttcttttccatacacattgatactatcaactgatgccttttatgcaaattacattgtcttggtataaaatggtttttggctctgaagttatgcaaaagctaatatttttccaccaccagacgccaatgggttcgagaggaggatttggctaaggcattgaaactccactcaaagcaattgcgccgtatcctccgattctttgaagaagagaaactagtgacacgagatcaccggaaggaggttagttttttattgcggctattattattgaagttccactatatctccattgtctttttcgttttctagggatggacatgttttaactgacatctcctgcgacccaatgaaaaatatttttgttgtggttcattttccttttctaattttaatttttttactttgttgctgcagtcagcaaaaggagcaaaaatatacagtgcagcagctgcagctgctggtgatggtcaatcaattaccaaggagggagaagagaaagtaaagatgcatacccactcgtactgttgcttggactatgcacaggtagttatccactggttttatctagatgtttttcatgataaataccattcagattgaaggcattccctccacaatatagggccagtaaattgttcttttccttttctagaatgttttaataaggacgagtttagtgtagatgccagggagtgggatactgttatttcaggatacccatgcaaagtgttgaaaagttagtgtggtttagcatattttacctatgggggttgaatactgtttaatgttcaatcacttattccgagtcaaggtgtgtgaacattgtggataataaattttctttagattttttacatttagatagattttttacatttagatattgcttgcatgtactagaaaatcagtgtttcatcatcagggttcatatgcaaatacagtttcttcgtgtgtaatctggctgtagtaactcctataaatgtcattctctcataatcatagattcatttattcgaatttttggtgtagttgctacaatttgaatccacgccattaggaacctaataagttgcataatactccctctgttccatcttgtaaggtgttttagttttctcctaagtcaaacttctctaactaacatttataataccaaataaacactatcaaggcatattttatggtggatgtagtgaaactaatatgatgttgtagatggtagtgcgtttttctataaacttggtcaaagctagagaagtttgacttaggacaaaacggcaatatggaatagacaatggagtactctaagaaacagtacaattgtagataaccaaggcctacttggttcatgtggtgattatattcatttctacttgtttctagagacacaaaaccaaacataagaaacatgtgctaacaaaaactatttttgtggattgtttagatcaattgtgcatcataaatttcggttgaatggcaatttatgaactagtttgtataaacaatataacataacataacatacaagttaaccttgtcatacatgtccattaaattgactttaccacacttttttgtgcatgctgctaatggcatttacaatattactaagtttgtagtttttgtttacttctatgttgcaagtatttgagttattttattgtttgaagtaatgaaggtctttgatctgttgaggactacaactacaaaacctaatcattctcattcatctttcatcttattctgtcatcatatttgaatcgtgtttgataagatgcattttttttgaaacacagatctgtgatgttgtaaggtatcggatacatcgcatgaagaaaaagttgaaagatgaattggacagcagaaatacaatccaacactatatatgccctaactgtaagaaaaggtactaggtacaattatagttcttttgatgctaggcacaaaatcaagttacttaaccttgttttacaatatgcaggtattcagccttcgatgcattacagcttataagctacaccgatgagtacttccattgcgaaaattgcaatggtgagctagttgcagagagtgacaagcttgcttctgaggaaatgggagatggtgatgataatgcaagaaaacgccggcgtgagaaactaaaggatatgcagcaaaggatcgatgtaattatatttttattttacaatgctaagaacattttcttgtgagcattcaattttaagcacttttaatgcaacttatatatataatggttcaactagtgcagaataagacaaaatgtttttgatttacaatctgcaatcatactgttggttaggccatgattccatgctttttttttggcacaacaggaaatatagtaagttatctgcttgtggtctttctggatgctgttgaaattattctttttgtttcttcattacgagtttttgcttggagaaaattacttgcatgcattagtatgctagatgttcatcagacatgaataggtgaccatgttagtaacacttatatgtacatcccattatgggacagtttacatcgtgagttctacttcagagttgttaatgctttgctataaactacagaaattaaatatacattagtttcaactttaacagataccatgatatatttccacagtaccatctaaacactgttgcttcactggtttgcttatacaacttatgattgtagatgtgtctacaatctgcttaaagttcaatataaaaatctcttgctgtttcagtctattcaacaaatactttaatgcggtagacaaccagttcttttggatgagaaatttagtattgtgatcttttggattaaaacgatgtgccctttttttagtgaagagtcttttcttttttgctgataatgagtagtagtctgtcaatattttcgtactaattgggaaatccatgtttgttagtcttgatctactggagtttggagttatttattttttttacaacttcgttatatttggttcaggaacaattgaagccattgcaagcacaacttaatagggtgaaggatcttcctgctcctgagtttgggtagcttacaatcatgggaaagagctaacattggtgcttttggaactgctgaccctagtgttgttcatgatctcgtgctaggaacccacaagggcagtatggtacaccaatgccatacctcgtaaagacaaaggtaagattatttttataatagtagtttttagtattgtttgattttttattagtacgcaatcaacatggcgcgtcttgaagcttcctgagattgtaggtgggtcaatcatgtcaggtgatggtggatctaacgggcaa

SEQ ID NO: 88113 - DNA, 551 bp, Oryza sativa
atatcgtcagcgcacagccatgttcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagagaggggggttgattctttcccagattatgagcttagaacgggggagaagtcagctgaaacttgtagctcattcatacgcagatccaccaaaacacaggagtagggtattacgcttctcagcggcccgaacctgtatagatcgtcggtgtctcgtgttttctggctggcatacgatatttccacatacagagagagtgagagcttgagatttcaccctaagcccccggccgaactggcaaaggggggcctgcgcggtctcccggtgaggagccacgagctccgtcaactttacacatagatggttctttctccataatacttctttgaacactaagatattgtt

SEQ ID NO: 88114 - DNA, 630 bp, Oryza sativa
  unsure (1)..(630): unsure at all n locations
cgacttcccgaggagcttgagaagaccattaaggcatcctctacggacctcgcccggagggcggtcgaactcggctggcgagttaccaggcccgggatcccaacttctccccatggatggcgctgtaggaggatcctcccgggaccgatgacaatgcgcgcgcgcgggtcggggatgctgctgaccacatcgtcaacggcttctagggctcgggccctctgcttgcgttcgaccacagctccgaccaggaaggcgacaccagcagcgaggacggtcttggcaacaaggccggcgacccgggcgcatattaatgagcccccaagcccccggcactcttatctattttcttgttctttcttctaaggccttcatgcctcttttttgtacaatgttaacttaatctgcaatgagaaatgatgaaaaaagcttgtgttagcattattctgctatatatatgaggtgaggatgaactgcgccatggtccttttgcgacttagcttggaataaaggctcgagcccaagtccccgtcctcgaatggctcgcgtcggtgctagtgactgatgagatccanctgtcgagactggcctggcaggcacgtcgtgaccctagggtatgggtgacccgattgt

SEQ ID NO: 88115 - DNA, 1563 bp, Oryza sativa
aaggttatgacattttttttttatcaggaggctatgacaattttcacaagcaccgtaatatagaagactataagaagattctgacctaccttgatttttgtaaaaagagataaaattcaaggtgccgtgcatatattttctatctatcttaccagtgggcttgcctcttttgaaacacttaaaataatagtattcagtttgtagtttggtactgagtttaataatctaaattctatgctattgacagtaaatatttaggcacgataaagagttattcatattcatatactatgaaatagtttctggattttgaaaatagagataagactcagacagaaaataatgtgatcatcttaccttctttgtgcgttcgagatcagattcgatacattttatcctatcccaagattccaagagggagcgctctttctccaagggaatctctggtggcttgttgccaagctcatcgaccttaccctcgagcctctgaagccgctcgatgacaggactgatgcggtctacactgaaagtctccactgctggatgatcatcagaagttggttcaggctcagctggaggcaatggattgtcaacccgcatctcctgctgaccatatgctatgtggaagaaggcaaaaacttttataatcaaggccagcagtaatctgaagaaacggcggaaaaatccttcatccgtgttctctttaggtacgactgttcggcttctgttgctcgaggaaataccgcctctgttgcttgaggaacctatacaaacaaaaaacactgaacagactactcgaagcaaatagttaagaatggttctaaggaagaactaaggtctaagaatagtaagttcaatagcttgttctttcattaatgcatagggatgtttcaagaaacattaatgcatagggataagtataatgctgtccttgcttaacacagacataatattcacaagggaaagcttatccataagaattacaaaggtgaatagaatcttgtaaggggagaataaaaaaaaaacagatttgctgaattacataaaatgacatatgaagactataaataaacatacccgttgcatatgatgttgtgctacctccaaaaggccgagcttgagctcttacttctggggcactagttttatcaggcatcgctcctcctctaccatagtcaacagttttgtctaccacaacaaagtgatcatcgcagctgtagtaagctgcagagtctcgtgctctgatctgcatctgtgtagaatataagagatttcgtaaacactaagaaaataatttgcatgggcacatgaataaacaagttcatgctacaactgaataagggaaaagcttacttcttcacgaactggagctaatcgactacattccactggccttctcatcattggagaactgagatcatcaacatctgaacccgactccactgttgatgtgtcactgcttctaccctgtcatgagtacatgaaaaaaaaaacgctattaattgtcaatgtgaactggttcatggagagcacaatgccttcattcatgttttagaatattca

SEQ ID NO: 88116 - DNA, 2081 bp, Oryza sativa
gctgccgccccaatctcccaccgcatccgcctcatccgctccctccagtccgtccccgccgaccgcctcctctcccacccgctcccctccaccgcccacgcctgcctcgccgcccacctcctcgcccgcgaccgcctctacgcccactcccgccgcgtcctctcccgcctcgtcgccctccgccggccccacctcgccgcctccctcgtcgacctcctccaccgcgccgcgctcgcgctgggcccccgccgcagcgcgctcgcctccgtggtcgacacgctcctctccgtcctcgccgacagggggctcctcgacgacgccgtccgcgccgtcgcccgcgtccgggagctccgggtgccgcccaacacccgcacctgcaaccacatcctcctccgcctcgcccgcgaccgcagcggccgcctcgtccggcggctcttcgagcagctgcccgcgcccaacgtgttcacgttcaacatcgtgatcgatttcctctgcaaggaaggggagctcgcggaggcgaggtcgctgttctcgaggatgaaggagatgggctgcttgccagatgttgtaacattcaattctttgattgatgggtatgggaaatgcggggagctggatgaggtggagcagctggtggaagagatgaggaggtcggggtgtaaagccgatgttgtgacatacaacgcgttgatcaattgcttttgcaaattcgggaggatggagacggcgtacggttactttgctgcgatgaagagggagggggtgatggcaaatgtagtgacttttagcacctttgtcgatgcgttctgcaaggagggtttggtgcgagaggcgatgaagctgtttgcgcagatgagggtgaggggtatggcgcttaatgagttcacgtatacgtgtttgattgatgggacatgcaaggcagggaggcttgacgatgctattgtgttgctcgatgaaatggtgcgccaaggggtgcccttgaatgtggtaacatacactgtgttggttgatggcctatgcaaagaaaggaaggttgcggaagcagaggatgttttgaggatgatggagaaggctggtgtcagagccaacgaattgctttacactacactaattcatgggcacttcatgaataagaacagtgagaaagcacttggtttgctaagtgagatgaagaataaaggattggaacttgatatttcactctatggtgccctcattcaggggctttgtaatgtgcacaaattggatgaggctaagagtttgttaactaaaatggacgagtctggtctggaacccaattatatcatatatacaactatgatggatgcttgttttaaatctggaaaggtgccagaagccattgccatgctgcagaagattctagattctgggttccagcctaatgtaataacctattgtgcattgattgatggattgtgtaaagcaggatcgatcgatgaggcaatctcccatttcaacaaaatgagggacttaggactagatcctaatgtacaggcttacactgctttggttgatggtttatgcaagaatggttgtttgaacgaggctgtgcagttgtttaatgaaatggttcacaaaggtatgtctctggacaaagttgtgtacacagctcttctcgatgggtacctaaaacagggaaacctccatgatgcctttgccctcaaggctaagatgattgatagcggtttgcagcttgatctcttttgctacacttgttttatatcgggtttctgtaatctaaacatgatgccagaagctagagaagttttttcagagatgattggacatggtattgctcctgatagggcagtttacaactgtctgataagcaaataccagaaattagggaacttggaggaggcaataagtcttcaggatgaaatggaaagagttttaccctcttgtacagacagtgataccgcaactgatggtaaaacctgagctcatgtagtgttaccatctcaggagttggaactgtataggcatcagtaccactatgctgaaatttttttgatgcagcatagaaacatatgccactgattcagtacacttctcctgat

SEQ ID NO: 88117 - DNA, 3340 bp, Oryza sativa
  unsure (1)..(3340): unsure at all n locations
taatattttgtaattagaaatctgatctatataaacattaaattgttcacttatttaagcatcccaccttgtatgactacatcaaatacagtccacacacacctcaacaaacaatataagattcaagcaagtaaaacaagtagaaaaacaacataagattctaaagcaaacacctcaacaaacatacagttatcaactgtaggactcttgcaacaacttaatcaagttgatgttcaaatcggcagaatctgtgggattgatgggtacagtaccatcatcaccacctctcctcgcggatcgtttgttgtaagcagacactgatactactacaaaatggcaaaacaccaatccttagtgtctaacggttttataagtcaatttttgagatttagctttgaagccataatccattatcagtggcttgcactaatctcttatgattcatgaacaaggatagttggagattaatgaggatgtgaatggtcaaatatatatatataatacacatcccatactagacaatatagttggccatgtgggccgcccggcacggcacggcccaggcccggccgtgcctgggccgaggcttgtcgggccgacacggcccgaccgacgcaccgggccgtgccgtgccagcccacgtgccgcactcacggcccaggcacggcccaacacgcctcgggccgtgccgggccggcccgaaggcacgatgggccgtcgtgcttttcctcacaataagtctaaatttcctccctcctattgggctgtgacatatgtacagctacaaaaagtctattttacctccctcttctttgggctggggtatataaatagctaaaataagtctatttaaggtccctattctttagacagttacatttatatgtctatttttagtccccatactttatgtaccgggcctggcctgccggcccatcgtgccgggccggcccgaccatgccgggccagcccagcgtgccggtggggaggcccaggcacggcccgacggtcgggccgggccagcacgggcccgacccaagtcgggccgtgccgtgcttgggccgggccaaaaaggcgtgccgtgggccgggccttcgggcctcgggccttatggccaactatactagacaagaaagatcggtctctcagatcgatggtatagctacgtagtcttgcgcaaagatctagacatgaccatttaaagcacctaacaaatagcttgatcttaatgacgaatcattacccattgattttaccctctattctcaccaagtttaatagtagagttaactatgagcttatagctcatattaaagttaacatgtataatagataagctataagtttatcaatatctttttcttttctctctgtctctcacctatgcatttaatgtttcatcttgaagtatgtgaatagcttgctcttgcatgagagcttttaaattctttctcctccacataaccttatagttggcttatagtgtattaaacttgctctaaggttgtatcaattaaccgataagatagctcttacaaacatttggatattttctttgtaggagtacgaaaagcttaaaacatttcttacatataccagctaaagttgagcatgtttttggttgcattgatcgtatggacttctcttttcaattttatgcagaaggtccatataggaatatggagaaaaaggtggaggaacttaaaaaaagtataaaaaattcttataatcttgatcagatggtcaatgaagcaaacgtagaggcacattataagtggacaggtattcccttcgaaaacctactccttttattcacagtacgttgtagttgtggttttttgcttagtttttctaattaattgtgtattgtaaggcttagtcccatttctcctaaaataagacaccttcttcttataaaaaatacgtcggcaacgactggcctaaaaaaatttatgattggattataaaaatattacaacacanattcgatagtaataagatatatatataccaccaacaacaaaacaccggcaaactgatggttatatctctcttttggaaacaggacctgaaatttggaaagatacagcaggcaaagtggatatttttgtgacgtctgtcggttcagggggcacattagcaggagtaggaaagtacctaaaggagaaaaaccaatctataaggatagtcgccgtggaacctgcggaaagccccgtactgtcaggtaattctatgtacgcatagataacatatttttttctctcccctttctagtaatatataaataaatggcatttaccctaatacaaaatcaccacaactaagtagcagtttaatttggctctgtttaggtggcaaagccagcaagcacaggatcagggcataggggtgggttttgaaacagaaattttgaaggcacataaacctattattacctatgaagtgaagacaatatatagtgaggatgccataacaaaagcgaggatgctggccagggaggaggggttgcttgttggtatttctgctggcgcaaatatagctgtttgcttggaggtaaatgctcccgatcaactctgttctttttcacttgtcttttattatgtcggcatggtctccaatatgtgaagttacttctctatatgtgtgaagttacttctcttttntttactatatggtctccaatgtgtgaagtacttctctacatgttcattgaagtaaatgctcccgatcaactctgttcctttttacttctcttttattacatataccagctaaagtttgcaccaacgatgatgtttcttatttcccctaatgaaggatgctcccaatcaacgttacactcctaattttacttaccaatacataccttatattatttgtaataatatgatcaacactcccctgttctaaattatttgtcgttttagttttgtactaaatcatgtgttccaaagtttagcaattagtttctaaaaattcatatagttgaacaacatgtgagctatatactagtatgaaagtatttcttatggtaagttcaaaaatatgaatattatgatgataaactatataaattctagaaaataaaagtcaaagttagaaatatttgacttcatacaaagctaagacaataaataacttgaaacagatatggagtaaataaaactgttcatgtggaccatgcgtccatgcctatctatgtactacttgtggatcgatcttatgaatattcgtggatgacacagcttgcggcgaaagaggagaacaaggggaagatgatcgtcaccatgctcccaagcggcgccgacagatacctaagctccgatctcttcaagtactg

SEQ ID NO: 88118 - DNA, 3751 bp, Oryza sativa
ggcgaacccgacgacgccctccgcctgcgggcccgcgccgccgccgccgccggtgacgctcccgctccgcagcagcagcaggagcagaggcatcaggagcagcagcagcagctgctctggtaccgcgcgtcggcgcccgcccaccgccgcgtcagggagagccccctcagctccgacgccatcttccgccaggtaaagcacacgattcctcctcctctccttccccccgctgatctccatcgatcgatgcggcggcgttcgtggaagctccaccaaaaataaaagagttggaattactgtgccctctgctagttcatcaacccatgatttttgttctactaataagaaaaaataataattagttttcaaattgttattagccgtttccttgtcggttagcatctcgcctgccgcctgccgtgctcagatgtgaagttcagcctgccgcggtgctcccgaatcgtggctagattttcgattcacgtctgtgtgtgcttgggacgggcacaatttgtttcgtggtgatatatgctgctgcggattcgggttgccatcgttgctcgttttggggatcatggggggaaccagcggccgggcgccggacgcatgcgttgcacaatttcgcggtggccggcagtgcagagacgacagcgatgtccgaggataaactgttgctgttagcatttacgagtagcagggtttggcctttggcgtgtcagagtgaaacagtgaatgaccaaacaatgaatgggtcacttggcacgcaaggcttgtacacattaaaagacttggtactcgggttggttgtacagactacagactatgagttattgttgggaatgttacttcagatacagagcttccattgaaggccagcaaaatcttgaatttatgcgatgttggacatgtggctcccctgttcagagtggtccatataactgtgtgtagtgtggccttgtggccttgtcttctccagttcggggcatgccttgcttgtgcatgaggtccatataactgtgtgtgttgtcggctgctgttttttagttggatagcccctttccaccaggcattaaggcatgctacttggcaccgatatgattctttacatttgctactctaggatgtcagtgtgctgcaatgttggcacagtattggggcaacattatttaatgaaatttccttgtaagattggtggtgggaactgggaaatgatctgagccgaacactaggtccatacccgttgatctggttttacgcaaaactttgtatgcatgcttgcataaatctgaagatttgagttttaagactggcattccttttaatttagatatattcttgcaaatcaaatcatttttttcttttacctgacaaaacaacattacataacttaacccatgataaaacatttattaggatattagtaaattggatgtcaacttttattactctttcttatagctgacagctaatcttttttgttttttgttttttttgtagagccatgcaggccttctgaacctatgcattgttgtgctggttgctgtgaacagcagacttattattgagaatttaatgaaggttcattatcatttcttgctctctttattttccccagggagtagtagcatttacttattatatgcttttctcgacatgcctcttgtctattatagttctgatttaactcattctcattatctgtatttgccgctgcagtatggcctactaattagagctggattttggtttagtggaacatcgctggcagattggcctcttctcatgtgctggtagatatctactgacctaattctaatttgagatttgataaacagttgtacacctcctaaaacaatagatctgcaaattacagtctcactttaccaactttcccgcttgctgcacttatggttgagaagttggctcaaagaaaacttattagtaaacatgtaagtttgttttactttgttagtagttctttatatttttattgtcttttcattcaaggctccttcactattgatgtatcgtgtatgtaagttcatgccaaaagaattgcctgttgatttactgtttcaagtgccagtagacagttcatgattttggtacacctcttgcaggtggttattcttctccatatcgttattacaacatctgtccttgtctatccagttgttgtgattctaaagtaagcatatttcttttgactttgcagtttgtttgaatgcatctacttttgacattcgttgatctcttatatttgatggtatgggatacactcattttttgtcgtattcagagatatgctgtatttatgtggtatgagtgcaaaattaattcaggtttttcagtttcaaactttttaagagtaattttcactaatgtatatttgttacttaaaagatgactcatgcaactcttatctttggttatgtttgatgttatacgatatatctagtccacaaaatgttagttttcagtttgagtaaaacaatcagagtcatatggataatttgattccgtcttggaatcttaaagcccatttctttttaatagtcatcaactattaaataaaagtaaatcttattagttccaaattcttagaactaacctgagagatatcagcgcagtcctaccaccctgaagttgcatgtatgtggcaatgttgtgcaaatcgcatttcataatcttagattcagattaagtcatccttatttgtcaaacagaggcagttgagggcagaagtaacaagtacatgtcgcctttttgttgattgtaaagagattagatagttcttatatacttatctattttggcttcatgcattgatataccaagaaatgttgtttatgaagatattgttcttgcataaatctggattcttagttcatttacatttcaatctttcaggtgtgattcggcagtattatctggatttgtgttgatgtttcttgcaagcattatttggttgaagcttgtttcttttgctcatacaaattatgatataagaatgctgtccaaaagtattgaaaaggtaaagcataggtatatgcttgtatgtttcatttttcatggtttctgttcaaatcgttgattccgaacatagagaataatgcaaagcaatttccaaagcagtgtagattttacggatgtcagcaatggactgctagccagtagacttttgttgtattccttctacaaagactagttcaagctgtacttcctgtttaaacttgtttctagcgttcatccctgacaatatttgaattgcttgtgtagtgcaaattttatagcttagagctcttcactcacttctatcattgtggctatgattatttaataataccatattttattcttatacaatagggcgtgacacatgacatttctatagatccggagaacattaaatggccaacctttaaaaggctatcctacttcatgttggccccaacactttgttaccaggtactgttctttgccttagacctttggttcttactttctaaattctaactttgcatgatccattctttttgtcacatatatttacatttaactaaaaataaacttttccttatttcattcttgttcactatgcagccaagttatccccgaactacatatattagaaaaggttgggtggtccgacaactgataaaatgccttgtttttacaggcttgatgggttttataattgagcaagtgagcctctttacatgatttctcatggtatttcatttacatagct

SEQ ID NO: 88119 - DNA, 1004 bp, Oryza sativa
cccccgtgcgctatcgtcgtcgccgccgccacgacgcctcagcgcatggccgcctcccccgcgagtccctctactgggccgcctcctcgtcgccatcgtcgtcgaccccccactccctccgcacctactgcctcctcgtccacctcctctcccgcaccgccggatgccgccgccgctcctctcgctgtccccgcacgccaccggccgaaggggaagaaggggagagaaagagagagaagggagagagggaggaggaagaaggactgacatgtgggccccacatgtcagtgggcccacatttctttttgtgtgaatgactaatgggtcccacgcatattttttatttctaccgccacgtaggtgccacgtggaacgaagactcggtcaatattgccacgtaggcgccacgtaggtgccatgtggaacgaagactcggtcaatattgccacgtaggcgccacgtcagcaaaaccgcctcccaaaaccgcccagggagtcaaattgcaccggttttgtaagtttggggagtcaagatttctggtattacggttgagggatacgatttagattcggtggtcagttgagggagtcaaagtgatcttattcctccgaacttaacagctcaagcttaattctgggccaaattcaccagccttgctctggtgcccggcagcccggcccaacaatggaatccgaccgatgattctggtcgctcgctgcttcgcttgctcgcgggcctcgcggccacatccatcaaaccacgggaaagatccggccgcgcgctccttttctagcgcacgttagaagcttccaaagaaaaaaaaatcccacgcctccaaacgcccaaaatgcatctcccctcgccttcctctagtaccttccagaatgttccgtttccctcctataaattacaaaatcccaccttcttctcccgccaaaagcacgccgatggactactcgacggtgaagcacgaggaggtggaggtggtggtgctggatggagag

SEQ ID NO: 88120 - DNA, 722 bp, Oryza sativa
atattactaaaagtgttaccttgcatgccactttatcaccaacagacaatgccttggaaccttttgtaaatgagcccatatgcagcacatacccagcaaatacttgaacattagttacattgaaagatccgaaagacccttcaattttcccagtgtcatatatctgatgcaagaaaaatcttgtcatgtttataatgtacggaacagtgactagcatacactgtgttgtttattattactaatgttcaattagaaatttatttgggaaaatatattgtatatttgcatgtgctcttaacaccaccaaatcacaatagctgaaaaatcattggaagatgtactaggatgaaatatcaggcataagcaaaagaatattgcaggattgggacagggtgtacaggttgctgttaagtactacctccgtcttagaacttatgggattttgcccatataatccctcatattctcagacagaggtagtacaagtgaaggactacagctgattgttaggacgacatacagttagactgcttcagattgaagggacaaagtagaacaaacaagtggggattaactacaagaggactactgcagctaattggcatgacatacaaatgaagaaacactgaagattacaacgataaagtaaaataaataacccaggaaccatattacaaccacatgagcattatatagtccacagtaagaatgttgtacctgac

SEQ ID NO: 88121 - DNA, 5608 bp, Oryza sativa
cttgagcaggagcagcagcaagccgccgacgccgacaaagaccgcctccgcacccgccgcggctgatcacgccaagaaggcaaacacggcggcggctggccacgtcaagacgccagcggcggcgccgaagacggcggcgtgcagcaagcgcaaggaggcgcccgcgccgccggagatggacgaggcgaagctggaggcggcgaggaagaagctgagggagcgttacacagaggaagagacggcgaagaggcagaggaagatacagatcatcaacaacgcgccggggaaggcgaagcagcgccccgccgtcgtcgagcagcggcggcgcgtggtccgggacacggtggtcgccgtggcgagccgtgctcctgtgcgttcctctctccggatgtaggtggtggtgtagttttagaatgaacatattattactcgggcactcagctctctgtactgtacatggttaatttatttcatcagttatctggaatttttcagagcaatgttggtggaaataaaactattcagttgtactccctccatactcataaaggaagtcgtttatgacaatgtttaagtcaaaccttgggaatataaatcatgaataactcttacgttgttgaatttgaaaatataaaagttatatgaagatgtcttgaaaaatactttcataaaaatatacatatatcatttttcaataaatatttttatagaaaaaagaagttaaagttgtgttttggagaccgtgtcgctgtcctaaacgacttcttttacgagtacggagggagtatgtaacaagtcaggttatatgaattaatagcaatgctgatgtaatgaataaagttcagttaatggtcaggtggctacactacacaacaccatgcatgcgagaaataagtatggaaagctttatcgcatcctgtttcagaagcaactcatgtgtgtattcagaagttcagagaatgtagtcttgcgattttgataaaacatgagcatgtctataactggttatttggctacaagaagagtaattttacagtccttgagagatatcgggaggtaccaacatttttagtttaagttataacacctcctcataccagagatactaaagttagactaaaaaatatgtacctcccgatacctcctcaataaccataaaatcactcaactaagaacgtgtaaatacgtggaactgatagtcagagccagagctcgagtgtgtctaccatttctttttggccatatcatgagcatgttcaggcctgaactattttgccataaccttggtatataatgtatgtctgcaagacaggatgacacatttggcaacctcgtaccagggttcaaaatttcgaatcgaaatttcggaaattttggccacccccgatacaaatgagcaaaccgaaacattaaaccctgcacggtactattcatgaacctatggattttatggtattttcccttaatttctaccttggaaaggttgagtctcggttatatttactctgatgataaatttagttttgtttctccaaatacttagaagctggcctctcaaaggctctggggcgacctatgtggtggtgtaattattgaaagaggtctggaacacagagtaataataatgtaatgaacaaaattcagctgtatgtatgaatcaggtggtgtgaactgatagcagtgcccatgtaatgaacaaagtttattaaagttcagttgtatgtggtttccgaaaatgctcatggtggtggctataacgagctcacgcgtgtgttcagaaattcagtgatcgtatgaacgagctcatgccttgagagaattaatgtacgtatgttctgcaaaaaaaaaaaaaaaaaaaaaaaaagaaaaactgggcacaactggttattaggccacaagcccacaacctgggcatgtattggctcaaatgctgggcatatggcctgggcatggaagcacatcattagccaacgctgtgtatgccatgtcgatgtgtatggctatctttgtggacggcaggtgccgagtaagacggcacgcaacagtaagcacaatgaagaatgacacacacgacaccaatataacataacatatggaacatctccgaattaagccactatgcacagataattaacataaagttacgagcacacgcattcggtataataacaagttaaatttgccattttgataaaccaatacgattaaatgtggcccgtacagaagcgtatcggtatttggtaacatcaatcaaccttttttgctttcacgtttcgacatgatataaaacttctgtaaggagcgaaattgttacaaagaagcatcaataggaaaaaaaaaagaacagatggaaactaggtatccaaaagttagaccagcttcattgaagctatctgggtagcaacctccatagcttcctttagttgagaggcctcagttccctgcattgcataaatttacatattttattgtgtgatataatcacaaatatttcacctcgggtacttatgtggaaaattcaagatttgaagggtacgattgctcacctggccctgggcaattccattcttgccaccacctccctttcctttgaggggcgcaatcgatggtgtcaaccaatccaacaccttcaagctgttagcagcgctgggaggcacaccagcataaatgactgccttattcgtggcttcatccgtgctgaatagcatgattggcaaatcctgtacaagacaaacccaaaagttcaacagcacatcctacacttgacaatggaaataaataatcttagaaatgcactctgttatagtagcacattttcccacttcagagtggttggcaccctagctaactagttatggacagcacctacatcattgatttgttcagcgcacctatgaggaattcacaactataacattgacatgagcaccaatttgtggtcgacattttagcaaagtagtagtggattttggctggggagacatgaaaaaaggaaacagtatcttgcatacagagtagaaaagaaaattctcctataaaacaaggcaagacgaagaaaaaggcattgaattcaaggctgtctctgctacgcattgttaaataatatagcatgtggggcacattgtaggaccattattataataggaagtaggaagtttgcatatagttgtctaatagatggcatatcaattcatttggataaacagccccatcgtttggcctaaacagccaaagaataagccaaaatttgaatttttgaacttgattttgaagttgattttgaaatgcttttaacgtaatttttgttaatgttggcttttaagtcgctacgaacaaatctacaaaagttttacttataaattaattttaattttctaataagccaaataagccattttgggtaaaatggcaaccgatgggagccaaagcatgttcttgcaacagtcagatgaaaacataagtcctgaccttctggtccttgactttgataactgcttcccgaatagcacttgtgtcaagacccacatctacatgagcaacacagaagcgctttccttcagaaagagcagtttgggcggcatctattgcaaacttcacggccttctggatgttctcctcgcccattttcttcttggccttcctaagttcatcctacaacatccaacagctgcaataagctccaaaatcaaccaataatggaataccaaatagccgaataccacatattgttctgttctttcaaggtaacagctcataaagaacatgtacagacctccaacttcgacacccggcctttaagatcagcttttcttgcagctggaattaaagctgtatcaagcttgctcttgatggaagcaatcgtctggtagaaacatcacttttagatggtgatccaatataaaatagatcagcagaaacaactccagtgcaatcaattttaactaccctttatccatataaagagtagaaaaataatatttctattggagaagacttacatcagagaatatttaatgaatatctagtgcattaagcaccaacaatgcaattgacaattgaaagatacaaacaagacaaaggcatataataccttttccaatatagctccctccaattttgatgcttcattgatttcagaatcaatagatgatgcatcctttatagcatcagaggcatgtttagcagtaacagctgtgatcctcctaacacctttagcaataccctcctcggacaacagggcaaatgcttctgcctcgctagtgtttttaatgtgtgtacctgatacagttaagtttaataaacataaccatgggaggtaatacattccagacagaagaaagtataccgccacacagctctgttgaaatggatagccattctttgctttcaggattggcaagtagatcttccactttgcgaccaactgatacaactcttaccggatcaggatagatctacaaatttcaacatgtgaaataaattacaggaaataatcaacaggcaaactttgtgtttcatcatgttatttcatgttttagccgactaacaaaacttacttcaccaaacacagctcgtagaccatttatgcgcttcgcatctgctaattttatttcacgtgcaaatacttccagtttgtcttttatctgttgattcactatagactcaattttccgcaaatcttctggctgaacaggtttccctgttacaaacaaacagttttgagttgcgtggctgagggaatacatgtgaagaaggataagataagaaccacataataccatgggagaaatcaaaccgtagcttctctgggagaacaattgaacctttctggtcaacatgatcaccaagtatttcctgcatttaaatggtggaatcatcatgagggtggaagataaaagtgcaaattttttcgataagcttaaattcaacatacccgtagagcaaagttcagcatatgggtacatgtatggtttggagcaatgagagcacggcgagcataatcaacctaccaatggcaacatgaacattcatatctgattaagcgaatatcagagatcaactaatttgatgtagagattgtattactaaaagtgttaccttgcatgccactttatcaccaacagacaatgccttggaaccttttgtaaatgagcccatatgcagcacatacccagcaaatacttgaacattagttacattgaaagatccgaaagacccttcaattttcccagtgtcatatatctgatgcaagaaaaatcttgtcatgtttataatgtacggaacagtgactagcatacactgtgttgtttattattactaatgttcaattagaaatttatttgggaaaatatattgtatatttgcatgtgctcttaacaccaccaaatcacaatagctgaaaaatcattggaagatgtactaggatgaaatatcaggcataagcaaaagaatattgcaggattgggacagggtgtacaggttgctgttaagtactacctccgtcttagaacttatgggattttgcccatataatccctcatattctcagacagaggtagtacaagtgaaggactacagctgattgttaggacgacatacagttagactg

SEQ ID NO: 88122 - DNA, 974 bp, Oryza sativa
ctgactatttagcgcaacatcaaacgcgggaccgatgactgacactatcccatagtacccatcgatcctgcaggccagttgcgcgccactgcgcgctcccatagagaggttgtgcgccactgccaaatacatgctgccatgcatgcatacgtcatgcaactgtccagcgtgagctgctgctggtcacgcgatgccggctgcgagatcgacgtgatctcgcacacccctagcgcggggtttatccggccaccagtgttagacttctcagtccttaatactattgtatttagctatcattgtattgttgggcttgattgtgtggtcttggcctagccagcccaaacctgagatgtataagatacccctccaggctggaaaggggatcattgagtaagaaatatcagaccaactacctatctcctcttccccctctgcgctgtttcttcctcttgcaactatgaaatctcgctgactcaaatcccccaaatccttgtgcggttcgccaggaacccagagttcgtaacaatttggtatcagagcacggtttgtgcacatcctggcaaaaaagaaatctcaacccacgttgacagagaggatgttggtggcggagggagagatcgagtcgctgggtgagcacgtcatcgagctcaccaccaacatcaacaatttgttgggtactatgtaagggctcgagaggtagatcccaactgtggatgcggggatcaaggatctacagagcatggtggatgggatcgtagcgcgggtgatgaacctcgaaaacaagcagtcgacgtcgtctaccatggcaacgccaccgtccggagggcaccgcgtggaagagtgttaccagggtgttgcattcggggccaatttggtccagaagccaaccctggtcgagggcaagccttcactccatgctacagctattacttttgagttgggagagtgtcttagcggggagtgggtggatctct

SEQ ID NO: 88123 - DNA, 718 bp, Oryza sativa
atcatgccctcacattttgttaaatagcaagccagggttaattctggcccttttggttcattcgcctctcagttggtcaccatctttgtaaagactcaagaccagattatgaacatgttgacctagttatgagcattggaaaaatattgcaagattgagtatataaggaaattacttttctgggggacagcataaagttgctcattatgtaagatgccacatcgcgcacagtttccctcacctgtgcaatttaaaaacagtcatgttgattactatagccaggaaaaagaacttgaaagaataggggacatggtaggaatttgaccaggataaagatggttctgttctttcataaccagaaacctctactacaacagaaagtgccataaacgcatggatagaaataccagtaggaagacgtaaaaaatatgactcatataaggaaaaaaaatgcatgctgggaaaagtcttgagttctgaaaaaatgacctgaaactccttgacgagttccaaattcaacatatccatcatagcgacatgaccttttcgtccacctactaccatataccggccatttcccgtgtatcctagagtataagggccaagtactgcatcataagagaagagctagtcaatccctcataacttgttggttgtcatccgaaaagttaatagcagcaagtagatgaaaagtgctatctagcaattattccaaaaa

SEQ ID NO: 88124 - DNA, 716 bp, Oryza sativa
tagtttaccttgggtgctgggtgttcttgacgaccttctggccgtacttgcgccacttgtagccgtcgtcgagcacgtccacgtcgctcatcgtcttgaagcagaatctcggctcccgcaccttccgccgcgccttccctcctcctcctcctcctcccccaaccttcttcatcctcaccgcgccaacccccagatgatgctgcgccgccgccgccgccgacgtgttgttgccggcgtcgttgatccccatggcgcccatcgccgccgccgcctcgcccttattccccatctgcggcctccctcgatgatcgccttcctcgcaagacctagcacggcaataacgtcgtcgacatgggagaaaaggggggagagagagagagagagagagatcgattgggtgttacgggtacttaaatactcgcaattaccatggatgcggcggcgaccatctctgaagatgcgcggcggcgtggaagcccccaccattgtggcggcggacggtgggaggagagggctcatgccaggaagcctgcgccgctggtccgtggtgaaagacggggaccaagtggctgtatcctatgaatccattgtggtggtgatgatacaacgcgtggccgtgggaatctggaatgggaatgccactgtggttgtggcctggcaccgcctcgcatggagcaggtccacattatttaggccgaccacccatggtggcggcg

SEQ ID NO: 88125 - DNA, 1210 bp, Oryza sativa
  unsure (1)..(1210): unsure at all n locations
ccagcaaggggcattttcatatgttagttagggtttttaaccattatttactatcattcatatgcaaattataattgactggagaatttttaaaagtattaaatttaatatatttttaaaactatcattcatatattagagtttttcacaatttaatttactatctttcatatgctacttatatatgacgcatcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatattggaatttttattaattataagtcatatatttgcttattacgatttatccacttaatttattatagacaaaaatactttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggctggtgctaactcccgcgcctacagctaatgcacattttctattcattaaaagaaaagcgccttgtagatgaagcattaggtaatttgatccagtgatccatacatggcccacaaccattgttcacaactctcccattttctcctcatcttcccccaagctttgctctttcttaccctacgacatggacacccatgtcgtcttcccgttctatcacgcatcataatggcgcactgccttattatatacaacgtttcccttccattcccctgtcctctttttacgccatccctaccgcgggacggccctaccctaattgctgctttcatttcttgttcgtctctttctttcttctacatttttcctctgtttcagctttaaatattaatgctgactgngcttctctttccctttccacttcttttgtttttatgatgacaacttttatccacctaagattcctccaatcactgttcctctggctcatggccactttctcggagctgtatgctcatctgacaggtccatctttcacacgttctcacg

SEQ ID NO: 88126 - DNA, 764 bp, Oryza sativa
ttcctgcagcccaggaatgaatttttttttggacggagggagtagtaaggggtgtgtttggttgggaggttttgggtgaacgggagatggcggcccattttttttttgcctgtttggttggtgggcggaagtgggattgggcggcccaaagaggaatatacctcgcagatgccggatgcaaccgcccgagcggccgggcgagcagggcgagcgcccgaggtcgggtcgcttcaccgcgcatcagcgacagccacaggtcaagaggcgagagcgcggcgacggaaggcgaggtcggcggcggcggctgcagcggcggaaggcggggatgagcgaggtcggcggcggcgcgagatgcgggcggaggcggcggaaggcgaggttgcagcggcggcggggagggccgaggtcggcggcggttgcggcggcggaaggcgaggtcggcggcggctgccgcggggaggggcgaggtcaacggcggcgcgagatgcgggcgaaggcggcggaaggggaggttgcagcggcggtggggagggtcgaggtcggcggcggctgcagcggcggggatgggcgaggtcggcggcggcgtgagatgcgggcggaggcggcggaaggcgaggttgcggcggcggcggggagggtcgaggtcggcggcagcgggggggagggatgaggttggcggcggcggcgaggaggggcgaggtctgcaacgtcggagaggcagagcacggcggcggatgcgaggcattttttttctttttcttttt

SEQ ID NO: 88127 - DNA, 753 bp, Oryza sativa
  unsure (1)..(753): unsure at all n locations
cggaaagtcgaaagatacactggaagcacgtaatgatctgaagcatatggaacaacgcgggaaccttcacccggaaccaaatgagaaaggaagccattacttgagtccagccagctacactcttagcaagggcagagaacgaaaagtatgtttggaatgcttggagagcataaaggtaccgtctggatactccacgaatatcaagcgaataataagcacgaaggagaagaagttcacaaacctaaagtctcatgaatgtcacgtgttgatgacacaactgctaccagttgcaataaggggtatcctttcagacaatgtgcgtgcaacaataacaaagctatgtgcattcatgaacgcaatttcgcagaagtcatcgatccggatagattagaagccctcagattgaagtggtgcatgtctcgccagttttgagtggaaatttcaaccttcattnttcattatattgaccaatttgcttggcaacctgggaaagaaaatcgcgatcttcggccctatgactacacacacaatgttcctttcagagagtacatggccgtcttaaaaatgatgttcttaacgcgcttattccaaagaaaagttgccaaggtatatgacagaagaaggattcaaatttcgtaaaattattgagacccttcccaaatgggggcctgaataacccatgaaggagactccgggaaagggaatctcccgaaggaagcataatgacgctgacacaaattattccgaaaggcc

SEQ ID NO: 88128 - DNA, 935 bp, Oryza sativa
  unsure (1)..(935): unsure at all n locations
taaaagagaaagaaaaaaatggtatttctagttggggaataaatttccccccaacgaccccttaaatcgagatgattatttgattttaagaaaggttttttggttttcaagacaaagaatgaacatggcaaatcacggcgcttccggtgttggtgttcttcttggggngctttaaattaaaaaccctggttttgggggttaacccatttctccagcacacctttgggccaagaaacatactaatacatcacaacgatgttcacgaaataagccaaaataatccntgttaattaagctgccagatgaatcaccaagaccaacgtgttctgaattgaaccaagcatccccctcctgtgcgtgggtgcgcgtgattcttctccacccccatatatatatatatatatatatatatatatatatatatatatatatatatatatatatatatatatatatatatatatatatatatatatatatatatatatatatatatatatatatatatatatatcactggtggagaaaccctttgtagtcccggttcctaacccccctttagtcccggtttccaaaccgggagtaccaaccgggactaaagatcgctatctttagtctcgggtgaaaggctgagcaatctttagtcccggttggtgttaccaaccgggactaaagatcgtgacctttttttttttgcatgcccctgttgctgcatggtttatatatatatatatatatataaaccatgcatatatatgtttcaatacatatatatgcatacatatatatatgtatttatacatatatatgttatgcaaatgcatatgtatatagatatatatatgaacaaaatatatttacattatagaaaatgtgtacacatgcatatagggaaccgagctcgaattcgccctatagaagtagtatacctatcg

SEQ ID NO: 88129 - DNA, 876 bp, Oryza sativa
caaaattgtgcgcacatgtgaaggttgccaatttttcgccagacaaattcatctaccagctcaagagttgcagactatcccgctgtcttggccgtttgcggtttgggggctcgacatggttggcccgtttaaaaaggcagtcggcggttacacacatctctttgtggccattgataaattctccaagtggattgaagctaaaccggttgtcacaattacagcagataatgcgcgagacttcttcatcaacattgtgcatcgatttggagtgcccaatcggatcatcactgataatggcacacaattcactggcgaagtttttaaagacttttgtgaagactttggaattaagatttgttatgcctcagtggcacaccccatgagcaatggacaggtggagcgagccaatggcatgatacttcaagggattaaagcacgtgtttttgaccggctaaaaccctatgccggcaaatgggtgcaacagctgccatcagtactttggtctttgcgaactacacccagtcgggccacaggccagtcaccttttttccttgtctatggggcagaagcaatgttgccgagtgaagttgaattcgagtctttgcgctttcgaaatttccgtgaagaacgctacgaagaggaccgagtggatgacttgcaccgactggaagaagtccgcgaagcagctttgattcggtcggctcgatacttacaagggctgcgacgttatcataatcgcaatgttcggtcccgtgcctttttagtcggcgacctggttttgaggaaaattcaaactacacgggatcggcacaagttatctcctttatgggaggggccgtttatcatctctgaagtcacccggccaggttcctatcg

SEQ ID NO: 88130 - DNA, 1247 bp, Oryza sativa
atgtatttccaagacattagacgaccaagctggagttattcagaacggcatcacttgagaagatgagttacctgaggatgtgcctggctgagcgtgaggtgatccttgctctttatctggagacccaatcactgagtcattaccaacttctggtccttgaaaagttgtctgcgctttagcttcaggaatctcttgatttagatctacatccgactggtttccagtcgggggctctcgggttgttgcagtttcagttgctgccgactggtttccagtcagcggctgatcactcggattggccttgtcgtccgaagcttgggcgccagtcggctgactttcggcagtcggttggctttcggcagtcggctggctttcggcagttggcttagcatctttggataaatttggctctgtggcagccggatcaggttcttttccagttggatctatatcggacggtttcctgcaaagtgtcctttcgatattcagcgtaatttctatgagagaagcatgtcgaaataaaatggtaccgagaggtttatacctggaagatgttctaatctttggcatttgacggccagccagttttttcctgggcatggtatgctttgggggtttattgggcgttcctttgtccccagatttgttgctgtcatcatcttcgtcgtcattaagcaccagctttctcttgcgagaacctgtctgcccagccggtttagaggtttgaggttgcgggtctgacctgattgtcggccctccgcttccctgaacggtgtgctggcgaggagatcggcgttgagcagttgggggatcagatttcattaatacatactcctgaatgagatgcttccacggttagctcactcaacatgaagataaaattatgttttggtcatgagttgaaggtttcagatacgtacctgtggaggcggattgaatgcattatatggtacaactggcagctgatgtgagtagctgacgacaatagcatttgagaagattttatacattctctccttcatgattttaaagtccagagagtctgggtcttcacggtttggatcatgcttgccgtcgaactcgaatgctgtgcgggatctctctttgattggagctaatcgacacttaatgaaatgccgagtgatttgctctccctgtaagccttgctctttgagcttcagcatgcgttccatcagttctaaggcttgggcagcttcatctccgatcggaagagagttccaagtatc

SEQ ID NO: 88131 - DNA, 10047 bp, Oryza sativa
tgcttttaaatttttttttgataactttttaaatgacatgtataaaacgaggggatgtccctccagggacaaaaatccacctcacaaaatgcaagctgaatctgagactgaaatctgaattgaattgcaaagaggatacgaagcagccgaggctgacgcggaggacgccctcggcgccgaggcagtagccggcgccctggcagctgccgcggagtcgccggagctcggcgaggacggggtggccgaagtcgcggagcgtccaggcgagcaggttggtcgccaggaacacgaaggcgtacacgtacctcgccatcatcgggttcggcggcccgaccacgagctgcgcgcacgcgcagcacgtctcctccaccgccaccaccacgcacctctcccccctcgccgccgcctcgccattgccgccgccctcctccgccgccatgccgccgctgcccagcgtcatcgatccccaagaacgaacacctgacaagctcaactcctgcagtacacaacacaaaagaccatatgcaagattcatcaactgaattaggcagacaaagaaagaaatcgcgcccgcaagctgctttttcgcatcgatcacactcgatccgtgaccatgagattgtccgttagcgcgctatagctcgccgatcgagcacgcatgatcgcgacgtacatgcgtgtgtttcctttgcaccaaagacatgaactcccaaatgagagcgtttgtttttgtttgtccgtgtcttgctttgtaggcaagcccactgcaaatgcctgcagctttcatcatctttgactcgcattgaccattacataaaaacatcaaatccgtactagaaccattaactaactagtaattagtaactaacttatgtcactagtagaacaatgtttgcaagaaaagaaagcttgtgtttaataaaagaaagccgtgtaacggattacttaatcttactccttttcatcattagtatttttgggttgtgtgtaaatctgctcaagaatcaacatcactcatcatcaaagggttttcttccaaggcctgtggactgcatgcagaaggctacacgttgtgctgtgcaatttatctgtcttgacagggacatgaaagaacacatactaaacaaaaagaggttttcaaaagaacattgatcaattcttgatgacatggttggctttaaagcaggattaggacgattaaagatggacaaaaagagatcagcatagctccatggactgcactcactgaagaatgagaaggacacaacattggcatgtttctcattctgaattctgatgaccagcagcagccttggatgtatgtagaaaaagagtaaagcagtaaagctatgaaagcatattatgagatggtgtggaatgtggaaagcaaaagggtctggttgggttaaattcccctgagaaatgatagattgatagtactactacttgtgtgacgtgtgagctaagaatcagagaattttttttttcagatatttgattgcgttggtgctagtatcttcctgctatctcgggcacgctatttgccgatctgttatgaatttatgatcctggtttggaatagtttaaatattcaaacataatttgttaaaatctatttgtttcaaaacattggaatcgggagcaaaacacctagtgcttttaattccttaggcctttgtccttttgtacggttctttcttttttatacatgtaacttttacttctcctatattcaataaaattagcacatgttcgttcaaaaaaaatattggaatatgctgatctacagtattctggctgtcatttcatttcgttgcataacaatattcctcctccttttttgactatagttgtagagtactacacgttggtgaaccgaactcagttctgaataccagaatcttttcttgttggattcatccaggttaagtaaaaatctaattaatcctcatgttctagtctagaacttgagcagaatgaaactatctccttaattcgcctctatttcaatctgatttgcaggtggtgactaattaaacttggcaaactgacaggggttcaattgttcatccatctcacctagctacatgcatgcatccagcaaaatcaaccgaataactaattaatctaccattcaaatatatatcacaaatcacaaaggcacatattgatcgaaacttaattagaaagaatctgctagatgtagtagaggaaggcagccaaggaagactcccacgcaagaaacgcacacagcagctgcttgcaagcgaagtcccggcaggcatccggcaactcatcatcattaacaacaggagatcgagaagagataaatctaccaagaaattaagactcaagaagagattggatattacttacctccaccacgaatcgatcgaatcctacatgcaacagcagggatggagctacgccgaagacgaagaggaagaagagcaggaggtagcttcagcggccgccattggcgagagggcaggagggttttattctggcgggcatcgcatatgtgcgagattgcgagagtggaggaggaggacgagtggaggtggaggtggcgcgcggctgcgcggtgcgcttcttttttttttctttttttgttcccgccgcaaccaaaggagacaagcaaaggaagcaagcaaaagaaaaaaagcccgggaatttacctggcgggaatgccctacttggcagcgccgcccgtctctctccacaaacgccctgcgtggtctctcgttagacttgtgcccttgtccatgcataaatagatagataaatagataaaatcttttttttactgttcttgggaattgggagatgtgaggtcctatatcctctgcggttaccacacacgcatagtacgtggtgtttgtgtacataaccaaatgaagtatgtgtgctgatttcttcttgtgcctggggacatcagtttagacattttggacgttttctaactgggtgattttggattggatagattatgaaaccgaggaaaattgagctaacaaatggttcgtgggaaattgtctaagccaatactgaagtagaaagttcttttttaaaaaaaatcataaataatccatcgaaagtcaccgtttcgattatgctgatcataacaaccaaaaaatagtttataaatgaaaattttatgtgagtttttttatcagttcaaaagcaaatactgaaaaataaacaaactataattgagaaaaaaatcaagtccaaaaataagctttaaattttaaaatttaacagtgacttgtaagcggaaaagtaaactacgggagtgcatacctctattaactgtttagagcgtgccatttgtctgagtcatcaaactcatgatccatggttacatcatagagcaaaattcgggggttatttgacactgttgtttccacttatttactgcgagagagatatttactttgggtattacgacgattaaatccatcaagattaattcaagacaaaatacattacctaatactaacaaataaataacaaaaagatcctggcatttaccaactttcaggtatccttaccaaattatcctgacgatgttgggttggacagaatggttggctggacgaacagccaaactgcaccccagcctctaccagctcttgtacatacctgccacaacagtagaagatttttccaatccttgtcacgtacatgtacgcatgcatacaaattacaaaatctttgggagcctttcttgtgtggctctcttttgcagcacaaggtgaaccacacttgaattgatccctgcctgagaaatttcacacgaaaacagagagcattcaaaattttctcgggtgttccaaacacgaatattgagctactttgtgataatgccatgccctcctcactcagtatgaaaaaatctcacagactataactattcatctcccagagcatcatataaataggacctcgtcaaattttgcaccgtagaaattagaaatacaattttttagtgccgggcaagcaaaagagttgtgttcggctctaatgggttaagcaacggctaataagtgctataaaattgaacagagtaataaaaataatttatatgtcatccaaccaatactgaaaaatagaccacaataaaaataaacccctaaaatcaactaaaagttatgttttaaaaattaaattttagttgcgactaataagctaaccagcggacgaagacaagcttcgtatttacattatttttttctccgtggaatggactgaaaaaatacgagatacttcctccagaaaaacaggcaaatgaagtatcaccattcaccagtcagtgtatatatacatcctgtgcacacatgtctcatctcactcacccaatgaatctctctgtcgacaaattgccatcacaaaacgaatgaaaaagagatactatatgccatgctatcctatcttgcagccaaccagatactactactactacaacaacaacatggctagccagctatcctggagtagaagcagcacaagacagacactaatggcgtgagctgaaccgttttctcgttgatgcttgtcgggtaaagccggtgaggcttgcaaaccaagttgacccaacctgacctgacccctgcagaaagctacagccaaagcaagcaagcagaaattcagaagagattcaggaggccagccagccagccagccactgaagaagctgtagctgctgctgctgctgctagtgccaatccttatggtccatgagcaagcaagcaacaaccatcacttgcaaggaacaagaatcgtcacacacacgcagcaacaataacaaaagcttctcttcccttctcttgcttgcccttttggaccacgttgttcctcaacacgtcaaaggaatgtctccttgatctgctgcaaaatgcagtttgttctagtttattgattttacaagggaacaacagttagtttgaccccttggaaaagagggggtggataaatggaggtagagggtgctatctgctttgactatcacttggttgttaccacatcagatgtgcgagtgcggttagttggtgcagacacactcacacacaccccacgaatgcgtcccctgcacacgcaggctctgttcgttcctaggttcccaccgccctaccctcgttttccgcgcgcacgtttttcaaactactaaacggtgtgtgtttttgcaaaaagtatctatacgaaagttgcttaaaaaaatcatattaatctattttttaaaaaaaaattagctaatacttaattaaccacatgttaatacgaacatcgttttatgtgccaaggagcaacccctcctcccgaacagaggctaaggacgtgtttggatggtgccctgacctgagcgctctcactcagacaggtgcatccaaccacatgccaccaaaatcggacgcctgagaatcgtgcctgactcaggcgtgattctcagggtgtgaagcaaacaggccataaatctacaaggatgcgggcgggtgccagcttttccactttttactactactagctaccaagagaggcaattttgcctatgtatgcatgtgttgagtgttgagccaggaagttagctatattctggctctttccaactggcagagacaaatcttgaatctaaatttgataacccatggagtgttaaactagttaaccttgtttgtgtaagactaggattgatactcaaaaatattctaacaagaaaaacttggaaaaaacatgaagcatccatgagagttgagttgagaccatgagtcatctcccacaaaccggagaaggcgaggccaagttcaactctaacaatgctgactagtagtacacaagaatttggctcagattcgcacctagggtccaaaacaccgtgagtcattttatttggcccatatgacagaggaaaaaaaaaacacaggacttcaacaaatcccagtccctcaaatgggaattcaggccgatgtttgtcggcaaaatgatgattttcatgatcagattcagatcaaaagttcgtgcacaggatgtgattattatttcaaaacagaattcaacttttgttgtttcagacacttgacatattcttttagacaaccaattctgactaatattcgtttataaaaaatcagtaaatgttcttcgtcttttattattgatgttaatacagagtattcagagtttcagttaccatgaacagctccgatgggggcggcgtcggtgaagaacgcagcatccaggtgcatgtggaagacgagatgaactcgccggcgcacatacggcggcggcggcggaggctgaccgtggcgggaggagcaggaactcgcggagtcgcctcgcctcgggttccggcaccgaggctggggttcgtcacttcgtctaggagaggagagaagtttgtggttcatccagacgctccaccgcgagcccatccgcggcggccgtcgccggcggaagagctctagcggcggcggcgccgtcaccggagggaaggaagaaaggaggggcctatttggtagcgatcctaaacaacagggaccgaattgcaaaatgtttcggcccaatgggcctcgcaacgaccattcgagttgggccctaattgggccgcaataggctggactcctcgaagggcaaagcctaattaatttcccgtagttttggactaatcaccttcattagctgtagaacaaacctgtgtaagcggcaatctcggcggtgagatgcaaggatcgaatcaaacaagtggagtgcatgttcatggggaaatgggagacagtagaagaatcaagaatagtaggtatagtggattgatcactattggcatactgttatcaaagtgattgattcagtagcttcctttttatcctcttcagttcttcggccaacttgaaaggctccactgaactctgatgcaacagtgtatgcccaccgtccaatttcgattctcacttgttgtcttcacatttttaaaatttgtaggtctttgagagaacattcaaattcggtggcttgtgtcggttgctgttaactgtatgaacatttctggtagggttacacccttgttttaaagaaatcaaattcggtggcaaacatatggggatgggagggcctatttttaaactttgttttaaaaaatcaaattcagatatcttgagtataatttttataaaaaaaagagagaaaactaggggaacacagtagaagaacaggcgtgctagcagctaaagtagtgaaaaggtgcacataacggtcatctcggacacaaagcaagcgagatcagattcatcatcttcacttttttcacctcaaaagaaccaaaggctgaccaaccagtgtgtgtgtgtagtgccactaatcaccacagcttccaggagtaactaatttttaatcttaaccaaagccagtctcccagtcccaaaggcaaaagttaaacaacattataatcacaagctcttttcacttttcagcaagtcatggtttgcttaaacagttctgtattattatttggactgagaatctcgggctgtcatcctctgcttcttctgataccggcagatgttccaaccaagtgactaaccaatcaatgaacttaatcaaaagattattctagtaagtacttggttaacactgttagtctccagtgaacttcacatgttcacagtgcatgagagttcatctcttgcagacctgcagtgttaaacataatgatagtaaccagcaggaacccttctagaacaattctacatgagaaaatgttattggaacagatcatatttctggctggattcttcagaagcaagcaagcacatggcaagaaagccaggatatctgcacctcgactatgccttaatcaagacagagaccctggaaaccctaaagaaagtttgcaccatcctcacatacttttgtggctttgagagattctcttaagtgcatttacaaaagttaatttgaattttgcagttgtagtttcaccattctgctagcattctacataaaagatttgattaaccatttaggtagtgttttgagattttttgtggttggttttagagataaaaattcttcaaccattctagatatgcacattcttaaaaatgccaatcacaaactgctaaactagacagaaagtcagtatgagacagaattcaatcagaagccattgaaaattcagagacagagcatgtggctcccctattattcaggttgatggaatgtatagaaagcaggtcaaagtataaaatgacaagcaaaaccagaacatgtttcttttaatctttatactctgcaaagtgggtaaccactagcagcaattcacatcacaaaacagaaaagagcaggaggaaaagaaagaaggcaattgatcaaactagaggattacaacactagcaagtagagaacaaatccaatccaacacataagaagaacaactctcaagaatccatactaaataataataagaattgaatagccagaagtaattgtgatacagcaggaagaaatgacacagaatccttttgttctaaaacttatgtcttactactactgaatttaactgaactgaactcatgattctcatctatacaaccacatatatccctgcacctacaatcctctgccaaaccctcctgtccctctcaaacttttccttattattcacaacccaattagccatcaatcatatgttcccaaatcctccaaatccccacacccccaccacttcccaatccctttcaacaccacagcaacacaaactgtttcgatgctgacgccgacaaatcataaccaaacaaaattttgtgcaccttactacgctcttcacgccggtagtcatcaatcaaccaaccaagaacactagtagctaataagaacgataatgaccacgtatacttgtgtgcgacttccgctgctgtcgatttgccggatgtgaggagcaagagcggaacacatgcatgtttccaaacattcttcggagaaattctatcaatgcagcgggggaggaggtggtgatccatatggtacgctgtggatcggtggccatgagctgtggtgttgcagagggggaggtggtggtgagccatatggtactccatggacaggtggccatggcccggggtagtaaggtggtggtggtggtggtgacaatgctggtgttgcgccgccgcagggtggcggcggcggtggtggtggcggcagctccggacatggcggatgcggttgtggcgcgggtggtggcggcggcggcggcggctgcggtgggtggaagattggtgcaggcggtggaggcgatggtggcggtggagatggcggtggtggtgaaggcggaggcggtgatgtcgacggtggcggtggggatggcggcggcggcgaaggcgccgccggtgatggtggtggcggcgatggtggcggcaggcccgggacgaacggcttgcactggaacgcggcgcagttgacgggagggcgcgcgaagaacgcggcgcactgccgcagcgtccgctgggcggggcggttgggcaggcagttcctccggtcgccgtagcgcggcacggcgtgcgcgcaggacggcggctcgccggtgaagaagttgtacgcgaaggtgaagttcttgaggcgcggcagctcgcacaccgcctgcggtatcgcccccgtgagcaggttgtgcgcgacgtcgagctgctccaccttcctcatcccggccaccgccgacggcagcgggccggcgagccggttgaagctcacgtcgaacaccgtcacctctcgcagcatcccgacctccggcggcaggcaggagctgaggcccgtgttgatgagcaagatctcgttgagcgtcccggacatgttgccgaggctcgccgggaggcagccgccgaagctgttgtgcgcgaggacgatgacggagaccggcgagttgccgaagttgtccgggaggtcgaagcggaagcggttgtggttgaggaagatggcgtcgagcggccggtcgaacagctggcggggcaccccgccctcgaagtcgttgaagcggaggtcgaggaaccggagcgcgggcatgtc

SEQ ID NO: 88132 - DNA, 3308 bp, Oryza sativa
gtgcagaacgtcgaaggcagaggttccggagacctgctctcccgatcgccggtgcacgccggcgagcgggatggagtagtctacgagcgacggcgcagtacagagtaggaggcaaaccctagattgattttttgcgtatgttgcgtgaagacggcaggtcggtttatatagagaagggtcgcttgatcagggcgccggactccacgccgtttgcacgcaccggatctttcggaacgtttccaaaacaaaaacgaatccgaatttgcaacaaaacaaaactgcaaaaggaggctgcatctgcgcaagggtgaggagccaatttttcggaccattcgacgcgtacgtcgtgcacgcgcgccgcctgccctgccctgccctgcccggcccggccaggcgaggcgagcgagcgcgcgcgtgtgtttcccctcttctctccaccacacatgcttcaagcgactaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctctgcaggacaacatctttgctaattaaagccaacagaactcattaaggcatagccaacctgccttgcagctcacgagagtatatgcatcttcacttggagagggtatatatattggtactctcctctagtttattaatggtttgttcttcccaggatctaattcacgggatctccgatcacatagactgggttaccaccatagtataactcacatgggtctcaaacacatctccttcgatgcattgtctatcacatttcgtgatagtcccttcgtgaagggatctgccaggtttctcactgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccagtttttcaacaacaggcagatccattaatagatcacgcagccattctgcctcaacagtagcagtatccagtgccgttaactctgcttccatggttgacctcgtcaaaatggtctgtttgcaagacctccatgaaacagcaccaccacccagtgtgaaaacatatctactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcacagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagttccgttagcgataatggaatccatttcactacggacagcctccttccagtagtctgcatcaggagatgcatatgcttctgaaattgacttaggagtgtcatccacgaggtacacagtgaaatcatcaccaaaagatttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaagatagaatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgacttttgccaagcacccccatgtgcgcaaataagaaagtgatggttttctaccaatccatatctcatatggtgttttgtccttatttctgttaggaactctgtttgacacatgatttgaggtcaacaatgcctccccccaccatgccttaggcagtcccgcggtgtccaacatggcattcaccaagtcagtcagtgtgcgattcttcctttcagcaatcccatt

SEQ ID NO: 88133 - DNA, 768 bp, Oryza sativa
gcgtcgaggagcccgacgtcgccgctggaccccaaggcgctcctgctccggtcgccgcggtcgccgaggacgtggtgggacgccgagccggtcggcctcgccctcgccgccgccgccgacgacgacgccgccaagaactgcctcctcctcagcccgcgcgtcgggccgctgaagtcgttcgcctcgctgcccaaggactgcggcggcgggcactcgccgcgcccgggggagctcgccaaggcgatgtcctgcgccgcggcggccaccgccaccgcctccgccgccggcggtatgtccgtgccgtgcggcgtgttcttctacggggatctgaagtctggtccggaggccactcgatccggtggcgctcaccccaatgccaagcgccgctccttcgatctcggcggcggcaagatccctgggccgggctctctgccggcgtcgatcggcggcgtccggcggttcatcggctcggtctcggcgagcgagatcgagcagtcggaggactacacctgcatcatcgctcgcggccctaatcccaagacgacccacatatttggggactgcatcttggagccccagacgatggacgcctccgcctccgccgccgccatggatgtgacggaagcacccaccgagtcctactgggtggtgaagtgcgacgccggcgccgccccggcctccggcggcggcgacttcttgagctcctgcttcacttgcaagaagaagctggagggaaatgacatttacatttaccggtatgtagttgca

SEQ ID NO: 88134 - DNA, 552 bp, Oryza sativa
tgctgaacttttaattgaagcttcgcttattatatgggatgaggctccgatgacacataggcgatgttttgaagcgttggatcggactttacgtgatatcctttctcaaacgtgtgctacaaattctattataccttttggaggaaaacccgtcgttctaggtggtgatttcagacagaattgccagttgttcctaaaggttcccgccatgctatagtcaatgcatcaatctcaaattcagatctatggaaacatgtaacagttttaacgatgaatataaatatgaggctacttaacacaaacctagagcaaaagcaaaaagatgagctgcatgcctttagtaagtgggttttagctattggtaatggcacaatacctatgaccacgaaggaaggtgaaagctatccatcatggatcgaaattcctcatgacttacttattataactgatggtgataaaatatctgctattgtgaatgaagtgtattgtgatttttttgcatcatacatgaatcctgaatacttagcttctcgtgcaattgtttgtcctaac

SEQ ID NO: 88135 - DNA, 3044 bp, Oryza sativa
gacccagatgtaaaaagtacggccaaaagatttttctatgttatgttaataataaataaagaagtatgtattggtgaaacttgttaatattgttataaaaatgtattgaagttggttgttgcgcaatttcatatgttaagtgaggtattattttgtaccttattcgacgtattagtactcggataatttatataggcctatcgcagtctggatcgtagaaacattatatggacttaaacaagaagaattatgtaacatgaagaaatagtagtataatttgaacatgatacaactatttgcattgcggttacatagatgatattagattcgaactaggagggaggtagtgcaatagttgaacagaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtggttcaagctgcacaacacggctaggtggagttagaacccttctggtgtctatccattctctgtacatctccttggtggttcctgggaggaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaacgaagaacctgacaacgatcaccacacctgcatcttggatgggcttcccatggagggagtgccgtagttagcacccgctagtcgctctgttgttcacgacattgtcgttcataagccgcttttctctgtaagtattgctcagtactttcggatgcgaaataccagcgaccttcttgtaaacaagtggttaggtcgagaacgggattttctgtatcaacccactcgatgtatgcgcaagctgtagtgcgggtctgccgaatagagtagtgttacgaagaataaagcgattgcccatacgaaatgaataagcatatgtagataataaaatacctcacgttcatagttagggcacctaaaaaagcgccttcctcgaatatcagtattcctcgaagccattagttggcatcgatcaccgcataggcagagaggacgctggcaccatggtggtagtaggtatacataaggatcgctacgccagtttggatcctcaacaccccggcgtctagccattgatgaatgccggtcagatttgtaatgaagcaagtggggaagagagtactgaatgtgactgagttctgaaagattgtgaggcctcactcgttaaggcgacttatataggcgcaaaaaattgagtgatacccctgacatgtgaacgtggtggggtatggtgggtacgcctgattggcgccgaaagttacatgcctgattagcgccgaaagttacattggtcgtatgcaccaaatggcgggcaaatactcgtatcgcacgcgaataaaggaggctgcatcagtgcggcagaaagtagtcgtgcatgcgccgaaaggtatcgtgcatgcgcgaaagttatcgtgcacatataacaacaacgtagtcattacacaagcatacattactggaaagtgaagcaaataaacaaagagaagactgctctactggccctgccccgcgccgcgaccacgcttggtcctccgggcctgtgctcgcacgtggtcctaggagtaggtgaaacgatccggtggcacagcatgggtagcacgagtgtcccgcggaggagtggcctgcgcctgtcctgcgtctgcactgggggtgcacctcccagctgtgaggggccgatgacgtcctctgtcgagcctgaagcgaagtcgaagtcagtgatgtcgaagagcaaggtggaaggcagcaagcggtccgacgaggtcccagcacggtccagtggtggaccttgactcgacgtgccggctgcctgtgacgaagtctcggtgtactgccagaattgcgctgagtgcgaggtcgacgcagcttcctgagacgctgaccctgcagcctgggagaagtgggcggcctgcgtcatagcgaactgggcgaaacctacacatcgacaatgggacccttgtaagctaagacataaaatgcatgtaaattgattgtcgaagtaatgttgtttttttaagtacctgtggggggcacaacagaaggcctagccgaggaaggcggggtgctgaacggtgcacgaaaccctgaagcaatcggcaagtgaaacggctcacttatatgtgcgaggcatgtacagaaatagtaataaaaatacttacctccgtgcggaaggggagtcggcctaggaacatgcgcagctagatggggaccagtcggtatgggtggccgctgtatagctgcgtctgcccgagcaacgtcgtctgcacgacaggtgagcactcggagaatcgagcgcattgactccaccatccgcgtgtacgtcgtcaggtgctcctctacgggtaccggaatccccgcgcctaaacgttggatcatcgttgaaccgtcaacgacgacccggttgatgtcgttgacctgcatggttaatttgttcgtaaatattcgtaaaatttgacgaagagaaagacatgaaaacataaaggaatggtgcgatgcagggtactcacagcacgagcgaagtcctggtcgcggttcctggcgtagaggtctctagtgctcgcaacgtggggctgctgctccaagggagcgaaggtgaccctagtacgggtgcgtggctggtaccagcgtaggtaggcctggtacgcctcctcagtgtgtggctctccctcatggtccacgacctcctcggttgcgagcaaccagtcctcaataaaagtcgccaacttggcgggccagtcgccagctgactgctgacccttgcgcgagtacctgcgaattaatgtgtaatattagtgtgaatcgacagatgttacaaattattgtgaacaggtagattttaatgcaacaatggaaagagtagtaaagggggcag

SEQ ID NO: 88136 - DNA, 1082 bp, Oryza sativa
  unsure (1)..(1082): unsure at all n locations
cttctacgcccacctcgccaagcttgccggcgtccccgacggcgtgctcaacgtcgtccccggcttcggccccaccgccggcgccgctatctcctcccacatggacattgacaaggtcagattacctacttgccattatgaatttctgaattccgattgattatgctttttttttagataatggattatattaacccggcctctacaccttagaaggtgtacacagcccaaaccacaatcaagagtacataagactccatctattacacgaggataccaaataaaagtttaacaaaacggttaaagaagaacaacagtctaagcctgatggttttcacttttcaggtgagcttcaccggctcgacggaggtcggccggctggtgatggaggcggcggcgaagagcaacctgaagcccgtcnnnnnnnnnnnnnnnnnnnnnnnnnnnnnnnnnnnnnnnnnnnnnnnnnnnnnnnnnnnnnnnnnnaacctggtccacatggcctcctacaccaacaaggtcggcctctcaccggccatgtcgtcagaaaaccatctagctggcataagcacaacatattgtgaaaatctcatcagctttccacaacaatcctgttctgttgcagggtgagatctgcgtcgccggctcgcgaatctatgtccaggaggggatctacgatgcgttcgtgaagaaggcgaccgagatggccaagaaatcggtggtcggagatccgttcaacccgcgagttcatcaaggccctcaggtatatatatatgctagatcagtaaccatgctctgatttttcaactatacaaacttcagattcagagaaccaaagatgttcagcaagctgtaataaccacttgtgtgcaattacaacgaagattgacaaggagcaatacgagaagatcctcaagtacatcgacatcggtaagcgcgaaggcgcgacgttggtcaccggagggaagccctgcggcgaaaacgggtactacatcgagcccaccatcttcacggacgtcaaggcatgaacatgaccagtgtgctcttcactcctcagtgctaaaatatgaccagcagcattt

SEQ ID NO: 88137 - DNA, 5378 bp, Oryza sativa
ccatttttgatgattcactttctgctgatgcttacctcaatgttctctacatgccatccacattcccacgatctgagaggtccaggcaatcgaaaggtcctatggacagccagtttgaatctgttggttcatacctagaagatggtcctcgcagcaaccttgatggaatccgatatgccgagtgtattcattacttgcaagaagtaagatttatacccccaactgtattcctattcttctttcgctagcatactgcccacatggtgcatagatctcaaataaatatactgttagttcttaaaaagtgcaaaagaaaaaaataatccaaaccccaaatctgtacacaacatttacatcagtgatcttacaaataacacagagacgagatcttttgaattgagaagttaggggtgtaggcataccatcaccacaactcctttaggctgtgtttggaaccctgggttcccaacccctctccatcgtattccgcgcgcacgcttttcaaactactaaacggtgcgttttttgcaaaaagtttctatatgaaagttgcttaaaaaaatcatattgatccatttttgaaaaatataactattacttaattaatcactcgctaatgtaccgctccattttctgtgcgaactgtgcttgttgggaacagatgcttctgaacacagccttaagtctactggattatcctagctcagctgcttaaaagttatagtggctgttactgtatgcacctgaattgtattcctcatgtcctgttcactactggggtgatcaaattcatacaagatctcggcagctaaagccacaaccctgaactatttttcaagttttggttcacaattggcacagctccttttagatgcattttagaaattggataatctatttaatattttgtcaatttaaagcaattaatggttttttttcggggattcttgcagtatgctcgaccagaaatgcttgctttcatgttcaggcatggtcattatgcagaagcgtgctccctgttctttccatcaaatcaaccaactgatgaaggggaaacatctttgtcttcaattccgcgaaatgatcctttgacaactgattatgggacaatagatgacttgtgtgatctgtgtcttggatatggtgctatgactgttttggagaacacaatcttgacaattactcagtcacccacatatcagggctcagctatgactcagtacatgaatgctatcctcactcgcatttgcaactattgtgaaacacatcggcattttaattacctctacaactttctggtactgctaacaaatttcccttcgaattattcatgtggaatacactgattttgtgccaagtgttagttacactgatgtggtgtatcaggttctaaaaggtgaccatgttgcttctggactttgctgtattcaattgtacgttaattcaatgtctcaagaggaggccttgaagcatttgggacatgccaaggtacacttctatcatatctttatagcataacatgcttgtggtatctatgaatgattgcacaattgtgagttgtgcaatccttgcattgttattgctagaggtctggagcatatgcatcttgtctagcctactcagggaagcaggatcttcgtaaaccagcattagcaaaagattaagtgacaactaccactctcttatgaatgggagggtagagtacccaatgatactagtagtattatctagttatgaattatattaaccaattttgacattctttaaattattagatgctgctgcccatgggcatcatgagttctgacctgccagttgaccacttggcttgtgctgttgttggtcccgtggcccttgttcatgcaaaacatggatatgcttggatttaattggcctaatctctgtttctaactctaccgtatcacacaattgctagtttgtttatgaggatcattggtctagctgaaatttaataacagaataagcttcatttatgagaatgatttctccacatgtccatacagttgtggccttgtgggtacatatgctatcaccacccaaatgtcttgatagccaatattgttgcaaacttccaactttcaaaccaaacaacccctattccgttcatcccaatgccctagcacaagacttgaagcactttggataggtagcatagaccatgtacctgaatattcatgccatctgcttcattttgtgttattttggaattgaccaagaaaatcacttatattatggtcatagttgcagaaaaactcaggtttcttggtgagtggtagttacccaattcatttatgcttcaactaaaacattcatcttgcaccttgggatttagtaaaccagaactacctctttagctttttggcttccatttactactccctccgtttcacaatgtaagactttctagcatttgcccacattcataaagatgtgaatgaatctaaatatttatatatgtctagattcattaacatccatatgaatatgagcaatgctagaaagtcttacattgtgaaacggaggaagtattttttaacaacccttgaccaaatttcaacttgttaccatcaaaatgcatgatatgaaactctgactattttgctcgtatatattcatcagagttagcaaaggcactctgaagagtaaaattgttttggtggggtttaacaccttatgaccataaaacctgggttaagtgacactaaccaagaaacctagttatttgtgcagctacagccatgaaacaaatgttttgaagtttactgtaacaaataatggtgaacatgtgtttgcataatatactttgttgggtagattgtggtaccataatacaatagttatgttgccataattttctgtgttgatgcaacttgctcatcacacagtgacacggatggctgctgtaaataaaaacatttttgttaaatatggacctgggttcattttatttggagctctattgtattgtaaaataaacaaataatgatttaactgtgtttttcttatgctgggcattcttatgaatgcagtcacattttgaggaagccttatcagtgcgagatagaacaactgaggctacaaagctggtaccaagaactgctcgcaataagagtgcatcagaaaaaatgactcgagaaatgataatgaaattttctactagggtgtcctatcaggtgaggaaattatcgaaacagataaaatttctttgtcaagcattcattatttgtttttttatcaatacatgtatatatatatatatatatatatatatatatatatatatatatatatatatatatatataacccagcatgactattatttgtacttcctccatcccaaaatatagctacttttctggttcaaatttgaactgcgaaggtagttatattttgggacagagggagtagctatgtagtaattttgtatctgcaatgttagatctaaatcagctaagatatttttacatgatcgattgtagatggatgtagtgaaggccctcaatagtgtagatggtccacagtggaaaacttccctttttgggaatccaactgatgctgaaactctgaggtttgtatcacttctttgcttgtgaaggtcgattcccttttaactgctcttggaggaggtcaaattatcaacacattactatctaagcgaaatgtgcctcttggactatcgctactatcacatgataaagtttaatttacatttttcacttcatgatttagttttatcatgctattattgagctattttaagtgtaatactgtaatggcagaaccgtcgacatagtttccctgttagtgcttcaaatggttgagaggcactaaaagtgattatgccgagtttgttcttttcattatttatttgttttttgtatcaaggtttctgtagacattcgctgggactaaactgctttctatgttatctttatgacaacatttagttagatttcatcacctgttgacttgtctttcatattattatattacaggcggaggtgcatggttgttgaaacgttggctgagaagcattttgatttagcttttcggatgcttcatgagtttgatctccctggtacttattgaaatcaatatttgctcctaattttgtggaattaatattccaagatatgcttatcgtggacatggaatctacacactcaagtactttccatttctttacagctgttgatatatatgctggtgtggcagcatcccttgcagaaagaaaaaaaggtggccaattgactgagtttttgaagaacataagaggaaccatagatgatgatgaatgggatcaggtaacatttactccgtagtctttttctgcagccttcagctttgattacatgccaagacttggaaagaatattcttggagcagaatatattggccatgatagaatcttttgaattatgtgttctccttgttaatcagcttgccagatgatgctggctagtttttagtcctatatcaaaattcacgttgttcatatgtaattattgtctagggttcacaaatttgatagaatgctatgtatatgcttcctaaaaaaagagtatcatatgaatgctaactcttcctatcaaattctatttcctatattgcaggatgaatttgtttcatcaggtgttcaactatttaacatgttactgatgttcagtcaacatatgcttaaagccttggacatgctttgcatacttatggtccttgacagaacaaatgtgctttatcattagcccaatatgtgatgcccattgtttagtagatctattcgtgtgtgaggatagtttatttgattgctctgctgatatatttgttcacttgcttttaataggttctgggggctgctataaatgtttacgctaataagcacaaagaaagaccagatcgccttatcgacatgttactcagcaaccacaggtatcagttgttcactacataggaaagatactcaaatgtgccactttattgtcatgatggaacttaaccttaatttcctcctgccttggcttctttagtactacaaattactttatggttctgctgatgtggtattttaattattatattatctggagttacaggctagtgttataatcacccaaatagtaatttggtttggtaccaaaatcattagacaccaacagcttactatgcagactagtaggcattcaatcataggagtttctatgagacatgccccccccccccccccttggcatgaattactttacaagacctgtgcactataccgccctcaataaattaactaacaatttttatttggggtacaaaccattgtcaatacttaccaacattcagcgaatggcttgtaccctgattcttttg

SEQ ID NO: 88138 - DNA, 8057 bp, Oryza sativa
  unsure (1)..(8057): unsure at all n locations
ttgatgtttacagtggtacagtagttcatcaaggctacaagtttgttatctgaaatatttccaggaagctccccaaaagtaggtccaaattattgggatcagattcaagaagttgctctcatatcagtgataaaacgcatccttcagcgtctacgtgacatcttggatctggtgagcttttgttttatttgtaaccacttgtagacattactgggttgtttaaaatcaaaccgtcctaagatgagtaccaccatgtgctgagttgctgatctcatggtttttgaatgaatgtctaggacttcttcttgttttgcttcctcagttatttcctgggtgaagtattacactgctaggagtacaaatgcattacttgtaataagggttccctcagcttttccatgattttttccctcgaaaatgcaggagagctgcatttcatttcattaaggggaagaaaaacaacacaaaaacacaaaaacgcaggagagctttttccatgcttattagcacagtcaatgtcaagctgtttctttataagaatactatgcattgattatgtctgcaacttttaatttggttattgaaccaaagcagatgtgatattcctactattgcatgcttaataaagcaaaacatctatgcatttttttagggttaattggatccatgccattataacaaaaattagaatgacatatcttttggtctcatctaggagggctatccatatcttcaattagtttttaccgagatgaatgcctcctcatcaactgaatctagcagagttggacaaaagcaacgtcctcttgggcttctgcaccaaatgattgatgatgctttcaaaggaaagcgacaattcttaaatggtaattttttctactttattcggttgagcggtaagtctgttttctgtgatgttctaatagcatttctgaacaaatctttcaggtaagcttcacaatgttgcaagagctattgttgatgaggactctgatggtacttattcaaaggagagtatcaagatagaaaagagagatattttgagctctgaaaaaggaataatccttggtcatggacttagaatcctaaagcaagcatctaggactgaccaaacagcgtcaactgttgttgaaaacaatgcagagcacaaaggatctactagcagatacctgggtcctgtatccactaagccatcaacatatttatcaaatttcataatatatattgcaaccattggtgacatagtggatggaactgatacgactcatgatttcaactacttctccttagtctatgaaaggcccaaagatgtaagccatttacaattttacatatcatgttctgaagtcagatcaaatctatacattttcacttttaatgtttttccttctttgtactggaaacttgaaatgatagtccttaccaaaagtttccccatttaggattatgtttaattggctggcgtttttattaaggcctgtttgattcagttcccgtatcaatacatacttaactcattgggcttctgccttctattttctttaagtgacaatattttgtgatagaaaatcttgctgttaagaccatccataaatttctgtgttttcttgtattttgttttgagatctctttggcctcagagctaatgtggaacctggaattcataatgttaatgtaaatagatattagttgttaggtgtccctggaatatcttttacaagtttttgtgattaaatgtttaaatattatctccgtgccaaatatagctacttctgggttatgtacatagccagaagttgttatattttggggtggagatagtatatttagttgaacatagcagtgtccgattctgtttcctatgattttgtctgacctaaatttttattcaaagtgcttcaaccatgatggtttatatttgatttatttcaacatcctttatagtttcaccttaaaagttggggataaaacttggtaagaaatcatgcccacatgaggatatgccaatgataacattaataagggcatggtatatttgtctatgaagtgaatcctttttagaaacagggggtaactaatgttcaatgtgggcctatttcattattctgatgtgaaacctggtattgatttgtatgaactcaattactgctcttttggcagcattctgacccaccaaacactttccttgtttctattatgttaatttctatgtggctcaaaaacttaggagccatataaatttgtttcagcatgcagcttttagtcatataacatgtgttttggcatgcagcttttaactcgtcttgtttttgagcgcggaagcactgatgcagctgcaaaagtagctgatacaatgggtgtagactttgtgcatgagatcatatctgcttgtgtgccacctgtttttcctccacgcacaggacaaggatgggcttgcattcctcttttacctaccctttctaaaattaattcggaaaacagatcacaatctgctcaaggatggagtgcgcacgattcatcattgtcttctcgtcaggagcccctttatcctcttcaattaaatttagttaaacatttggcacagttgtcatcagttagagcagttttggcatgtgtgttcggaagtagcatactatctggtgacagtgaattatgttccaatgtaaaagatgcaaaacaagcccctgaaatcaagaggtcattctatgaatttgctcttgagcaatcagaaaggtactgaactactgattagtcatttaaatgattatatttaactttacttttgtaattgactaagttctttacaggtacccaacattgaaccgttggatacagatgcagtgtaaccttcatcgagtatctgaatctgctgtatcagctgaaactgacaatgaagtcaccttgcatcagcccaagggaaagttttcttcgaagcgagcccgtgaacctgacagtgatgccgaatcggagattgaagatattgtcataagcgggaaatccacttcaaattcactagaatctcctaagtgtgatgaggctaaattagagccaacaacttttatttcatttgactgggataatgaaggaccatatgagaaagcagttgaaaggtaacacatcatttgtatgccactccttctgctacttggaaaggttgtttgagtagtttgaatctgatgactgtggttactttgtttttgcaggctaattaatgaaggaaaactgactgatgctcttgctttatctgaccgctgtttgcgcaatggagcttctgataaattgcttcaactgctcattgaacaaagggaagaaataagtttaggggccagacagtcccgtgcatatggatctcataattttgggagtgatacatggcagtattgcttgaggctgagagataagaaactggcagctcaacttgctctgaagtatgataagacattttagtttgaacctttcattgttgcgatgaaacttctgatttatacgcatattttgagttttagtgtctctgatacacatgcaatttgtgtgcattatcatgctaccatcttctgttatccagatgtgcttattgagttatttattgcatatgaacactggcaggtacctgcacaattgggatcttgatgctgcagcaaatgttttaactctgtgcatctgccacttacctgagaatgatccaatgtggagtgaggtagccagatttgcatctaattgcatcttaagtttgtacattatcttcaaaggtcatactgtatctcgtgattgctcaccatgattttgttttgtctaaaaaaatcatgattttaaacatgcatggcacattgccacctttgacatatgcctacccaagctaacactaggaatggcttactggcttcttgccaaactgcttagcatttcatgtacaatatgcacttgaatgattacatttttgtgggcaaatttttcaatgataaatgcccaaatctgtctgaagtttgagctttatagatcttgtttagcattgtttgcttgttaaatctctgcctttttatttgtacaggtgctacgcatgaagcaatctttgcaacgctatggtcatattatgactgcagatgaccattacaccagatggcaagaggtaacccaatcaaatgtgcacaaaatactgactaagccaaccctcctcccattttttttaaaaattattcaaatgcaacaagcataggcttcagccttttctcctcaacttgttaagtgtgttcatcataaaatttctgaccattgctgaaattattaggtcgaagttgattgtgaagatgatccagaaggtttagcacttcgacttgctgccaaaggagctgtttctgctgctttagaggttgctgaaagtgcctctttatcaattgatttgcggagggaactgcaaggccggcaattggtcaaacttctaaccactgatccactgaatggcggagggccagctgcagcttcgcggtttctgtcaaccttgcgagattccaatgatgctctccctgttgccattggtgccatgaagcttctacctgacctgcgctcaaagcagcttcttgtatgttggcagatgtgacacataagtcaagtgtggtaaagctttcctttcagtgattaaattgaaatcgattaatgtactttcaggtacacttttttcttaagcgtacagttgggaatctgtcagatgatgatgttgcacgacttaattcatgggccttaggtctccgggttctgtccttattgccattgccatcacaacagcgttgctcttctctgcatgaacatcctcagttgatcctggaagtattattgatgatgaagcaactccagtctgcttctttggtattgcattgcatctcaactgattttttgtacttcttgactcacaatcttgaataccctagaagaataaaaatgattatcatctctcagtactaaactccttacagctgccattatacttgctgtacctgttgtattaatggaatatttcttatttttgactgcagattttgaaagaattcccatccctgagggatgacaagttaattgttacttatgctaagaaagcaatatctattaatgttaattctactcctagggaacctcgactaactatctctggctcaagagcaaagcaaaaaaaggttgctgcaccagccaaaacaaattttgtgcagagctttggtaacttccagagagaagcacgcaaagcattctcatgggtccctcgtgatagtggcaccaaaacacccccaaaagatattcttcggaaaagaaagagttcaggttcaggaggtgaaaggtcctcttgggaagcaacacctagtgtacaggaggagcgggcacctgaatacccttctgaggggcaagaaagacttccttntgtctctgctcctgaggaatgggtgcttactgnagaccctgataaggataacgcaactcgtgcatgccatagatacgaatcctcccctgatattacattatttaaggtaagccaaatttatcaggctttgtctttctggcaatgctgctgacttttacatttttatcctccatagtctgaattggctcctgtgttttttccatgtaatatgttatgcattgacgctggcctaactttctgctagcctgttgactctgtatggttttgagttgtagcttttagttatgtacttatgttctttgtataaaaaaattgaaccttgctgtttagttgccttagattttgatgatgtgcagaagtgtgaatttggtagaatcatatgagtaatactgtgttagaaaaaaacataaacagaatttatatattgtagcacatattgttttcaactgtgtgccctggaagggacttccaaattatccaggagaccaggacatgcaatgcacaggtttgtgacgaaacaggatatagttgagatgaatcttgggcctaatagtcttactgagttgttatgtaaaatgcaattggaatttacacttcttttgttagattgtactgactgactaaacagcactactccctccatccaagaatataagcatatctggagttttttggggtgatgtgattggttgacatggggaagtagcggggaaattaaatgagggatggttgtgattggttaagatgaagtaggtggggaaatgcttatattcttggacaaatttcaaactttcagatgtgcttatgttcttggacagagggagtatacactaaatagggcaacatagtgacagcatgctagtagtttcagagatgttagttaatatttgtaatgatactcttgttggtctgcttagttttcatccactcctgtaattcagttttctaatatattaataaacttagaaaatggatgtgttttgctactacttttactagcaaatcttgtaaacattttaatttatgaattggagttaaggggtgctttcaatgttttgacttcctgttatctatttgctctaattcttcaacaatccttttgtaggcattgctttcattgtgcaccaatgattcaatagctgggaaaggtgcactcgaaatttgtataactcagatgagggatgtgctgagttccctacagttgcccctcaatgcgtctatggacaacatagctcgagcttatcacgcgacagaaacttatgtacaggtacacgaaatggctaacaagatggaacttttgagtggtacagcatgctaaattaacagtatgtcatatgttcaggcactctcttatgcgaaaaatctattgaaaaaactagtggggactagtgatttgtcaagcagctccgaaagaagtagagatgttgatgatatttctgtggacacgggcagttcaagcgctggaagccaaaatatagatgggctgtctgatctcctacctctagctgatttgtggctagggcgtgcagaactacttcaaagccttctggggtcagggattattgcctcactagatgactttgctgataaagaatcttcaactaatctgcgtgacagattggtcagcgatgaacggtatagtatggctgtatatacttgtaaaaaatgcaaggtacgaagtgttacaacttatttctggtttatacttcacacttgctatgacatggacagtaggcttaatggtgtgatcaatttcagattgacgcctttccagtttgggttgcatggggccatgctctagttcgaatggaacattactctcaagcacgtgtgaagttcaagtatggaaagctctgcttgtaggttttgccaaaaggaaatagcgttaggggaacacaagaatatgtctgccttcagaaaataagacaagaggataaatgaactaataaccttttctgatcattttagttcttttaaggtccaaactttcgttgttaatgacgaagaggttttttttattactagcttcgttttgttatattttttcctcattagacagaagggattttgtcctctagcatgaatagtttttatatgtgaggcccaattgttaaaagatgtttaacataaagtttgtctattttcttctatccttctactttatcaccagaaggatgacgaaatgtgtttcctttattaaattcgttgctgagataagtgagttaaaagagtcgcaatataaatggaatattgaaacactttttcgtacgtccagagtgtgagagaggagatgttgctaatgctgatctaaagcattctgagtttgagcactatgttagctcattatcttttaatttgcctgtggaagtgatactgtttatctattgtagtttaaccttctgttgtactccctttccagacaagctcttcaacaatacaaaggggatgcaactcattttgtccttgaaatcatcagtacaattgaaggagggcctcctgttgacgtttcttctgtccgttctatgtaagtgattagcttcaagattttttttccatatttttctgaacttgcagtaaaacattgtcctttgacagacacaaaaacagatgacgatcgcactaaacactctgtgatccatagttatattgatga

SEQ ID NO: 88139 - DNA, 1349 bp, Oryza sativa
  unsure (1)..(1349): unsure at all n locations
caaatgaaatatgaaacttacgggcccttagttctcccaatattaaccaagtcttcaatgtcgcaagcctcactcccaagctcactgttgttcctcatgaattctacaggataagcaacatatggttaatctgtaaaagaattgtttaaaagaaactacaacaaaatacctaacatggacaggcaagcatgggaacataggaagatacttcctttgacaacaaaaataagttgttttgaattttcaaagtcaacaaggtgtcccttttatgaaggaaaagcaagatgtccctttaaccactaaagttgaccattgtctattcgaaaactttgtaaaatatcacggtagttcttccacatcaaatttactcataccattttccaatatcagaactacattttatacatttagacagcagttctcgccaaaataaatatagtttgactgtgcattcaagggtgatatgtttttttgtcatcacgggtagtactacagaagcatcagcgcggcagtaacatctgacttgaaggataacttatatgactcaagcattcaagttgttgattgtggcattgacaataaacttcttgtacgaatcaaatgggcctatgatacagaaatgcctaatgtgtgtgggtgtgcatggatttaccatggctttaactttatgtgcagagataaattttatggttatatgtaacaaggatcctattgcaattaccagcgacagagttgtgatggcggcaccaccgtttcttgcagaggtagtggcaggcgttgttttgttgccttccccggagtttgctcacttcctcgtggatgcacatctgctcgcgggagcccagtactgccatttttggcctacaaaactgaacgagttaatagtgcgagggcactaactccattactccagacctccaagacaaagacattcaaatggaattacagaacagcatacatccggcgcagttagcttagataaaaacaactgacagataagcgtaatttgctcgccatcgggcttcacctgtaactggtggccttgagctccttgatgacctgccggagctggctgtgagtccgtgaggcgtagatgatcacggggtaccgagacgactgcgacgccgaaccccccgagtgctggctcccagaaggctggctcccatacggcggctgctggctcccgcccccgcccnnaanncccaaacaaaaactcgggggggttaaccacctttcacctactataaacgatgttttagcaaaataacaggatcctcaggagcacaaaggtcgctaatttagactacgaccccacctaggaacgaaaacttgggataaaaaggtttaat

SEQ ID NO: 88140 - DNA, 1666 bp, Oryza sativa
  unsure (1)..(1666): unsure at all n locations
caagagtagcccttctgaatgtctgttagtcatgagtgcttcgatagtaatgttgaatctgaagagaagaacatggtgacatcctntngtcgggcttcttcttgatatacttcgtcataatcttatgttagatatggataatcagtcaagtatggggctatcacctgctggcagccaagcactagaatgagattcaaacatgccaaacattccattaaagatttggattggcgtctatctgttctacaacgccttccacctctgtctgaacggcaatggagttggaaggaggcattagttcttttacgtgctgctccttcaaaattactcaacgtgtgagttccttgttgctgtatatcaattttttgctgtctattattgtgctcaatcgtttgtacatctgaaagatcatcatgctctcatgctctgatgcgaaagggcatgcagtctagtggttgcagtgacctgagtagcacctcaaggtcctgagttcaaatctccataggagcgaatttcagattgggttgtttgaggggctaaattcccaatttaaaaggcttcatatattcggttggatgtagaagctgggtaaaaaaaaaagcattatccgatatagttattagattgatttgtttgtatgtgcatatcatcttgcatctttgtttacacagctaaggtcacatcaaactacgtgtaatctgtgcatgtttgctcatctgaatcatgcaccatgggcatgcatctcactaagtagcttacaacccagggtgtgatgctgtagatttttgagcctatcaaaatcaagctcacaaactaatctcaaataaaaatataatctattactaaatgctggaaatatgtaattttaagtgaaagttttattttgtatgtagtaactgatttacaatttctgccttttatagcctctactctttattcgttattttcttttgtttcttttacttatatgatattttaagatttagtacactacttcgtattatttgttaatttcattgtctttctatcttttattcgttatttactacttttattcacacatgattgtgatcggctgtacatcattgaaattcttgatagatgtatgcaaagggcaaattatgatataggagaagaggctgtacagcggttttctttgcctgctgaggataaagcttctcttgaactagccgaatgggtagctggtgcgtatagaatagcactggtatgcttactcttgctatttttcttcattattgccttatagatatgaattgtttggctcctctttatatccatgcacttttaactcataggcatccacatgtctggaaaacacataattccatatagctctatatggcctgactcaccatcgcgtgagtggtccatataggctatagcagtctttatgatgaactatccatatgcataaggcctagctttaaggcaaaaataacaataatttctttctcctctcccctctcctccctcacatcacatggttggtaattgagtgggccagtgggacccaggttaaatgtcttatcttaccatatactcctccgttccaaaataaaccaacctaggagaggatgtatatggttgattttagggcttaaggttcatcttatgtcctaaattgtggatgcccgacattggcgtg

SEQ ID NO: 88141 - DNA, 708 bp, Oryza sativa
atggagttcataccttcataaggtggtgacaggtcacatccaaacaccaaagaaatctatgagaagctcaactttttgattcagaagataaggaatgcaggttatgttccactgacagaatatgttttacatgatcttgaagaagagaacaaagaagaactgctaagatatcacagtgaaaagcttgcggttgcttttgttctgactcgttcctcctcaggtggccccataaggatcatgaagaaccttcgggtttgcggagattgccatacagctttcagatacatttctcagattgttggtcggcaaatcattttaagggattcaatccgatttcatcatttcaaggatgggaaatgttcttgtggggactactggtaacttgtttatactgctggtaccaggaacaggcttttcctaactacacaaatttgaggtttgggtacttgattactaggtacatggttttcctggacttttcatatttgaggtgaatatcacttctcaccaggtacctatcatcccttaaccgttgggtactaatagttcatttccctttctccgagtaagttgctaatggttctctacctgatgaatactttaacctaataaatagtgttcacttgacttcgatttataccgagtgtcaaatatgaatactgacattgttggtgtggtttgctgtgatatgcgactcagagctttaga

SEQ ID NO: 88142 - DNA, 2384 bp, Oryza sativa
cgccctcctcgtcggagttgagggcgaacgcgagccgaggggccgaaccctcgaagctgtggacgatatggtcggcggcatcccggacctgcgcgcgcgccgtcctcggtcccgggagggaactcgtccagcgccgtccatggggagaagtcgggtccctggcctggtaactcgccagtacgagctccaccgctcctcgggcgaggtccctcgaggatgacttaatcgtcccctcgagctcctcggggagccgctggagagtcccggccatctccgagaggcgctgggcgaggcccccctggttggcggcgtacttcacagtccgcccgccccagagacccgcctgccgcccggcgcggtctaaacgggacacggcgtcgcaaagcatgctgggccctatctcgcctgccaggcgaagggcctcgacctccccggtggatgaatccagcgcgccctgcagatccgcgatggtgtgttcggcagctgcgaggcgggcggctaagtcgctgtcgcccgtggccgccccgccgctacgcgcccttgcatccagctcccttgcctgcgcctcgagttcagcggcccgctggttcagtgcggccctctcggcgcgggcactttccagattgcgacgcgcttgttcctcttgcgcagcttcgcggagggacgcgctctccgctagcctctgtgctgcggcctcggcctcctcgagggctcactcccgctcggtgagcgtatcctcgcggaggcggagtgcggactcttcttcggcacaggcggcttcgtgcaccgccagtgtgacctcccgaatagcaatggcggcctcgcggtccgccaagtccctctccacgacgcaggcacgctcttccagcgccatggcacgggcctcaagggtttcttcgcgccgccgggatgccacctcggtctccgccgcccgccgttctcgggcagcggcagcgtcaaggaccccccgggcggcgtcgagcttcttccctagctccgcctcccagctcccgtattgaaggcggaggtcgtcctgcgcctcgttcatcacggtagtggcgatgagggcagcccccctctcctcctccaccttcctggcgatctcccccagcatcttccgacgggcttcgagctctgagacgtgccggcggtgtgccttgcggcccacctccaccatggcctccaccgagcgacgcccctcttcgacacgtgcccatgcggcgtcgagctccacccgctctgcttgcaaggcctccatctgggcacttaacccgtccaacaccgtggtgttagcgacggccagggcctgcagaagaggctctgcgctcagtggggcagcggaaggcgtgggggagagccgcctcggtgaggatgctgcgcggctcggcccgccgatggacgtgccggactcagggatgtcccccggacctggcttgtcctgagcgtcgcccgagggagtgggcccaagcgatgcgcccgcggcctcgtcgcgagctgcctcggaagtcgtcgccgcctcggcctggcgaagtctggcctcctcccgagcggcttcttcagcttggcgagctcggacggccacctgggcggcctcctcggcttcccgtaggcgatccgcggcttctcgccggtcagattcccgcctccgagcctccatggtcgccgcattctcggcctcagattggccggacttgaattggcaagaaggacgcgacgggatctcgctgaagcagaagaaaagccagaagacaaacaagatgggtgaatgaaaacttgtgttggaagaatgaatacagccacaatgggcgtgggacgaacctgcgagggggtcggttaaacgaccaccttggaggggaaatgaggtttccccgggatggttctgtccccccatcttgtggagccgtttcttcttccgctccccctcgggctgcggcgtcggcgcggccccctccgggcgcctgctgctgacacgcgccgccccgccccctcagggaggagatggggaggaagtaccctcttgcttcctcttccctcgggcgtcggcagggcggctgccccccgagcccccatcacggggcccggaagcacaaccccctcctggggtagattgatctcccttgcggctcctgctcgcaccatcatggcccttaggagctcgttcctctgaggccccgaccgccatcatgatggacaggatgttggcgcgatctggatcgctgcagagggggaggactccatgggggatgagggatgcctccgcggagctgaattcagcacccgttggatcattaccttgaagtcttcggggacccagtcccatttgaccccccggtgggtcctcatacagtcctcggacccggtgtactcccaggcgccccgggcgc

SEQ ID NO: 88143 - DNA, 1380 bp, Oryza sativa
tagccggcccaggcactgcagatcataccactttcatggccgtttgctgtctgggggctcgatatcttgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggggtgcctaaccgtattattacggataacggcacccaattcactagtgagcttttcggtgactactgcgaagacatgggcattaaactctgcttcgcctcacccgcccaccccagaagcaatggccaagtggagcgcgccaatgcggaaatcctcaaaggccttaaaaccaagaccttcaacatcctcaagaagcacggcgattcgtggatcgaggagttgccagcagtgctctgggcaaaccgaaccacaccaagccgagcaaccggggaaacgcctttcttcctcgtctacggcgcggaggcggttctcccatccgagctcaccctgaagtcccctcggaccaccatgtactgtgaggctgatcaagatcagcttcgcagagatgacctcgactacttggaagagcgaaggcggcgcgcggccctccgagccgcacgctcccagcagagcctgcggcgctaccatcagcgccacgtccgggcacgatcactctgcgtcgacgacctcgtcctacgccgcgtccaaacgcgtgctggattgagcaagctctcaccaatatgggagggtccgtatcgtgtgatcggcgtcccccggccgggctccgttcggctggccacaggcgacggcacagagctgcctaacccgtggaacatcgaacaccttcgtcgcttctacccctaatggagtttgggtgtcaggtttcgggctcgggccaaccccgcacccccttcaagcgtgcagggttggccgggggctaccacatatgcatattttttcttctatctgtatttcaataaaagcattttcgatttcctaaaggctgtatctgtgctgttgtttccctttgaaaaatcttgacttgaaataggtcacttgtgctcaatcctgccctcgggggctcgggtcggctaaaatcgccaaaaggggcccagaaccgagccgtgccccggggcgtggtgaactccgggggggaatcggcaaaaacccacaatcgggtcacccataaccctcggtcaccacgctcccggcctggccagtctcgacacgtggatctcccaggcactagccccgacccgcgccttttgaggactgggacctgggcatgagcccttaatcaagtgaagacataaaaggaccacggcacagatcatcctcatctcatac

SEQ ID NO: 88144 - DNA, 732 bp, Oryza sativa
ttcagcaactgctccaccaaaacaaacatcaatgcgggccaagattttttgtttgctaattgaagtatttcctggtgaagcgacttgtgtgaccattccaagagaaagaccatgtggaagtacagttgcttggtgtatgggatgagcaccctgagtgtggagtgcaacaatagcatgcccactttcatggtatgcgataagctaagaaaaaaaaataattagtgaaatggaattcacattctgttccaaagattggtaggtcaatgtatctgtttgagctagtagaattgtttgcttgctctaaaggaaaaggttagaggacatgcctttctggattcactcgatagtaacaatggcctcttgtgatttcccatgatgtgacatttggcaaactccttatgtgcggtgtcctgtccttcagcaccttctattgcagccttaattgctgcaatgatcacgagatttgctaaacggagtgaaataaagcacaggtagaatattggtgataacatcataaccatttgcagtacctttgaaaggttacaacattaatgtatctgtcaaaaatggaaattctgtggaacaactatactcaaataaaggctataactatgtaggaataacaaaagggaacaaataggaaaacatgactgatgaaaaaagttgttcggtctctataaaatctctgaagtcatcacttgattggttcatgcttccaaaaggggatgctat

SEQ ID NO: 88145 - DNA, 677 bp, Oryza sativa
ggcttcggaatagtagaataattcggaatagggctcaagatctttgggaaaatctaagttaatgatcaacaagtttggataaagaatttaggaaagatattcttatactggcacaatacaaagagaagtagatgcgaaagctatcccttcggatccaacctttcccttaaagaatttaattggttagcataatataatatctaataaatggaaaatcaaatagtagataatctgttatgaaagagagaaaacattctttgaagaatcaagattggtaatcaacccttggctttgttactaactttcttgaccaaaactgcaagcgtgaacttggccagttcttaggtttccgaaatagtgtaatggaaaaagagtgcttcgaatcgactttgattggggttcgaaaaaggaataaaaaaaaagtaaattcaggaaagatttcctttttttaggagaccctcaaggggtcgtggaatgcttttcttctcctcttattccatatggaatacaatcaattaaaataagaaggataggggaatattcgactgttcgctccaaaaagaaggttaaatcatcctattgaaaaagaccaaaatagaaagaactttttcaaattcaattctttatttttcactggggttagctgatctagttcttaatattttacttactcaatt

SEQ ID NO: 88146 - DNA, 603 bp, Oryza sativa
catcatatcatgatcgatacagaaatcgatcgagtcatctgttcctttacccaagaaaaagtatttctattttccatgtccaatcacagatcccggaatttctacaataaattagataggtagctaagctaatctagttccctatacacgaatctgttgcattctactgcaacagttgtactggaatgatgaataccttgagcaggtagaaatagaaaaaaagaattttgctaaaatggaaaaaggctttctttctaaaagaaaaaggatgctaattttgattaatatcaggagatcaaatgagtttatgcttcactaattgaatgataaatgactacaagcgaaggagataggcggtttaaacaaaaaaagacccaaaatttcaaacatgtatctagaatcacacaggaaaactacaaacaaaaatagtgaaaattagctcgtaggaacccatcagatcgttatagacccaacgaattagtagttcccaaccgcgggtggagtgaaatccaacaaaaaaatcagtaactaaaagaataaaaaaaagcttttactgagtcatttaagttatagaagattcctgaacccaaggattcaaaataa

SEQ ID NO: 88147 - DNA, 4650 bp, Oryza sativa
gtggcgtgacctgaccgaccaggcggccagatttcataattcagagataaggaagaaaaggaataagttcacttcaggtctctctctaattttcatccattaatcacaaaatcgggtacgacgggtccctcaacttacaaaaccatataaaagaggtccctcggcagtattatgcccagttttagatcacgtggctccctttgactaggacctcatcccacgtggtattgacgtgaagtttatgtggcaattggatcttgggaaaataataaaaaactatgggacccatgtggtcccacatgtcagcctccctcttctctctatcccccctctctctcccctacacggcaaaggagaaggacgagcggcgacgcaaagggggtgacaggcggagcgacggcaggcggcggcgggtggcagcagtggcgctgcgcgttcatcatcgcccgcgccggcggcgaatcccacgagctccgcgtcaacattgctaacgcctcctcggcatccgtcctctctcacgtcgtccaccgcagcgccgccctcccgacgctgacactggaggagcagttcgtgacgctggcgctgccgccgaagcacccgccgttcgtggagtcggtgcgcggtgcggggtggacatggacgacgtgctctgcgcggtgttccccatcgggtggttcagcggcgagcttctacgagcgaccgctgcagggcgtgacgctggtggtggacctcaacaaggaggaaagaagcgaagggtcggcgggaggaagtggagggcgcgcactcaccggctggcgaggaaggatggtggacggggaggagtcagcgtttagggaggagcggctgcccaaggtcaggacgggaccgagagcacgaaaggaggggcggcggcgacgtggtccgagatctgcaccgaatcaggaagctgcggcgttgtcatcgtcctcacctccaagatgtacgcacagatcgagacgacccgacggcagcgcacggttgcagcggcgaggggaagaggaaggggccgctgcgggcctctacccgccaacctccaagagcccatcacccgtcgccatcgagcccccactcgccgcgtgcctctcctgccgcccgccaccgtcgagcctccacccatcgcgcgcctctcccaccgaccgccactagcctgtcccgctcgaacggccgctcgtagccggccgcctctcccgctggaacgggtgctcatcgtcgacggggagaggtgtgttgctgttggtggtgtgtgcggcggtgaaggcggaggcaggcgcggcgagcgacgaggagagggacggccggccgccgacgttaggaccatgggggcgggagtggaggaggctgcgcctctccatggtgtccttatcttcgccggcgagatgaggaagtagaagggagatggggagagccgaggagaggaggaataagaggattggatttgatcatttgagaatgacatgtggagccaccatatttttttggtgtagctgacatgtgggccccaccatatttttttggtgtagctgacatgtggggccacgctttttattatttttccgagatataattgccacgtaagcgccacgtcaatgccacgtggaacggagacctagtcaaacaaatcacgtaggcgccacatcagccaaaatcgctgagggactacgtttacctggttttcgtaagttgggggacggatcatacccagttttgcggtcgagcgacgaaaatcggacagggcgacaaatagagggacccatagtgaacttattccggaagaaaagggatattcagcggttgggcggttgagcctagaaggctagaagccgaagcaatataggccttcgtggtgcttggaaaattgataatgggccttcactatgcctaacgtttgtgggcctcaatgtccggtgcataaaatataggaataagttcactatcagtccctcaaatatagatcggatctgattcgcatctctcaaccataaaactagttataaattactccttcaacggttaaaaccgtctaaaatcactttcaagacattattgaaggtggtatctgctgacatggcagccgaccaccacagccgcctgttgatccgctccggcatcgacctgtcgacgctagcatgtctgacaaggttcgtgctcaagcacggggtcaccggagacaacgctgccatcctttcccttcgtctgctccatgtccatctgcagatcaatcaacaacccaagttagcaaacaagcgatcaccagaacagacagtaaaatatttcatccgtatttcaaatgtacgacgccgtcgacttttcgaccattcgttttatttaaaatttttatgcaaatattaaaatatttatgtcatacttaaaaaacatttaataacgaatcaagtcataataaaataaataataactatataattttttttaataagataaatggtcaaatattgaaaaaaagttaacggcgtcatacattaaaataaaataaaatatgaatgtagtaatggtcaactcacatcggcttggcccttgacaacaagtgcaacatgccggcgatgtgcgaccctgccaccggggaagcctaccgcggcgtggccagtgccaacgactaaacgacacgccatggcgcgccggcggtggcagcgaaggagctgctcaagtgctcagcgccatggttgtgcccgccattgctaactcacaccgcagatgaaatcaacacaacctaacttagctagatcactctactgaaatcaactcaaaggcccagtgagcatgcacacggtctcactgcagccgccgcttcacctaactatatggagtagaatatatgggctgaaattctatttcaatcctgggctagacacttgagatatgtttttttttaaatgaatgttagataagcaatttacacttgggatatgttttgagctcaactatatttggtggacagaacgcatgtgcgatgtgccgaagaaaatgtctaccagaggaatttttttcatttttatttttttaatattttcagaaatattataccggcgaaaatatttacaaaaatagaccttactgcctaagtggagggtggcaaggtgacgtggcacacggcaccgtgtgtgcattttgccctgaggtggggtgaaatgcaactttcgccgcatgtaaaatttgcatgcccgctctataaatattttcgtcggcataatatttctgtaaatattaaaacaaaaatattgaaacagacaggaggaattgcctgccagcgcaaggaactgagattattctcctagtagtactgtacaaaataaatcgtactactagtatagcactatagtagcaaataatcagtagtcgcgcacgtgtgtcatttcgccaggctgtgacgagagagcatctgtagccactcgccatcaacgtccacagtggtcaacccagacggctgcctctagtagccgagttttaatcgccaaaatggaaacgaggcgtgtggagaaaagcccagtttaggtgaaaggttggtttgtttggtggccacatgtggtagcctccgcctccacaggatcgcaatgctcggcgtccacgcgcgcgccgcgcggaccggaaatgtaatgcccgagagcgcgacatgcaggcaggcaggcagcgcagcttaactggatttgcgtgtggatggaggatatgatatagtatgtgtattattagtgcaaaacgtgcgcgacgttctggtttggaggattattgcacgtacgtgtgtgtgatgctattgttcaggaaaacgggccgacaaaacaagggtcgtcactcactcaaaatctccaataaagagggaaaaacacgggccgggtaatcgtgagaagtgtgtttgccgcaagttccgctcctatctcacaaccgattgccacggtacacggttgccatcccatattcagcgcatgtttagcgtagctttagctcagcttgtatcttcatccaaaataagagaattaaacgggttatggagctctcttgaaatgaataatcaaggtgaaagctgggtacaaactacttgtaattttacttaaatctagaagttatattaaaggcctaccaaacacgacctcgtattccctacttctcgcgatcgatcacgtacacgctgcatgcacgttccatgcccagaataccgtcgatcgcccacttgctttcctcccatcccaacacacgcacgtggcgcgggcggcacacgtacgtctctccgtctctcaaacacgcctacgtacaccggcacaacccgtgcgtgcgcacgcgcgtggcatgcatgggtccccggccaactcccgtcgctcgacgcggcccgatcgaatcgaatcaaaacccgcacgcacacgaattcgcaaacgaagcgcctcgcattgcgtacgtcacacacggatatggaatcatgaaaagtcactactacaaacatggtttttgcatacgggcgagaagggggcgcaaccgcatgcactaaatcgtctgcgaaaatcacgatctttgtatgcggccggcgcaaccgcatgcgaaaatctgattttcgcatgtggacgcttaagacgaccgcatgcaaagagaaaaaatcgcgaaaaaaaaataaaattccaaaaataaaaaaaa

SEQ ID NO: 88148 - DNA, 589 bp, Oryza sativa
aggtagtatgaccaaaagtgaaccaaccccttggactgttgcgaaattacaccatctgatttcaaagtagcccgatctaattcaaaaatttcccctaattgggaacgcctcgcatatttttttacagtagcaggattagaataacttactccattaagttcgccaccatagaactccaccgttatgcctacttgttcaacactgtatttggattctgctcttctaaaaggaacgtccgctctcacaattccctcttcatctaccaaaacaaccggaaatgtttcaaaaaaagtaggcatacggcgtacaaaaagttcgcgcccttctttatctctaaagataggatgtcctaaccatccaacagctattccatccccattgtccattgagcctgctctgaataatcccccctttgccggattattaccaatataatcataaaaggctaatttttcgggaattttagaccaagcttctgataaactgagattttcggctaacccatcactaactcttcgatatatttcttgttgaaagaatccctgatcccactgataacgagtaggcccaaacaattcaattggggtag

SEQ ID NO: 88149 - DNA, 582 bp, Oryza sativa
ctgccgacgggggcggtgctgatccaggtggtgccgtacgggaagatggagcacatcgggaaggtggacttcggcgatccggcggaggacatgaggctcaagtacatggcgtactccgccggcgtggaggagagcacgctggtggagacgctggggcgcgaccacccggcggtgcgcgacccggagtcggtccaccggagcgggtgggggaaggtcgccgagtactacctcggcaagcaggacatccgcctcgatctcgcccgcttcgagcccctcctccgcgacgccatggattacctcaaacaccagtagaggcgagctccatccacaaagactactgtaattagctactagctgcaacatttttttttttttgaatgcctagctgcaacattttcattttcgttctctatgcttttttttttttgctttctattctttcgagttctttcacagaaaaaagaaatcgatcgattatttgatcaggattacagttacattatactacttctctttgtattccctttgatgcacataatggaggatggaatggaacgaaatcgattcattattagcactgaa

SEQ ID NO: 88150 - DNA, 614 bp, Oryza sativa
caaatcctccaaatggaagggctcagaaaaattcctataggaatttaatcctacgaattttctataaaaacaatgtgttccaaagaagccctagacatgataatattttagtttcatgccctgataatatatatttttgtctctggtatatttgacgtttatgataagatttagataaacttcttcaagaaaaaaaaaggcatcaatagtttctcaaataccacttaatttaaaaagagataatcgcaacacacataattttcacatagcaccatccaaccaccattcctctgtgcccaatcgctggcaaaacaggttatccatgatcgtactgaatcaccatacagttatacattacacatgactctgcgaagggagtcagggtgagcatccaccagacaaccacacccaaggctacataatagctatgaaaagaacaaaacaatggcatcaacgacagctttgtcagcagctgcaaatatgaactccagttcagtttcaccagtctaggctaatgctcctcgagaggaaaaggttgtcgatgtagtctatgatagggctagaggcatcgatgtatctcctcatctccttctgcacggagcaatctgcagtag

SEQ ID NO: 88151 - DNA, 4256 bp, Oryza sativa
cggcgctcccggtcacggtcccggtccctgtcccgatcccggtcccggtcacggtcacggtcacggtcggaggagtcgcggtggtgggaggaggaggagtcgcgaggggggttggaaaggggaggcggcggcgccgaaggggggcgggggagcgactggagcaggtcgagggcggagcggcgctggtcggtgacggcggcctggcggcgctcgagcgccagcttctcccgctcctcccgcgtgaggaacttgggcttctccatcccgtcggcggcgcgcttcatggcggcggcggcggcggcgggattcgtggagttggggagggtttgtgtggaggacgagacgacgggttcgggaatgggcgaacagatgggcgctactacttgtctacttgggccgtgcaggccgcaccgacctagtgaatttgggccgtgaaatgagcccagatgcgtcggaatcccggaattcggagtggattcgtggatttgggggtttgggcttgaaaatttgccccaaatgtacaggaagggaagtgctcccagtgatgatgaggatgaaccttatacttgttttccttcaagatccatatgaaatggtgcgttgattaggaatttgaaaagaatttggaagaatcgttcctttgttccaaaggaccaaatagttttttttatctataggtatccaatcctacaatatttctccagttttcatttgttgctaaggggtcctaaagaatgatttccctctaaggcccagtttagattttaacttttttcttcaaactttcaactttttcgtcacatcgaactttcatacacacaaactttcaacttttccatcacatcgttctaatttcttcaaacttccaattttagcgtggaactaacacaacgtaaattactgcactccaatatagggcagctaaaagcctaaatttcaaattgtcactttcacgatgaaatttgatctaacttaactagagatgcttaactaattaaacagcatagcgtgtgctgcttgcaaggtttacaaaaccatgttgctatcgcggttattacatacagtaaccttctcagtttttaaaattacggtatacttcacggtaatcgcacggttgtgctgtaaccgccaaaccagtgacacccaaaacagtctagggaacctttgttgcttgcgcctacactctacacagtgaacagggagaagcagcggggcccatgtatcagtctaacagggcttgctctaatcaacccatgcttaacgccaaagcaaacaatcactgtcggatcagttgggtagatgcgacgcagctcgcaaacctgtccgccccttatctatcagaacgaaccctctcaattacatgtgggccccacaacgagaaaaaaaaacctgtacgagcgtgccgacacatctagcctacaacgacactgtccaggctagcttagtggcttgtcaagaatcaagcagctactagctttcaatgcaagaggcagcagcagctgatcttgtcaagctagcagaggaattgcaaagaacgatggatgatactaacatggtagggcagaagcagagctggcaggtccacccaacaacagatttttttggtgaccaaatggtccatccatctcatgatttctttgacagctaaaccaaatcatgcaagacctgttgctttccataaccataattaattagcacttcgtgtttgtattttgcattttgtatatgaagaaacgagagagaagaaagggaacagataagcaaaaccataaccgtacgtgttacagccaatgctcatcagacaatgatgctatgcacaatgcactcaagagcaacccacattccaaaagcattacatacaacttagaaaatttacagggggaaaaaaacagaacaactaagaaaggcactgaggccctttttctttagccttttttttatactcactctacctggcatcaaagctggcagaggcatatgtttcgtgttaatgaattccaaggctttttcacaagccatggtttttgccacaaaacacaactcatggagggggcagctcaccaacccctcttgttcttgagtaaaagtttggaacccccccccaatcccctcatataatgaaaccaaacgaaaaaggacgtggaaagcggtccgcgaaaaaaaacctggacctttggaaggcagaattgctccatgatctgccatccagacggcaatgccgaaccaacttgagaattcgagcaccaggtggatctcctttccctcctggtctgcgccaaacttctggcatgacaatactagttagtcagcaatcttttttcgttgttttatagctttcatcttcaatgcattttcctcgaacatgatcataacgctctgcagatgatctggaaccagcaagaaagaatcaaggttctgacagaattcagtttggatataatgtggtattgttaggcaggaacatttggtgaacatttagtatttgtataaaaaggagtttggggggttgcacatcttcttttagtaaagtggtattttgtctattcaatgttctggaactaaagagtttgtactaaagtaatatccatgtggaataaatagaaccaactattgtactatacatgtggaaaagaaaattcgtcaagtaatcatgaatatgaactgcacctttttaccttcaatccgtgtaagggtgcagataatgcggtgagagctctccagagttccttgtacgctgctcgatccttctcaggtccctaagatgctgcaagatctcctgaagaagatcaaaccccttgtctcctttcttcaaagacctcacacactgttttataaattccttgtctgcctctagagcatgcagccgctcatggacttgatcaatttcatgcgctattgcaagtttatcttgctcattagctggttccaacacaacattttctgtagaatggtctgcctcaggatcttgccttgttaggaggtcgttcccatcttccacggtagtgtcatcaaataatgggagcagcttttttcccctatagcttacaccttttcttttgtcatgaagtttgaagttgctatcatcatcagagaaaccatttgaggcacccatcaaatggttttcttctgataatcgcttgtccatcttaacactatctgaatcttcatcttcgaggtcaaatagcctctcctctagcaatttgagctgctccagtatggagagtctttcttcctcaaaatctgcgagtgagcaaccaagtgtccccagatgcctagcagtttcttgtaacacagcatcagtagggatactaccattgcttccattaagaccatgggcagattcatcgccttcatagaaactttgggaatggtcatcgctgtcctcagcactggatgatgctgaggatgacccattgtggtcatcagccttgtgcctggacatttttctcctttccttcacctcaaagagatgaaccttgcgtctgtacaactcgagctctctctccagatcttgtttctccttctctctcttcacaactagttcattcaacctctctagcgcatcttgatcatactccgattgttcttccataagtcgctggtactggattgcctccatctgcattgccgccttttgttcttgcaagcgatttatcattgccatagtctcatcagcagcgatagcagctgcactcctctcattttcaagctcagtatatagggtgctcaaagatttatgtgcagatgccaaagcagattttaactgatcaacactaaccagttcaatactttccagatcaactgacttggtatcagaagtcattgctttatggtctggcaactcatgtaaaccatcgatatcttcaatgtgaattggtgtatccggagcactctctgattcaacatcattatagtcaggacataatttgtttaagcttgttgatggtccataagagaattgatgtaagcttggtagagcagcctctgttggattaactggatcaatttgaaaaaaaaaagatgatcagttgatcacactagagaagtcaacaaaagatacaaaccaaatgattaaaatcttatttcttaccgttgcctgcactgatgttagcatcaaacaagtctgttacatactcaatagcacgtactgtcataaaagttgattgatgattcagctcaggctgttcagcctgattctctttggtgccatcatttgaaatcaaatgaacttcttcccaagaatcaattgtcacaga

SEQ ID NO: 88152 - DNA, 558 bp, Oryza sativa
tgcagaaaaaatgtcgaggtcaaaacctgggtacagaaccaaaaacaaagcaaaaaaatgacgcggactcatcagtcagttgattaattagttggaggtcacgtgatttgcaggtgacgacgttcacctgcggcggcttcgtgatcgggctgcgcaccaaccacgcggtggcggacggcaccggcgccgcccagttcatgaacgccgtcggcgacctcgcccgcggcctcccggagccgcgggtgaagccgatctgggcgcgcgaccgcttcccggacccggacatcaagcccggcccgctgccggagctccccgtgctgccgctccagtacatcgccttcgacttccccgccgcctacctcggcaagctcaaggcgcagtacgccgccaccgccggcgccagcaagatctgctccgccttcgacatcgtcatcgccaagctctggcagtgccggacgcgcgccatcgccgccgaccccgccgcggccgtcaagctctgcttcttcgccagcgcccgccaggtgctcggcctggagaccggctactggggcaacgcca

SEQ ID NO: 88153 - DNA, 622 bp, Oryza sativa
agacagcacgtagccatttttcaacaaaatcatttcgaaccgatgacctcaaggcaattcgatattcaactttcataacaccagccaactgaacaaaccaaatgtcagaattagcaatgtccttgcaaaagaaaaagagaagcctgaaaataaaatagttaaccaaataaaagtattcaattgtacaggatagcagtcataccttcgatagatagtgttcattattcctatatgctgatgcaacttgagaaaaatgtttttgagttaaacatagagaaaatggagccccttttttgagtcctgccaaggcctcgttggcccattctgccactgcagacaacaatgaaaaggatacacgtgcaactagtcagtactaaactgaatttataaaacggtctcaatatagaaacactgttggcacttgtgcataaatataacaacattctcttgacgccttagcttaaaagcagagtacctgcagcatcatcactttgactacacttcttaagctcttccacagattcagcaactgatttgtcaggaccaaaggaagaaatgatatatggtaaaaacttatctagctggggccctgactctggctcgttcttgaactttgtcagca

SEQ ID NO: 88154 - DNA, 1338 bp, Oryza sativa
atttatgcagcgttacatgaacttgaccctgtgttcaaaaagttctcttttggagcgaatgtttccagcctgttctcttctttacgctacaagagacctgcagttattcaatctatgtacatctttaaggtaccttgtgcagtctctagtttcttgttggcattgactataacttttattccttattgggttaatttctccacaactcagcaaccaggcattggtggcgaggtggtaccacaccaggataatacattcctatatacagaccctccatcgtgcacagggctgtggcttgcactcgaagatgcgacaaaaacgaatggttgcctttgggcaattcctggatcacataaaagtagattttcgcatcaaattattttatttcaagaatcctcttgtgtttatctgagcttctgatttgtttatcatttacattgctttgtaccagatggcctgaaaaggcgaatgatcagagatgaaatcgatactcattttgatcatccttcgccaacctatgatctgaaagaatttgtgcccttagaagtaaagtcaggtgatttggtggttattcatggagatcttatacaccagaggtgaagttatcctgttatattgcgtatgcttgcaatcaactgcttcatttttttactaatatgttttaactttctttgccagctttgaaaatctttctccggtgtcaagacatgcactgagcttacatgtaattgataccgaaggatgtgaatggtccaagcaaaactggttagtttattttaacacttttggagaattctaaagttaaaattctatcttctatatttgctcttggtggtctttgcataacttactgtcgcgcagtagaagtctagaattgcctagaaacaagctattctacttccaagcttgtcctaaactgctcaaaccaagctaatccctccatttcacaatgtaagactttctagcattacccacattcatatagatgttaatgaatctagatacatatatgtctagatttattaatatttatatgaatatagacaatactagaaagtcttacattgcgaaacggaggaagtacttgttttagactgtataatcttatactgcataatcttgtacttgatactgtatagttttgccgtagcctgtaacacaggacacatattggttacttgtacctgtatatattgaaacaaggtattgtgccgctgtttgtatttttacaaatgggaatgatgttttactttatctttcatgtcaatcacttgaaaactccgaaggcagaaatttattagtgtccttgtttaagtcactgttagcagaaattttgta

SEQ ID NO: 88155 - DNA, 575 bp, Oryza sativa
gagatctcaaaaacaccttcgtcctctccacccaacgccataccaccccccctcccccctctctctcctccgcgcgcctcagcggcgaggggtttcgccgccgccgccgccgtcgcgccggggggacggctagagaagatgctgaccaagttcgagacgaagagcaaccgggtgaaggggctgagcttccacccgcggcggccatggatcctggccagcctccacagcggggtgatccagatgtgggactaccgcatgggcaccctcctcgaccgcttcgacgagcacgacggccccgtccgcggcgtccacttccacgccacgcagccgctcttcgtctccggaggtaaacatcgattcctccctgcctagatctcgcccgcctcgagcattttttttttcgctgtggtggttcgccgctcgcggggtcgggtgtggcgtcgacgcgtgtttggtcggatcctcctcctcggatttggaggacgtctcgcgtggccgttagatttccgcgtgatccatttcatggtgcaatgaggacactcgaggtagataccacgcgtacgtggtggcgatta

SEQ ID NO: 88156 - DNA, 1560 bp, Oryza sativa
ggaggttgaatgaggaaattttaagcatgattcaagctaaaaaagttggagagcgatcttcattctattttgcttccactttggaagcttgctgaatgcttcctttgtcattccaaacttgtctttgaattcagccgaagataagtaggtctgcatttagttcaaaatggggtatgtggtcattacctggtctgaggataagtaatacgaagtagctaagtatcgaaaagatcatatattcacctctcgcctggtaacgtcaatttcagtgacaggatcagcagctgtagttatcaggcgatcatatgggtatactgggagcccctcgtcatcttctggttcattttcttttacatcttcattaatagtgagagattcaactctactggtcatggtgttaatgccttcttttgcatcttcctcttgctttggcttctccaactcagatccatcttaatttgtacagaattttacaaacaacaagaaatcattaacccttcctctgtttaaaggcaattttatgttccaagataagtgtatcacataccttttactgatttagggcgatcaaaagaaccagtgagagaagcagttgcagatgacttagacggtgcacttgatgagtcaggtgtggcagattttgggaaagttttttaactacgggtggaggggtggaaagatttctgctgtttgcactttcaaagttagcagccaatgcagtgaatgccggagatcttcccctaacacggacacgttcagggctgaaagacatactcctcgagcgctgagatttgtcttgtacagtgcttctccctgaatatgttggtgttcgtcgctttggtttctggtaacaagttagaaagattgtaaatgcaaaggttccacatccacagataggtctgctaactacagaaaaacacttacagaccacagacttacaactagaaatgttataaataggtggttccatgattgtacacacaaaagataaacagaacactgttgtctagcagaaaacgagtttgcaacaaagaataccatatatggttatttcgacatggcagactatcataagacaactaaagtttgtacatatcttacatccaaagcaggagaacctccaccctttacaatggaaagcttcctctggtatgaattgccatgcatctacaagagaaacaagagtgagtacaacacattgaagatgaaaacaaggagcattatggtgcttctgccaaaaggaacacaaactacagttgttcatcttatgaatattctacttacaagtgactttgctgagtcccaagtgaagaaccttgtgaaaaatgtaggctcacttccttccatgataacaaaaattggtgtgtcgctggatagattttccatcaggaaatcaagcttaacgaatttctgatgcagtattaaaaataatagtcagtgaccaaaagaaaaggagatgccacctaaagtgcttcagcatggaaaaacaaatcattacctcaccaatgtccagagcttgtaatcgcactttgacatctacctggtggccaacccaaacaa

SEQ ID NO: 88157 - DNA, 522 bp, Oryza sativa
tgtggccaaaagtaatgtgatcctttagggtatgtcttatactacacttaccaacttcttctccctcgttttccaagcacatacaatgtttttggcaaactgctaaaccatgcgttaaagtacttaattaataatgcactaataagccaccccgttttccatgcacggggaagaggttcttaaacccttctcccgaacacaccattacttgtcataattcaagcaaaggcataaaaaaaatatttcaaaatcacttgtcatgtcaaagcatggccattttttagaccacaatcgtagaagtgatcaaaaagctcattctaaggtgactactggttctcattgaactcatgcctgcagtttgcgcacttatagaaaacagtttgcccctcatctgctgaccgtaactgcaattacacatttttcataaagtagttaagcatcaaagctagaaaaaggaaaattaagcttattgaacatcaaatgttcaaggatcgatagctgacctgcttggtgtaatactga

SEQ ID NO: 88158 - DNA, 733 bp, Oryza sativa
acggggattggcttgtgccgattcgtaaaaagggaagaaagaataattgatcggctacagaagagggataatctaattttactagggacaggcaggcatgtgcaaagacaaaattactcacatccaaagccttttgagcctccttttcgaaccaaataatcccgtggtcagaagcggcgatgcatgacaacaccacatgctcaaaactgccctctgctggcactgcccttctgacctgcggcggaagtctcccacatctgcatagcagccaatgtggatacaatgccaattaaaatcaagtgtaaatataacagctaatcttcggaagcttctaactaatggctaatgccatactagcacacaaggattttgtttttttaattttaaaaaagttttaatttttggaattttggcccttaacctgcaggtctccctcttcaccatatgaaagactcttactggagcggagaagtaagatgcatccctaaacttctcttctgacacaaacgtgtctctcaagccaaagaaaacacaacaagcacggcaaactggaaagcaagaaacagaaaaaaaggggaatcacttgggctaaaaaaaatggggaaataaccagcggaacaaccagtaaacaacgccctcggaacacaatggaaaacaaaaagaactttagctggtttaaaaaccacaaaaatgaaccgaaaaagcgtcgccaaaggccctggagaacctggca

SEQ ID NO: 88159 - DNA, 658 bp, Oryza sativa
  unsure (1)..(658): unsure at all n locations
ttgaattgtggttggagatttgacatttattttgcttggtatagatcattacaaaaatggctgccgctaatggagtaagacgtgtttgggttggacaaaacagcctcatgtctactccagctgtatctgctgttatccgtgaaagagttggtgcagatgtaagatttattttacaaagattaactttttgcagtgtgactgttagtactcactgcttattttctctgtgttaacaaattaccttactggtgctttatcaaatcatcaaaaaatagggatcaaaggctactggtgccttcattttaacagctagtcacaaccctggtggtcctactgaggtatcacagttatgatgtatctctgctgctaatcaaagtggcacgattttctggggttatcagcaacttttcatttgatctttgcaggacttcggaatcaaatataacatggaaaaaggggggacctgcccctgaattcggtactgataaaaccttttttaatacaacgaccattactgaatatcttatcgcgaaagaccttcagatgtaagagtgacgctgacctggtagttttggtgttggtttgctcccaggattgaanatatgttcaatctttattcttgcccattgcaggtgatattcttgtgaagggcactacc

SEQ ID NO: 88160 - DNA, 725 bp, Oryza sativa
tttttgaaaatatcccgcatatttaaactcgcctggaccccttagttatggaaggacctatatataacttttgggaccttgtcaaggccaataaagtgggtttaaaccatcaagcctctaaattcccttcggaacattttccaataaaaatgctatcaaatgaaagtttttcaagccggtgggtaattgggggcaaaagccccaataaatcgtatctccacgtgcccgactaagagaccaaaaaataattaggtgttattaccatgcttgtagattctttgccattcatctatggaatactatttatcaatatatatggcataaaaagcaacagcattcaagaaaagggcttaataaaatatcttaccccccatgtaggtgctctttaaaaactcggtcaaacgcacgacacatgtccaatattgtgtcaagttgtgcctgtagattatgataagtttatgagtcagcatgatgtagacatggtttgcgaatagataatgtgctagggtgccattcaaatgaatgttgcaggttgtggcacgaacaacatgaacctgaacacttgcagaaagttacaacaagcaaagtacggtttttcttaccccagcatcacctccaattggcctaccaaggcgatccaactcagcttcaatttcatcaattgttttgttaatcatggctataatacttggaatttttgctctgatcacagcctctaagtgctg

SEQ ID NO: 88161 - DNA, 547 bp, Oryza sativa
ataaaaatagcaatatctcctttatgcaaaaagaataatgatgtgtcagcttttgaggcactaaacccaagatcaatcagtttgttgcttaatctggcaaaccaagctcttgagcttgtttcaaaccatataaggacttatctagtttgcatatatagtgtggcttagtgacatcctcaaatcctggtggttggtccatataaacttcttcttctagatgaccatgaagaaaagcattttgcacatctaactgtctaaggctccaacctctagacacagctatagataaaatgattctaattgtagcagccttgaccactagactgaaagtatcctcataatctattacatacctaaagaaccatcagctttccttttaattttatagacccacttacatcctatgacattcttccctctctgaggtgggactaagtgccaggtattatttctgattaaggcatcatattcagattccatagcatttttccaatttttatctttaagagcctctatatcattactagattactaggttctccagaat

SEQ ID NO: 88162 - DNA, 2430 bp, Oryza sativa
ctgggctggttgtcaacagtagcatattggagaggggatgattgagctgggatgggttggaacatgatatatgaaatcaaacggcttatcaatctttcttgatactgttatggaattttattcaaaatctaggtggaattgtagaggaagattgaattgttagttgaaattttttgttgtgagacttgatctggatgtctttgttgtctctttgtctcctatggtggtgtttgcttttgaacttgtttactccctcgatccatcctaaaatataaggcataaccacccataacacaaagaccaagaaaacatttaatcactttcttagttggatcaccttgatgaatgcaagcaatgtgattgggagtgattgggaggtttgatgatagtataagatttaaaacaaataaattttataggaccaagagatactagttaatgtatgcatgcatgcacgccttacattatgagacatgagagaaaagtggttgtgccttatattttgggatggagagtataagcctaagtgtttggtgatgtaataccatatttgtgtacatccttctatagatgtagaggccgggttttatttaatctattattaaaaaaattaatctttcttggttacatgcatggcttgacttgggagctacttcataggaataattgcagtctgtggttggtaatatatatatacaaatgttacagagattaccaaagctgctaaaatatgttatatatccatgtaactttttagccaatataataattcactaacccgcacacgttgcttttaattgagttttacatatatcctaaaaaattacaaccaacaatataacctatacatcaactgatgcatggctcattatgcaatttttaaacgtatggacatcggaaatttattttgacgaaattatagtcgtggccttgcatgcatgattagctgatccttgtcttcatttcaagtgtttgtgaaaccaatcgaccattaaatcaagagcttgctcggcttttttgacctcgaatgggttgctggcgttatatctgcaagcaaatccatggttcactccttggaagaccttggcaaagtaatcaatcttcaataattaatgaacaaaaggttatttctaacgttcattttttgctaatgaataatatatttctttgcaaagatttgttattgaaatatttgatgaatgttttaaagaaaaatatgttcttcttgcaaaaaaggagagaaaggaataggtataggattaaagccacatgcagtgccccaaatgatggcctagcttttgtggattagattttgggtgagttattttcctcgtttcgcttatgcaactcacttgtttactgtgactattttttaaaccacgaaacagtgaacggtgtcttttttagaaaattttatatatatatatatatatgtgtatacgtttctttaaaaattaaataaatatattttaattttgtaatagttaatatttaattaatcatatactattgttatttctcggttcccgtttacaatatgctagtaaatcttttgatttttatgccattgtatcagctctaacttttgccagatgttgaccagcaattagagcccgcgtttccctcaaaaggaaaatatagcccgcatgatcctttatcatatcatcatccccggaaaattcttttgtgtgtctacagtctcatttcctttcagaaaatagacttaattagtttttcagtcaagtgttctcactcttcccgtctattgaatcctgtgcttcatgtatatgtgcaaattaaattatcttatctgaaaaacaaaaaggataacaaattgcaaggcaaatagagctatatatgctgatgcatttgctatatcaactgtaaacgaaattataacaggggaactcacccgatcagttctatgacgcaaggcctgaacatactggtacactaattttggtggtgtcagtgtgtcgttctgagctccaatgatctcaatggggcatttgacctctgcgtgaaatgtcacggcgaactttggaataagaaaacaatggctatatattcctgtgcaaccctatagctagatcagatgatacatgcatatttcagcaacagcaacaaagaaagaatatcaacctttaatgtcatcgacagtcaccaatccaggatgggtggtgacaatcgcttcaacctcgttggtttttgctacctccacggcaaacttccctgccagttaaaacttgcctttgagagactttaatatgaatcagatctctgtttgttcaatgtggagaggagatcaggaaggttcagagtgtatccttagaatatgaatctggacagactcatgtcttcgttggactagaaaacatctcatccaatactagattggtttttttttatggagggagtatgttggtattc

SEQ ID NO: 88163 - DNA, 720 bp, Oryza sativa
ttttttttctttcgaaaatggaaatgcgttaagttggcgttcatgccatttccggcccactcggcccgttacaatttggaaaaggaaaaagtacaccgaaggtccctcagcttgtcatcgagttacaaaatcgtctccgaaccgtaaaaccggatataatacctcctctaacttataaaaccagtgaaaactagatccctcgacggttttgactccggttttaactgacgtagcagctgactcagcatgggacccacatgggtcccacgtgtcagcctctacttcccctcccatctccacctctcttcctctctctcctcccacgaaagcagctggccagctgggtacggttcggctggcgcggcggatggctggtgcgtaaaaactgggcggcgccagcgggggaggagctgggcggcgccggcgataggtgacgcggggacgcgggagaaggggcgacacggcggcgcggcgacacgggagaaggggccacgcggcggcgatggactcggcgggtgccccgaccgcggagctgttcgccgcatgcgcaggagaaccgcggagcaggcgagcgaggcgggctgcgacctcgctttcgttcgcgtgcggcgtcggcgtcgtcttcatcctccgaagcgagctcccggcgagttggtgaaaactgcaaaaccgggcaggggctagcaggcagtctcgaccgcgtgtgcgtctggcggcgtc

SEQ ID NO: 88164 - DNA, 650 bp, Oryza sativa
aaaaaagaacaatattctagcgagctgacattcagcgacaaagataaatagccattgtttttgaggctttataataaaaaaaagtaacggtacagcagcatgagctcaccaatcgggtctgatgaatcgacaataatagcatcatatgtcccttcaggagcattccttaagaactccacagctgaaataaaataggacagttatgaaaattacaaaccaaagaattgaaaggtgcatctaaattgcaaataggatatatttttttcacagttataaacaggtaatattgattgtgaacgtaccatcaccaacatgaagccgaacacgaggatctttgaatccaacagataaatctgggaagaaatctttacaaacctacataattaagatgcatatcaggaaagtttgttgtgcaatgacatatatttattcaaatatcaaaggagaattgttacatcaataactagctgatcaatttcacatatatcaattgactccacagaaccatgtctacatatctcccgaaggactccaccatcaccacctccaataaccaaaacctgaaattcggtaggtccaaagaacattagcgaccaaactaaaattttctatagaagtaaggataaaaggaagaaataattcaagacaat

SEQ ID NO: 88165 - DNA, 703 bp, Oryza sativa
attcctgcagcccttttccgcaagaaccaagcaaaactgattcacacgaaaattctatacaaaattcatgctttccaaacgggtcgttttgggtggggaatgccatacttgtgttcttcctcgagatcacaaacttgcctaattttgcaatctccatatttccccagcgctatatgggagcaaagcagccaggtacgatttgaaactatgcggccacaggataatccagaaatttacaatgggctaaatttgctaaacataagatcctcagagtgatactaccacacatatcgtcaggctgtgtgttcatttgcagctcatgatctccagtttttcacctcttctcatcccatttgagcaacatggggggaagttgcatgttttcctccctcttttcatagctcgatatggtgagaatgattgggaacatctccttggttgtccaggggcatgtactgggccatgatggcgcggatctctgaatccatgtacctctgtacacaggcacaaccaatgcaaaagaaaaagcgagaatttagatgccaattcagagttatcaacagagttaacctgaacaaagttacccatatcatacccggatcctgtatttgtatactgcgtatcctgcaatgcctgctaccactaggccaaagaagatcacccacaagaagttccatcctacctctgttgctgcatttttgcc

SEQ ID NO: 88166 - DNA, 507 bp, Oryza sativa
cgatagaatcaattcaatgctgaattgcaataagcggagtctcacaactagagacgaaccgctagactacatagagtaatgaatccaacgattcaaaaaaaactaacagatggaggaaattgcacaagaaatcctggtctcaaagaaaaagaaaatggggatatggcgaaatcggtagacgctacggacttgattgtattgagccttggtatggaaacctgctaagtggcaatttccaaattcagagaaaccctggaattaaaaaaggggcaatcctgagccaatccatgttttgagaaaacaagtggttctcgaactagaacccaaaggaaaaggataggtgcagagactcaatggaagctgttctaacgaatcgagttaattacgttgtgttgctagcggaactcccttctaaattagggaaagaagggctttcgaaatctaatacacacgtatagatactggcatagcaaatgattaatcacagaactcatatcataatatagg

SEQ ID NO: 88167 - DNA, 749 bp, Oryza sativa
gaagttaaaattctacctcattctcatatttgaacacgaacgggtatgacagatgccatgcctcatctaaagcaataccaagaaattcccatgttgcaccttgatccaagcttcttgcaacaccaatatcaccttgcattgtgcttactgtttttgtttcaaagaacagaaagagtgtgtccccctgagagatgcatactatcatatcaggttgagcattacaataataactagaaaaaaaaatattacgatgggcttaaaaaaattcaaaagcctggatttgacagaaatttaccttcaataaaagaaggtttctgtttgtgtattgtaacaaacaatattgatgttacaaaagcatgtataaaattcccctgtcccagttgaggaaatatctccaaaaaaataaaacccatcgtttacatatctatatgaaatccagtgtagtgccaatttaattttaaattatttcatcatttatccttaaaatgtgttttgacactcatagaaaccacatcatggcccaaattcacttcaattgtaatgcaatgtacaagtctcaggcaacattttttctggtttcatattcggtcaaagaactgttttctcttcagtgtttcaacaaacatttcagaatcatgataaacttaaaggcgaagcatctttgcgtactaatttcgataagcatgaacattcattaactttatcaaggagataatagcggttagaactttgtataaatctaaggagaa

SEQ ID NO: 88168 - DNA, 505 bp, Oryza sativa
ataggaatgattttccaaccgttccaacatttcatcaatgaagggtagtgaaaaatgatcctttttcgtagccttgttgagtttcctgtaatctatgcacattctccatcctgtgatggttcgttgcgggataagctcatttttagcatttgcaacaaccgtcattcctcctttattaggcactacttggactgggctatcccactcgctgtattgcacaggatagataatccagacgtgcaggagtttcaggacctctttcttaacgacttccctcatcgcattattcagctgactttggggttctctggacggctgagctctcaggcacgatgggccttgcgatgagtatagcagcacgggattaatccatttcagatcctgaagggaatagccttgcaacagcgcgatgctttctcaaagacggctagaagacgactggttttgccatcagaaagcttgtcactgataatgactagagcttccttattaccatatacaaaag

SEQ ID NO: 88169 - DNA, 503 bp, Oryza sativa
cctcaactatttctcgcgatatcttcttacgaagttttgttagggcatctataacagcctctggtttaggtgggcaactcggcaagtagacgtccacaggaattaacttatcaactccccgaacagtactataggaatccgtactgaacattccaccagtaatagtacaagctcccatagcaatgacgtattttggttcaggcatttgctcatataatctcactaaagagggagccattttcattgttactgtaccggctgttaaaattaggtccgcttgcctaggacttgatcttggtaccaatccataacgatcaaagtcgaatcgtgagcctattaatgaagcaaattcaatgaaacaacaactggtaccatatagaagggggccataaactagagagtgttgaccaatttgaaagatgcttttagtgtagttgaaataacggaattggaacttgtttggtcaagtaggggaaactcaatcaaactcataactgtcttaa

SEQ ID NO: 88170 - DNA, 1074 bp, Oryza sativa
gacctagatgacatccaagacaaattttaaaacccaaaaatatattttgagattttatgggcttagatgacacacccatacaaatttaagaatcactcactcaaaaaaatctatagaaaagttgcttaaaacaatcatattaattcttctatcaattctttttaactaacaaagtacttaattaatcatgctctaatgagttatctgttttcatgtgcaggagggataagacatgtttttagcaccacatttgccatgaaactacatatttgtaatatgtgcttgcactttaagtacaaatcacatacgttgtaaatatgtacttttttggtataaactcaatgttaaatttatagttttgcgatatatcatcttatagttataattttgtagttttgtgataggcaaagtagaaaactagcaggttcatgtgtgtacggttacgccctttttacggatactataccactatatcacggaatagtagcaaacaacaacaaacacaccaacaaaagatgtcacagcaaatgaatgccaatgatgcaaggatccagctacagctgacctttggtcttgactaaccaggttgttgctaatacatgaaacaaattctaatggaagttacacaggcatagataaaccaccaggctataaaccatctgcctgcagtgcgtctgttcaaacatcaaagtgaaagtacaacctggcagcaaaacgttttgaagctaattcaagaaagaaaaaagatagttcaagtttaacctaaacatgactaatcgtcctgctcaaccttcaggctctgaagcttcgagtccagctcaccgtcatcctcttcctcctcttcctcttcctcatcatcttcagcctccccctcagggtcgttctcatctagtggaccaagcacctccacagagttctcaccactcttcagaatatctttcacctcatcaatcccttcgtccgagatgaaattcccgtttatgttcagttgcacaaaacctggcttgtttgcgattgcctgggcaaagcaccgagctcccaccctctgcagcatattcgtgcttacatcaagct

SEQ ID NO: 88171 - DNA, 1271 bp, Oryza sativa
atgtagcccgacagacttcttctcggccgagtgcttgctcgcaagatgggccatctcgcagctttccttgtcgcaggtgatagcctgcttgacatcgctgcgcagggatatgactcctcgtggtcttggcatcttcatcatcatgtaggtgtaatgtgggatggccatgaacttggctaacgccggtcgtccaagcattgcatgataagctgtctcaaagtcggcgacttcaaagcagacattatctgtatgaaagttttccccagtgccaaaggtaaccggcatagtgatttggccgagtggtgtagatgaaaacacaaggaagactccgtgaaagggtgcattcctcagccgtaactcgatcctcgagatctgcatttcgtcgagagtcttggcgaagaggatattgagcgctcttccgccatcaataagggttctcttgagcttcacgttgcgaactactgggtctagtactgggggtaccgccccgggtggaccactcggttgggatgatccgagcgatcgaatcgattgcaacctcagaccattgtaggaattgtggtactcctggctggactgcgttgatctcccggtcggtcagcttctgcttcctctggactcgtaggcaagtggccctccgaagatgtggttgagctccttccttgaatcctgcaaagtgccttgagctggctcggtgtcgtccttcttctatgttgacgtgtcagtttccccttaagtcggcttcttgaattgagcgacgtactgcttggcaaactgcttgtagacgaaacaatctttggcagcgtgcttggagttcgggtgaagtgaacatggcgcattcatgatcttgtcttaggtgttgacacgaattcgttgatgctgaaaagtggacgtggcggcaaccagatcctcgggcttacacttgcgatccttgtggtgagtgttgctgctacttgcaccgttgttgccactgtccttcttgggcttccagccactgccggactgcttcgaagctaagactgcgtcgtccgccttggcgtactcgttagccttctcaaacatttccttgaccgtcctgggtggtttgcgtccgaatttgccaatgagtagctcgttgcgaactcccttggtgaaggcggtgatgatattgccgtcggtcatgttagagattttgttgcgcttctctgaaaagcgccggatgtaatcccttatgggctcattaggcttctgtatcacattgtagagctcgaagtgagtgcttggccgttcga

SEQ ID NO: 88172 - DNA, 1082 bp, Oryza sativa
gaatattgaagggagcagctggtcttgctgccgatgccaatgcgttccgcgagttcttcaactgggccgcaccacgtgtctgggatgccgtacgttctcagcagcagcagcatctgctgcaagtggatccacgaggggtaggatcagcatcagctagagacaacagaatagcttcactgcaccagattgaggccgatcttcagaaactcgagaacgacctatggctgatccaatcaactacatccacaatgtatgacctaatcgatcgtcttaaatggcatagccacaaggatacagaagcctggcatcttcgccagatcaagtatgtagtgtatgatgccgaggacctccttgatgagtacaattactatgctctcaaggtgaaggtggacgcaagcaagaacttggggcaagatcactcgcatgaaacctttttggagttcttggacagtgtcaacttcagtaaagtgatggaaatccaaaatagacttaagcaggtttttgaccaatccaagggtttaggctttcacaaaacaccaaagaagtttgatcgattagtcagaccagagacatgtcgtgtcctcgacaagccagataagatatttggtcgtgaaaaagaactgaaggagttgaagcaaaagctaggagtatgtggacgcaagagaagcaggcctgtggcatgcagcactatagctgaagcaaggaggacagagttgcctgtgctgccaatagttggcatggggggcgtcgggaagacaaccatggcacaacaaatctgtgaggatggagtggtgcggaaacactttgactgcataatctggatatgtgtgtcggatgaattcgaggtaaacaggttaacaaaagatgttctgaagtctcttggtgtaaagtcacaacattctgatacaagggatactcttatggttaatttacgtgatagtgtcaacgcaaagaagtttttactcgtccttgatgacatgtgggatgatgtcttaaaagatgagagaggatggagaatatttcatagaactttaagcaatggtcttcagggaagtatgattttggtcaccactagatcttcc

SEQ ID NO: 88173 - DNA, 2552 bp, Oryza sativa
cacgtcaacgccacgttaatgccacgtcaaatgaagaccgagtcaaatttgccacgtatgcaccacgtcagccaaaaccgccgtctaaatcactgagggatctcatctgtagtggttttgataattgaggcacccgttgtatctggtttcgtggttgaatgacgaaaatcggattcgttgacaagttaagggacctcagatgaacttattccgcggcggatcaagcgatgtgaacatgggctcactgggccaatggacacggcccactaactcagcccaagtgccaagtccgccgggatcttcatccgaatctccaccggcccagttagctttcggcccaaaacagatttcaaaataaacaggccacttcaattcttttgttactacacggcataagcacatgtacacatactactacacatgcaacactatgcttacacttcggcaaatacgacatctaacacatgcttaaagaaacgaaaaccatcaacatatttctgatctcactaaaatcttattggaaggctacttgcgtgttcgtaatatttatgggcacttcatatccataataatcccatcaattatatatgggaagttttctttaggtatttttaatattggaaaaagtacggattacccccctgaactatcatggttggctgaattaccccctgaacccgaaaaccagacatagcgtaccctaaacttttaataccagacgaattacccccctcaatactattttgagcggttttgacttgagcttgtacacgtggcgccaacgtggcaatctagtcagaaaaagactcctcggggccacatttcatctctcttccttcccggtctccctctcctcggtcgcgctctctctctctctctctcccgtgcacacggctgcggacgggcggtgggcggcggcgcgcgcggacgtgccgtgggcagtggcgcggggggacgggtgaggcgatgggcgctcgccgccggcagcctgccatccggtttcttgtggtgatgagctcaggtagctgcagagaaatgagaggagcttgttggccaaatgaccatcgccggcataggaacagcagcagcaacaggccttcgacttccctggctacagcacgagcagcagcaacatcacttggcgcagcagagccgcctcgacaagctgaggcctgagggtgcagcagggcttcgacccgccggccgggtgagaggggaggccatggcttgctccgcatcgacggcgatgagcacgcccagcctgccgccatgtacgaccacgcagaggcgacggccgggcatggatcgtgcgcgttcccggagatgttaaacttcccatcgcagcgtccaacggggccctccgccaccgagctgctcgccagccagatgaacgccaactaccggttcgggttccggcaggcggcgggaggggtcgccggattggctggcggcgaaggcgccagtcggctatccacaaagcatcggacgggcggcgttgaggtggtggccgcgcggttccaggtcaagcggcgctggagtcggcgcgcgagggccggtgacgggcggcgccgaggtggcagccgcgcggtccctggtcgagtggcgcgggggtcggcgcgcgagggctggcgacgggcggcgccgaggtggcggccacgtggtccctggtcgagcgtgagagtggatatggctcaacgcgataatcatgttgatacacgaagagtattacatataggcgccaaccttccatagaacactcgaccgatttatggaagcatgatcgggaggttttaggaaagagggctaattagagatacatgccatatacagtctaacacccccccgcagtcgcaacggcgctagcagacgttgagactggagcgaaactcggtgaagaccggtgtaggaagccccttggtgaagatgtcggcgtactgcgatgttgtgggaacatgaagaacacggacggcgccgaccgcgacacgttcccgaacgaagtgaaggtcgatctcaacatgcttggtacgctgatgctgcaccgggttggaggagaggtagacggcactgacattgtcgcagtagaccagtgtagcccgcgacggcggagaatgtagctcctggagtagctggcgcagccatgtgacctcggcgaccgcattggcaacggcgcggtactcggcctctgcactggagcgggagaccgtgtgctggcgcttggaggaccatgacaccaagttgtctccaaggaagacggcgtagccagatgtggagcgacgagtgtcagggcagccggcccagtcggcgtcggagtagacggcgaggtcgcaggcggaggaccgctgaatgtggagtcctaggtccacagagccacggatgtagtggaggatccgcttgagggctgccaggtgaggctcgcgagggtcatgcatgtgaaggcagacttgctgtacagcgtaggagatgtcgggccgggtgaaggtgaggtactgtagcgcaccggcgaggctcctgaagtctgtgggatccgctacaggagggccgtcggaggagga

SEQ ID NO: 88174 - DNA, 5336 bp, Oryza sativa
atgcactgaaacgtgcgattgtttcctgccaaaatcatcacatggtatcagagcctgatccaatctaatctagccatgttactcgatggcgtcctcctccaccaccagtagcgccaatcgtctccagggaagcacggtgagtgagaagcttgggaaaaccaaccatgcactttggaaggtgcaggtttgtgctgcaattcacgacgcgcgtctacaggggcacctgactggcgcagcaaagaagcccgacgctgagattgccgtcacagttgacggcaagacggagaagaaggcgaatccggcgtttgaagattgggaagccgtggatcagcaggtcctaggcttcctcctcgcatctctttcaagagatgtgctcatgcaagtcgcaaggtgcacaacggcggctgaagcatggacaacaattgatcagatgtactccacccacaccagagcgcgagcaatcaacacatactatgtgctcaccaacaccaagaagggaaacatgtcccttcctgagttcttcggcaagatgaaggcgcttggtgacgagatggcggctagcaccgggcgacctgttgaagaagaagagatgatcatgcacatcattgctggccttggcaagggatacagcgaggtcatctcggcagtgtgtgcacgccccgaaccaatgaccgtgggagaactatactctcaggttgttaatttcgagggtcgcatggcactctaccgaggaacccaggagaacgtcgtcaaccttgcaagccgtggaggtggcggcaatggaggaggtcgcggtggcggcaacttcagccgcggcagcagcggaggcgctccccaaggcggtcgcgggcgcagcaacaatgccggaggccgctgaggccgcgggcgtggacgagcaccaggggctgcagatcgccgaccaacatgccaagtctgcttcaaacgaggccacactgccacagattgctggtacaggtatgatgaagactatgttcctgacaacaaacatgttgcagcagctgcggcagcgagctcctcctatggcatcacaccaattggtacatcgatatcggcgctacagatcacatcaccggtgagttggaaaaaactcacggtgaaagacaagtacaatgggaatgagcagattcacactgccagcggtgcaggtatggatataagccatgttggtaatactgttgttcatacccctaatagtcgcaacatccatcttaaaaatgtgctatatgtccctcaagctcagaaaaatcttatatctgttcatcgtctagttgagaataactctgcttttcttgaacttcatcgagattatttttatcttaaggatctggtcaccaagaaaatgctccttagaggaagatcacattgcaggctctatccacttcccaagccatccttgaagtatgcctgcaatgccgccaagatctccttccatcggtggcacagtcgtctaggtcatccctcctcgtcagtggttagacaggtggtcaataaaaataatctctcatgtttagatgtgtcaaatgagtcagtttgtaatgcttgtaagcaagcaaagagtcatcaattaccatttcctgttttatctagtgtctcccaacaccctctagagcttgtcttctttgatgtatggggtcctgctccagagtctgtagggagaaagaagtactatgttagtttcattgatgattttagtaaatttacttagatctatatgctacagcataagtctcaagtctttgaaaagtttcaggagtttcaggttatggtagaacggctgcttgacaagaaaattctagccatgcaaactgactggggaggggaatatcaaaccctaaactccttttttttttctaaaattggcatagttcatcatgtgtcatgtcctcacacacaccaacaaaatgggtctgctgaaagaaaacatagacacatagttgaggtaggcctctctatactatctcatgcctttatgccattgaaattttgggatgaagccttccaggcagccacctatctaattaatcgagtccctagcagagttatccaaaatactactcctttggaaaaaatatttcatcataaaccagattattccgctctacggatttttggttgtgcatgttggccaaacctttgtccctataataaacacaagtttcaattccgctctactagatgcgcttttcttggttttagcaacatgcacaaaggtttcaagtgtcttgatatatcctcaggccgtgtctatatttctcgtgacgttgtctttgacgaaacggtgtttcctttttctgaactccatgctaatgcaggagcttgtcttcggtctgaattatctctcttgtcacctaatattattagtggggatgaacaggtattccattcatgggctaatccacctgctaatccgcctaatatgtctcacaattttcctcaagatgctgcaacagatcaaacagccaaagaagatccgcctggcgctgactcccatgatgattcctgctcccgccctgacggatctgtgcaccgctcccctgcgcgcacgcctgacgcgtctcctgtccgccagtccagtgctgacacgtctctgcaccagcatccgtctgccgccgatcgcattattctgcaggggccaccgccgcatcaggagacaagggggcagcagtcaggcacaatgacaggcacagcgacgggcgaagagacgttgggcagtcctgtaacagatgttgaaatacttgacatgaatgacattgatactgatgtcacaggtattaatcccgatgccgacactatactgcctcatgttcaacagatggagactcaggaaccacaacaggtccgtcccagaacaaggctacaaagtgacattcacaaggaaaaggtatatactgatggcacagttaaatactcctgctttactagttcaggtgaacctagtgatcaaagaggccctaaaggacaaaaattggaaattagccatggatgcagaatatgaagcattagttaagaataacacttggcacctagttccacctcagagagggaacaatgtcatcgggtgcaaatgggtgtataaaattaaaagaaaggctgatggttctctagatagatataaagctcgtctagtagataagggattcaaacaaaggtatggtatagattatgaggatacctttagtccagtagtaaaagcagccacaattaggataatattatccattgtcgtgtctagaggatggagtcttagacaactggatgttcagaatgcttttcttcatgggtatctagaagaggaggtgtatatgcaacaacctccagggttcgaggatgtcaccaaaccacactatatatgcaaacttgataaatccctgtatggactaaaactggccccaaggacctggtttgctagactgagtcagaaattgattgaacttgggttcagtggatcaaaggcagacacttccttgttcttcctgaataaaggggaggtcactatctttgttcttgtttatgttgatgatataattgtagccagttcatcagagagggcaattgcagctttacttcaggatctaaagacagactttgccttaaaagatcttggagaactacactactttcttggtattgaggtaagcaagatacataatggtattattttgacacaagataagtatgctactgatttactaaagaaagtaggaatgatgaattgtaaactagcagctactcctttgtcagtaagtgaaaaattttctgttcatgaagggtcccctttaggtccaaatgatgctacacaatatagaagtatagttggtgccttgcaatatttaactctcactaggcctgatatagcctcctctgttaacaaagtttgtcagttccttcatactcccacaacagtacattgggcagctgttaaaagaatcctaagatatataaaacaatgtactaagatgggcttgaatatacataagtcagggtctacactggtcagtggattttctaatgcagattgggctggaagtatagatgacagaaggtcaacaggtgggtttgctatatttgttggctcaaatctagtgtcatggaatgctagaaaacaagccacagtgtcaaggtctagtactgagtctgagtataaggcgatagctaatgcaacagcagaaattatgtgggtgcagactctgctttctgagttagggattaaaagtccccgtgcaggtaaaatttggtgtgacaatcttggtgcaaaatatttatctgctaatccaatgtttcatgcaagaacaaagcacatagaagttgactatcactttgtcagagaaagggtaagtcagaaattgttggaaattgattttgtttcttccggtggtcaagttgctgatggatttactaaaccactgtcaactaatcttctggagaagtttaaagccaatcttaacctagcaaggttatgattgagagagggtgttagttgagtctgtttctatctctatgcatgtgataatgatcagtttagttgtgataagataggattagattttatctcttcctttacatttgttatcgcatgctagtttctctcccgagttggcgcggttgttgccgatctcgtgggcttctgtaatcgccacgatgaaggctattctaatcatatattaacgcgtaagcaacgcactgaaacgtgcgattgtttcctgccaaaatcatcacacgttcaacgccgccgtcaccgccatctgcatcgcaccatgtacgcaaaagcatgtcaaccatggaggagcacggcaaggtgaagggaactttgccatgatcatttggtcggcattcgtcgccgccgggctgctggcctactgctgctgttcatgctcatcatgaccggcatgctcgactctgccatcccgacgacgagcagtagaagaagtggacggaggtgatcaactaccggttcctcaacacgctcttcaccatcgcgtgcctgtaccagcagtccagcacgtcaagatcttccaccacctcgtgctgctcctccggtggcgccccagcaccagcgacgaccgcgaggatatctgcaaggtgtactgcaaggattgcgcgccgcgggcgcacgaccgcgtgcacatgctcgtcgtggcagtgcttcttcgcgtcacctgcttggcgcagcacttctgctacactctcttctggagctacgcgtgcaaggaccggctaggctgggctccatgatgccggcgtggggagaggagagagaagggagagagggaggaccaaagagggaaggagagaggatgacacgtgggccccgcatg

SEQ ID NO: 88175 - DNA, 9193 bp, Oryza sativa
ccggccgacgtgggggagtgggggaggagagagaggcgggattcgaaaatcgaatcccggccatatcgggtgcgggcgcgagcgggagagagaggggagtgggtgcgggaaacgcggcgcacgcgtgggcgtggtcgacgtggcccgaaggaggcagagacgtgggcgcggcggcggttgcgagcgcggcggcgcgagcgagagcggcgggaggtgggggaaggacccgacaggtgggccccacctgtcggcgaccctggagaggagggcggcgggacggcctggctgggcctcggcctgcggccggcccagcagggaggggggaggaaaggagagaatgggccgacggcccattcgaaaaaaaagaggaaaaagagaggaaaaagaaaaagaaaaaggaaaaaggattttccctggaattaaaatattgcttgctcaattttaattggttaaaattatttctagagctctgaaaattccactaaaaatcctgttaatgaatttcgacatgtagaactcaagaaaaattccacatgtcaaatccgattattatttgcattaccttcttagggttttcttttgatttgcaccagcattttcttaggatcatttataaattaaattttaggcttgggaggagaacttcggggtgtgacaaacctaccccgcttaaacggaatctcggccccgagattcggaggagctggtgaagaggtgcggatgggcggctttcaactcatcttccctttcccaggttgtttcctcttctgaatgatgactccactgaactcggcaaaatcgggtgactttgtttctggttctcctttcactggtatcaagtatgcgaaccggcttctccacgtatgttaggtcctcctggatatcaatgtgttccgaatcagcctgttcttcaggtacccttaagcacttctttaattgggacacgtggaacacgtcatggatgccgatcatgttggatggaagttctaactgataagcaacttctccccttcgttccaaaattttgtatggtcccacgaagcgtggtgccaacttgcctttcgtctgaaaacggtgtactccccggagcggagtgacacgaagatacacggaatcccctgcttcaaaagtgagctcccttcggcggttatccgcgtagctcttctgtcgagactgggcaattctcaacctttccctgatgattctgactttctcttctgcttccgctaatacctctgttccgaacagttgacgctcgcctgtctgatcccagaagagaggtgtgcggcacttccggccgtataaagcttcaaacggtgccatctgtagactggtctggtagctgttgttgtacgagaattccgcatatggtaagcttttgtcccaagctccaccaaaatcaagagcgcaagctctcaacatatcttccaagatttgattgactcgctcggtctgaccatcagtttgcgggtgataggccgtgctgaaatttaaacgggtccccagttcttcctgtagcttctgccagaattttgaggtgaactgactccctcggtcagatacaatctttttgggtactccatgtaggcacatgattctcgaaaggtaaagctccgccaaccttttgcccgtatatgtggtatgtactggtatgaagtgagcaaccttagtgagtcgatccacgactacccagatcgaatcgtgacccgatgatgtccggggcagtcctgttataaagtccattccaatctcctcccatttccattccgggatttgaagaggttggagtaaacctgctggtctttggtgctctgccttcactcgctggcaaacatcgcagagtgcgacgaattcagctatttctctcctcatgctgacccaccaaaacttttctttgaggtcttgatacattttagtgctgcctggatgaatggagtactgggtctgatgagcctcggtgagtatcagatccttcagttccttgtcgtcaggtacacacaatctttctcccaaccagattgtgccatgctcatcttcgtggaaatcccgggcttttccgactctcatgttctttttcagctctgctatttcagaatcatttgcttgagctgctctgacttgatccacgagcgtaggccgtgcctccagagcggctacgaacccgtgttcaacaattcccacgttgagatgctcaaactcctgccgcaattcctcacacatgcccgcgatgcatagggcagtgcagtaacttttcctgcttaatgcgtctgccaccacattggctttacccgggtggtagtggatgctcatgtcatagtctttgattagttccaaccatcttcgttgtcggagatttaggtccggttgggtgaagatgtatttcagactcttatggtccatatatacttcgcagcggttgccaatcagatagtgcctccagatcttcaaagcatgaaccactgctgccaattccaagtcatgagttggataattcccttcgtgtggacgcaactgccgcgaggcatacgcaaccactctgccctcctacattaggacacatccaagtccgtgacaggatgcatcacaatagacttggaagtctttcatcgggtcgggcagaatcaaaactggtgcagatactagtttcttcttgagctcctcgaagctcttatcgcactcggttgtccatttaaacttctcatccttcttaagcaactgagtcatgggtcgggtgattctggagaaattttcgatgaatcagcggtaataacctgcaagtccaagaaaacttcgaatctgcgacacggtcttcggtggggtccatttggtaactgactccacgttcgatgggtcgactgccacaccctgagctgtaatgacatgacccagaaatttgacttccgtcaaccagaagtcacacttgctgaacttggcatatagctggtgctccttcaacttctcgagtaccagacggagatgttgttcatgttcttcttcggactttgaatagataagaatgtcgtcgatgaataccacaacaaacttgtccagaaattccatgaacactttgttcatcagattcatgaagaatgcgggtgcgttggtaagtccgaacgacataaccgtgcactcatatagcccgtaccgagtggtgaaggccgtcttcggaatatcctcttcccggattctcaactggtggtagcctgatcgcaggtctatcttagaaaacactttagctcctttcagttgatcaaacaaatcatcgattcgcggcaaaggatatttgttcttgattgtgacctcgttgagtgcgcgataatcaacgcacatcctcttcgtcttatcctttttctccacaaaaatgaccggagcaccccaaggtgaagtacttggtcgaatgtaccctttctgcagctgctcatcaacctgcttcttgacctctgctaattcgttggccgccattctgtacggtctcttgtaaattggagcggttcccggtgccaagtcaatccggaattcaatctctctcttgggtggcatggtagtgaggtcttcggggaacacttctggatactcgcagactatgggtatatcttccaatttcctcaagtttttctccacggtgtccactgggatttccgtctcaatctgattcaaagagaccccttgctttggtgagtctggtgatttgtacactaccgtttctcccttctcgttggtcaaggtgactgtgcgattcgcacaatcgatgactcccttaaacttggtcagccaatccatcccaagaatgacatctaggtctttggattcgagaagaatgaggttggctagaaatggtgatctttggatttctattagcactgaagggctaaaactgactgaggttgaactatttcccggggtatgaaccctcattggtgtgctaagctcttctttccttaacccatgcatcccgacaaatttctttgaaacgaaagaatgcgttgcaccggaatcaaaaagtactgttgcagggattgagttaacaggaaacgtacccagtacaacctctggtgctgcttgtgcctcctccgcagatgcgtggttgacacgagcctggataaaccttggcccagcacgcctaggcttcgggcatttgtcagcgaagtggccaagctcgccacagttgaagcaggaccctggttttgctccagtctccttcttggattgcgcgggcgggcctgactgtgccggtgccattggtgggcgtggagctgcaccgcggttggactgacctccatggtggttctgactgccactggcgccctggggaaagttgctagggttgaacgggcggtgctgacgaacgatcatggtggtaggtccaccctgctgcccaggagcgaagcgcggcctctggtgacttcccggaggtgccctgaactgtgcggccttcctcttcctgtccatcttgttgcgttgatcctcctggcggattgccttgtcaaccagcctctcaaagtcagcgtagtccccggatatcagttggttggtcagctcatcatccagacccgccatgaacttctcctgcttctcggcgtcggtgcggacatcctctggtgcatatcgcgcgaggcgattgaactcgtggaggtactctgtcacagtcctgttgccctgatggagtgcccggaattccctcttcttttgtgccacgaccccgtctggcacctgcgccttcctgaagctacagcagaactctgcccatgtgacttcagtacctggtgggcgggtggccatgtgattgtcccaccaagctgacgcgggaccctgaagctggtgtgtggcgaaagcgaccttctcctgatcattgcactgcaggagattcagcttcttctctatggcatggagccagtcattcgcctccatggggttggtggtgctggagaaggtgggtggtctgacgcgtaggaactcaggcaacttggactgagggggagggggaccaaactgctggtgctgctgttcgacgtgctgcatcatcctctggtgcatctgctggtgctgctgctgcatctgctgcatcatggctgccatcatctgagtctgatgtgccataacttgggcaagggtcggattctcgggaagtggtggcggaccattgccggaatcactgctggggtgcacaccgtcagcgcgttcttcgccgttgctgccctcgcctgttgcgcggctaccattcctggtgtagaccatctggagggaaaagcagacggggaaaagaagaaaaacagatgctcaggaactaagctttattacaaaggaattaaaactgcaattgttctgatctgaattaaaacacttaaagagcaagcaaaaatccttattaagacagccatatcataggcacatgatatcgaccgtcgactaaccccaaacaagcaacctaaacacacaaattaacaagcagaagctagacagtcgataaactaatggaaaacgagcctaatgctcggaacggctcctgcggtcggtggagtcgaaggcgtcctcctgctcgtcaccaggtccctctgagcgactcccggagcctggcagataagtctcgccactgcctgactctgagccactgggagtagcagacaaccaacctccattgccactggctggacccctggcggctgatgcgggagcgaaggagagagcggacgcgggagctggagctgcaggaactgccggagctgcgggcggaactggaggtgctgcgggagctgctgatggaggtgggttcctgggcgcaagctggatgcgcacgggtgccgtcgtcgtcttgcggggcgtagtgcggatccggactcctcctggcgctggaagaccctttagctgagcgttctccctcttcaggcgcgctatctcgtccttcagagcgacgatcctcatgagcttcccatcgttcaaggccttggtcgccttgtgcaggtccgagtgcatcctgtccaatcccctcatcacagcacacatgtgaccaaaggtggtgtcgttctcgctagctgtcggacggaaggagctgacgtcatcaccgttggctcgacgggggtggaagcggtacgccgtgtcgtggaagatgtagttgtggcgctcccgtagtctggccatcatcaagtaggctgcctcctgacaggcgtgatctgctgtgcctccagatgcctcgaccaccatgttagctaggcaggtacccacgtagccgtggacctccaagcgaacacggtgaggaagctcgccactgagcggtggaatcgtcgtgtactctggcgcgttggggtagcccaccaccagtgtcatgcgtgccaactctgccacaaagtcaatcatgccttctccgcggtggttgggtgggtggccggccatctagagaatacgaaggagtaggatcaatgcatgctcaaacccaaatttaaataaagcaataaaagactcaaacaagggaatcgaataagagcgaaatttttatgcatagatcattttgcatgagagcgaataaataagacagacccacataacgataaaataatgagaaattagatacatactaataataacaataagagcataaataccttgcaacccatgttcctgagctatgacctaatgcatttcacccatcaaatcccaactgactgacgaataaatcccaatagttttactaaaaccctagactgactcgttttgaagaatctcacttaaacgagcgaccaagatttttcccttgaaccacaagaacagatcccaattttcccggaacaaatccaattgcaaagaacatatgcaatgaaaaggattcagagggctcttaggtttttccatttggcttgtcctacggtcaaggtcggctctgataccaacttgtcacgcccagaaattcccgaatagaatttcaagcagaatgtgcattaaatccccgtccaggaccggccggggtacacaaacgacaatgttgacattcagatccacgtcttacaaacatcataaaagtcttacataaatgcagcggaaaacaaaagataactggagctaatccttgacttgaactgcagcgggaacaccactccacaggcatcctcgacggcacggacgaagcctactcctcggagaacccgccatcggacacaaactcgagctctgagattggggggaaaatagagcaaggctgagtactacccactgtactcagcaagtcataccggaatgggggtatgatgcacggattcaacaagggatagctaagcaggttcatttgcataaatactggcattaaaaacaggaattgaatgcgaaaacagttgtaataattaagcaatattaatcatccactgtccaacgctacaccacgttgcaacaggcccaaccatccacctataccatccaaattcattagactaaactaatgtgagtctaatcacggtgaatctggttgaccgcccgtaaccgcgggcacggctattcgaatagttttactctgatcagaggtgtacaactgtacccacaagacacagccccacgacacgtttccgtgcgccgacatgccaccacgacatcccggaaagaggccgtgacaggacccttcgcttaaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacgctacaagcccagccgttgcccacgctggcttgtggtaagtacgataagttcttccagggcatcccgcgaaccggtccttaactgccatgggtgcgaccagcaaaaccatgcacccacagcccaccatgtgattcattttatttaaccaacaccagagcggtggtactaatccaacattatcatataaacctatagtctaggttttaaatgagatttccccattgtgtgctagttgaactaagcatggctaagcaattcctagtccaaagtctaatcaagttataacccaagctaacaaaggagcatggtgtccaaaaagcatggctgtaacaaaaggtaaccatcccatagtataattgcaaaacaaatgcggtatttgaaagaaaacattaggacatttgcaatataggatcaatatgatcaagtgacaagcatgacttgccttgctctgctgctggaggaacctcggcgactatttcgaagtacaccggagcgtcggaagagccggaatctagcgacatacaaggcaaacattgcaaacaggctataagactactgaaacagggaacaaaaccatctttaatggattctacacatttttcttgatttactgagacttgattgggcttaaacggagctcggatgaattagttatgaattttagaagattcactgtgtttattactatagaagaaaaaccttaaatcatttattgcgcaatattccagggctgacgtcagcacggagggggtgcggcgccgacatgcgggcctcactggtcagcgactcaagggtggccggtctaccgtggaccgggaccacgcgggtgatccaccgccgatccacgggatcgacggcccggatcggcctggggccgatcggacggtgcggcggcggtcaggctaggctcggctcggcacaaagccggccgaccggtcacggcgacggcgcgcgcacgcgcacgcgcgttgccgacgacagcaaccgacggcggagacggcggcgcaaaggcggcgccgaagggcggtgatgctaaagcgacgactaacgggcggcggcgctaaagcggcggctaggagggagagggaggggaaaagaggggagggggtgcctcaccgagggtggccggcgcggaggaagacgatggcgaacagcgacggcaagccacgggaggacgacgtcggcgggcggacgagcttcggggtgccctaaggaaggagaagagagggattagagagagggagatggaccacggcgaccggaaaccatggccaaaggcggcggtggaggtggtgctcacccgagtgcgagggaacgagggctccggcgacgaacctcgacggaggagaggtggacggggtggatctcggccacgcgaacccgacggcggcgacggcgcggcctggcggc

SEQ ID NO: 88176 - DNA, 1128 bp, Oryza sativa
ctacacaggaaataaaaaatggtggggccatgtggcccacatgtcatcctcgctccttcctcttctctatatcccctctctcctctctctcttcttcctcatcctccctagtccctccttctttcttccagcagcacgccgccgctgggaacccacctccgccgcaagcgcgtcccgagcatgctcctcctcgagctccgcgaggcatgtggctcaggatggtgtggccagcgccggcggaacaaatgagtcatcagggacctcttccttgcctccgcgaacccctcgcctcgcgacgctgccgctgccgccgccgcggcatcgtcatccttgtcctccgcctcgtcgctacgggggaggatgaggagaagggtgggggtggtgtgcgcggcggtgtcgtcggggcaggagggaagtggcgggggtgcagccgttggtggaggcgttgccgccggtggcgagagcggcggggtatgtggtcgggctgcgcagggggggacgcggaccacgacggtgctcggggcggtcaacgtcgccgaagcagcttcggcgaactccgccgtgcccggggtcgccgcggcagggctgcacaactacgtcgccggctgccgggagaggagaaggcggaggcgaagagcagcggcgcgacggggtgtggccagcggacgacgaggagagggatcccttcctcctccttcgtgtcccgcgactgcgagctcgccgtcgcacgtcgccaactcgtgcaaatcgatgcagcggcgcagcaggagtcagcggcggcggggccgaggtcgtgcagctccgaccgccgctccctcctctcccgtctcccgtttgccaccgcacaaagctccttctgccatcggccaccacgcgccgctcctcaaccgccaccacgcgccgctcctcaaccgcctccacgcgccgatggctgtcgccccccgtgcttctccccgccttctccctctccgcgtgcgctcgccgggctccccgctctattgctgccgtgtcgtgctcttcttcccgccgtccagcggccaccgcccttctccctctcggcgcgcctgaagagaggagaggaaagaagagagggcagatcgggagaggaggaagaagaggaggggttag

SEQ ID NO: 88177 - DNA, 3051 bp, Oryza sativa
catcacctgttaatactgttagtcatactactccacatatccctaatgcttacaatgattctaatagaagatattctcctgatactaggtatggccaatataacaatattgcgccacaaacacaacctattaggccaccaagtccaccaccagatccaccaaggcctgaaactgtggagaattggtttagaaatattatcagggagaatttagcaaagctaaggaatcgctctagggactaccgaaagccgtatcctgattattatgacattttcccatatcctcgtgattataaaattcctgaatttaccaagtttagtggtgaggatagtaggactacatgcgagcatgtagatcaattcttagcacaatgtggtaggttaaaagtgatatttttaaattgcgcttgttttctttatctttgtccggtactgcttttacatggtttacttctttaccggcaaattctattgatacttgggctcaattagaacaaaaatttcatgattattttcacactaataaaactgagcttaagttatctgatttaacatcggttaggcatgaatacaatgaatctgttgctgattatattgaaaggtttagagatgttaaaagccgatgttttagtttgaaaataactgataaagatttggccaacattgcatatgatggattgcttgattctattaaagagaaattgaatggccagatatttcttgatattgatcatgtgttgcatgaagctctggctcaggaaagccgagtggatggcaatagcttacaagctagtttagatgaaaatgcaatatcatgtatagccgaaccaagcgatggttcggattgtgttaatgatttgtgcaatgatgcaacaaccattatagccgaaccaagcgacggttcggattgtgttacttgtttagacaccgatggaatagccgaaccaagtaatggtttagattgtgttgctagcttagagagtaacatcattgaaaatatagccgaactaagtgacggttcggattgtattacaagcggaagtgaaatagcattgtcacctaagaccgaatcacaaatcggtcatgtggatattggaaaagataatgacaatgtcttgtgggatagtggtgaaatagaatccaaagtagctatgcatacatatcaaaggccgtatcctgaacatgtagattcggtcccatacccgcaaggatttgaggtgcccaacttcacgaaattcacaggtgagaatgctatgactacaatggagcatatcggccgctttattgattaatgtggtaaagccggtagcgatgatttgcttaagttgaagttgtttcccctttctttgtcaaactttgcatctacatggtatagtttacttgctcctaattcaatttctacatggtcacaaatggagcatgagtttcatgattatttcaaagatgcaagcttgatggagcaaagaccgattgatacttcatcggtcacttgtgaaacgatttcggttacatctatgtctaagatcggaattgttagtaatcctctccctattagtcctattgatgttaacaaaaagaaagggaaaagtgttattattggggatcctcggcccaagactaggatcaataatgcgaaggccgaagatcataaagttgcaaaggatgagtcatctagtttgcaaaggaccaaaaagccgaagctcacttttgagatgcttatggctaagtacgagaaaggattagcgggtcaacgatttgataatcaaactagtgattcaaaaataccaagatcatctcgtaggaagagatttggtcaaacaccaaagcaattggagccatcaactataccaactccatgcaaacctccgattgtgatgccatggtatccatatccaatgtcactatatggttatccttttatgtattatatgccatggatgcctcaaccacctatgctgtgtcatcaaggatggaagcaatcacctaggacggtaccaagtcattctaactcaagacaagaccgtttcccacgaaagaatcggtccggtggatcaaaggtgaaaaaggtgaagaaggtgtgggtgagaaaagaagacaaagctccggaggtcgttgctatcaaggagaaatctcaggatattcaagtacctactgaagatgcggcgaaaactatacaagcggagaagactgaagccgacgccgttgctgtcgacattggcagtctgaccgagccagccggccggtctaaccgccagactacggccggtctgaccgacccttctagccggtctgaccgacggcttgtggccggtctgatcgggcccaaaggccggtttgaccgggcggcattggataagagtgggaaaattgagagcaacataggagcttccacttcgaccaaaaatatgaagaataattgcttagctcctggaaaacaactacagccgaagtggataccttctggcttatctcgctctcaaaagaggaggctacaacgtcttcgggccataggtaagaaagaaaaggaggccgaagatgtggagaacaagacatgcaataatttagagtctcgaacagcacctagacaagtgtggagacccaaagaggtaaaagttaagagaccggtgatttcccatagaagtaacaaatccaatttgatgagagaagaatcatcggtcattagagataagtctccttcacatgatgctatgggtgttagtgcggtattcgtcttgccttcgaaatcgcacaatctagaaagccgattttgcttggggggcaagacatcaatatgctcatgagggaaccaagggaagatgaacggcgatggatacaacatcacatctttgaaccgccgtttgttggatgctaaggcaaggtatgagtttattgtgtttaacattatattatatgcatatgccatgttattagaacattgcttgctatctagcacatgtgtgtttttgcttatcaaattgatattatacatacatgttgcaaatgccaattctaggtagtagaattggtaggttggcatataatttgtttgaag

SEQ ID NO: 88178 - DNA, 957 bp, Oryza sativa
ttatactccattgaccctggtagtactaagatgtaccaggatctcaaggaaagattttggtgggcaagtatgaagcgtgagatcgcagaatatgtagcggtatgtgacgtttgtcagcgagtcaaggcagaacatcagaaacccgcaggtttgctgcagcctttgaagataccagaatggaagtgggaggaaatcggtatggatttcatcaccggtctacccaaaacatcgtcgggccatgactctatttgggtgatagtcgactgacttaccaaagtggctcatttcatcccggtaaggaccacctattccggaagttgtttagcggaattatatatggccaggattgtgtgtttgcatggggttcctaagaagatcgtgtcagatagaggtagcaagtttacttcgaaattctggaataagctccaggaggagatgggttccaagctgaattttagtaccgcttattatccgcagacagatggacagaccgaaagggtaaatcagattttggaagacatgttgagagcttgtgctttagacttcggtggaagttgggataagaatttgccttacgcagaattctcgtacaacaacagttatcaagctagtctccagatggctccttacgaagcactgtatggtcggaagtgccgcactcaccggtgcaagaaactacgacggacgacgacgtacgtcggccggcgacaagctccgacaacggcaccggcttggctcgacgtcgacggcggcgctgcggcggcttgcgacggtggcgaaggggcggccgaggtgatcctcctccgcgcgaacccgacggtggcgacggaaggcggcggcaacggctacaacggcggcgcggcgtggcttaaaggcattatctacggcagcggctagggctacgcgccggcgacgctacgggcaacgatagagctcgggacttgaggggaaacatag

SEQ ID NO: 88179 - DNA, 2492 bp, Oryza sativa
aggagaagactttgaagagttacaaagccagcaaggcaagtcacacagatcccaaacaaccctttaagcatgttgatcccgtttaaagctactgtttctataaaactattgcatttattttcgaatgtcattgggtggaaataacctattgccttgttatagcccttttgctattgattccctattctttgtcacttggttaataatttgattagctagaacattatatggctttagctaaagtgaataggatgcttagccatgcttagagacactagctcatataaaggggatactcatgattcactattatttaatgttggtttaatgatagctcacgatggttaatcgtgattggttaattaattaatttgccaactaaaatatgataatggtgggttgtgagcatatggttttgatggttgtgctcatgacaattaaggaccggttcacgattttcggttgtgaaacatttaccgtgccaaccacaagccagcgtgggcaacggctttactttctgtatagtatggttcattgtagagcaccagactgtgaagtggtggagataagcccacgggggtcgctggggagtgcactactttgaattgtgttatatagagggtattgtcacaatctctattcgggtacttgttaagtatcacgacgcatggttgacatgatgttgtggttgtgtcttgtgggtacagtggtagacctctggctagagtttaaactattcgaatagccgtgcccgtggttatgggcgggtctaacaatgtcttttgtgattagtttcacacttctcaccataataaatgatgctgttaataatttgtttagctcctggtctggaatggtatattcctggtttggagatagaactgtgcagccgggattggttgttcagaatggttgggcctatgcaacagggtatgttgtatagcgttggattaatactgtttaattaatattctactgttttattaaattctgaaatatttattaaatgctatttatgcaaatgagactatactatgccatcctttattatcctgtgcacttgcatatttgctgcgtggcttgctgagtatgtcatatactcaccttgtaatcattcatcagaggaggagttctacagtgatgccgatggtgtgtaggattacgcgtagccctggtcaagctgcctgtggagtggagtcgtctgcgccgtttatcttattttccgctgcttagaactttattgattgagagaaactatctacctctgtaatgacattatattcgcttattaattaaagtaataattgtactctattatcaatttgttattgtgtgcctcggctgattcctggacgagggtttacacacatgtaagcgtttggaattttggatagaaattccgggcgtgacaaatttacacccaaacttcaccatacctctcatcttctcctaggaaacatctacatggggccactagacagccactcatacttggttgagtgaagtacaagtgggatcacagcctcaaaccactgccaactcctttaaatcgtttctaatcctcatgttgacaactagctctcactttccaccttcacttttaccattcactactacagccaagatatttgtgtgagggctaaaacgatttttgcacgcgggtaggcggcccgcacgcacctaggtgtctgggaaaatgatgatttttggcgcaccaccacgggaaaacaaaaatccgaaataacataatttttttataccaacaaaaccctagaatccggcggtgggcttccgcccgacggccatagtgctgccggcctccgcgtcacccgctgtcggatccgcgctcccctccggccgcaacgccgccgacgcccctcccctccgccggatctaggcagggaagaaagggaaaaggaggggagctagatctggcgctgggaaaaggcggcccggctgcgggatacatgcggggacggccgccaccgctggattcttgcgttgacgtccaccaccgttggatccgtgtaggcactgccgccgcccaccggatcccacgccctccaccgcctccacatggaggaggccggcacgctcctactcccaccgccgccgcgcctctgctgtcgccaccacgccgctactgtcaccgcgcgccgccaccgctaccgctgtcgagaggagaggagaggagagtggagagaggagaggagaggcgtgagagagagaagactgagaggagatggtctgcgtggaaattttaaagtggaaaaagggatagaggggaggggagaggagagaaagaggggaaattttaaagtgagtgagagaggaaagagggagttagtatttttgcatgcggctctcttaataggtccgcatgggaaaatcggctcattttcacgtgctgtccatttaagaggaccgcatggaaaaatcgatttttcccagaagcaacgagttgccgcacggaaaaattgatttttccgtgt

SEQ ID NO: 88180 - DNA, 1596 bp, Oryza sativa
  unsure (1)..(1596): unsure at all n locations
acggcatttgattgacatctctgcaagcagctcatcaaatagctattctataccccgggtgtagaatagtttttctaatatatatatatatatatagcctatttcctactaccgagagtagttactccctcctattatggatcggattcagttaatggagtgacgaggatccaataacgatgaatacctgtgttgtttaattaaatagtttgttagttcagatagttgctaaatcatcggctgcatgcaaaccaacttctcggatgcagtttcttcctcgcacccgctcgtcctggcatattatcttctgctcgtgccggtggaacatatatattagccggccaacagaaaaaatggcagagcatgaattaaaaaagaatgacnagaacattcaactttaaaaaaaaaaattttagggccaaaggaaaaaaacacaaaggccccccccaaacccccccctcttaaaaaaaattttttgttgtggttttttttttttttttttttttccctttttttcccccccccgggggggaaaaaaatttttcccttttgggggggggttttttttttttttttttttttttttttttaaaaaaaaaaaaaaaaaaatttttggggggttttttttttgtggggggccccaaaccccccccccaattttggaaaaattgggccttttaaaggaaaaaaaaaaaaaaaaaaaaattggcttttatcaaaaagatagatcccatcatgactatattttaactatatttgagcgttgttactgcatgtaaaacacagtgttactacacggtgaccgtcgcgttactgcacagtttcgcgaaacgagagcttctttttccacatcgccgcgtgaccatcttcgctatcaataggctggctgccaggcccctttccaaacactactttaagatctttcaccatagcaaacactgttttcccactgcgatgtttaggcttcgtacggtggtccgccttatgttcaaagtgattgcctttcttccgtacagggtggtttgcagcaaggaatcgacgatgacccatgtacgcaaccttcctacagtgcttaagatacgtactttctgtttcatctatacagtgagtgcaagtcttggaccacttattagactgccccgataggttgctaggtgtaggccaatcgttgattgttacgaacagcagcgctcgtaggttaaactcctcatgtttgtcctcgtcccacacggngacactttctttcttccacaacagtttcagatcttcgaccagtggtgttaggtacacatcgatgtcgttaccaggttgcttggggcgctctgaaataaaataaaatttcggggggccaaatttccaaaatttttaaatttgtggttgaaaccccttttttttcccccccctttttttcctttttttttttcaaaaaattggggggcccccaattttttaaggggggcccccccccccaaaggggaatttgggggggcgggggggggggcaagttttagatacacatcataacgggccaagtgctatggccgntgntaatntntncnanngnnnnaatccataagaacgttaagacaatcgtac

SEQ ID NO: 88181 - DNA, 776 bp, Oryza sativa
  unsure (1)..(776): unsure at all n locations
gggccaaatcagctacatcttgggctttgatgaaattcggggcttgaataatatgtccaaagacatcactcccagggcccactagcaatacgtccgtctgcttggcggttgtgcagtatatcactgagtggaaatgatgtcaccaccgttaccgagtgaccttgaaagtagtgagacagcttcctggtagtaattagaataccatataacagcttctgaacctgagggtacctcgttttgaagttggctaggacctcgctgacaaagtaagtcggtcgctggactttctggacatggccttcttcctcgcgctcaacgaccaagactgtgctcacaacctgggaggtggctgatacatacagcatcaacggctcctgcggatgtggtgaagctaagactggtggctcggtgaggagtttcttgaaatcttcgaaggccttctgtgcttcgggtcccggtttggagacaaaggatttatacaggttcaggccttcttattcaagaagtaataccctactcctgtccggggatggatccgccgagtgtattattgattgtatgattgggagaaaatcaacctatgccccaagaggcacccggaccctccttatatatgggaaggagtccgtgttaaaaaagataatctatatccctaacggaatatgcagatacaggtaaaatacagtcgtaaccgactaagtctcaaggtgtttccttgatgtacaagttaagaaacgaacccgagatgattgctactggaactgacntcacccctc

SEQ ID NO: 88182 - DNA, 594 bp, Oryza sativa
atcagtgcgacatcttctggggcataacgagctaagcaattaaagtcatggaggtactctgtgacagaacgggatccctggttgagtgctctgaactctctcttcttaagggccacaacacctgatggtatgtgtgtcttcttgaaagcagcagcaaactcccgccaagtgataggctgtccctcggctctgtttagacgaaactggtcccaccacttagcagcaggaccatgcaactgatgtgaagcaaaggaaaccttctcctgctcagtgcactgaatcaaatctaacttcttttccacagcatgcagccaatcacctgcctctactaggttagtggtgcttgagaaggtaggtggtctcacacgtagaaaatctgccaacttgttctacggaggtggtggttgattgttgttatttgcctgttggttctgcgcttgctgcactaacagattaatcaactcggtttgctgggccaaaacttgggcaagtgtgggatctccttcattgtgaccatttccacttccacttccacttccagtgcgggtgttcaccatctgaagaaaagcatgggcaaaaggaaagaacgacaga

SEQ ID NO: 88183 - DNA, 2780 bp, Oryza sativa
agccaaaagaagacttttaaaaccttttttcaatttaaattattcatgaaatgcaattccatttattaaaataacttccatggctcaaataaatcccagaaaaacctaggaactatagaatcaagtgaagtatttaataaaattttatctagcccacttttatattggaatttattatttaaaattagatcttttcttctaggcttttaaaatcatttctaataattccaattaaacaacaatttatatatttagggatttttagggtgtgatagatgctagggtcaatcgtcactgtgaaagggggttgcccatcaaaccatgtcctctactccgatgatttttctttttcttgggagaaccatgtggcgcttcggctcgtcaggccctttgcccttttttcctttactagatatgtcgttgacgcaaaaaacttccgttacatcattgacagggacaaacggttcgtccgagtatccaaccttgttaaggttaaccgttgtcatcccactgtcatcaatcgttacgcctccaccagtcaacctaacccattggcaccggaacagaggtaccttgagaggtccatagtcaagttcccatatgtcctcgatggcaccgtaataggtgccagttgtaccatcgtgtcccatggcatcgatacgaacagcaccgttctggttcgtgctcttcatgtcttgggctctcgtgtagaatgtgtacccattgatttcatatccctagaatgttgcgatcgagccagatggtcccctcgccaggaaggccagttgttggttaatcgtctcgttacccatgagatgttgtcgcagccacgcggagaaagtatcaatgtgatgccgtgtaatccatgcatcggatttaccgatgtttctggcgcgaactagagccaagtgctccttgatgtagggagccaccaatgaagattgttgcagaaccgtgaaatgggctttacggaataaattgttgtctaccatcattattgctttccttctgagagtcccctttccccgtagtctcccttcatggcgtgattcaggtatcccgattgggcgaaggtcttcgataaattctacgcagaattcaatgacctcctatgttccataccccttggcgatgcttgtctctggacgagcacggttacgaacatacttcttcagaacgcccatgtacctctcgaaaggaaacatgttgtgtaggtacacaggcccgagaataccaatctctttgacaaggtgacaaagcagatgcgtcattatattgagaaatgaaggtggaaatatcaactcaaagctgacaaggacattgcaccatattattctgaagggcttctaatctatgcggatcgatgaccttctgcaaaattgcgttcatgaaagcacatagatttgttattgttgaccggacattgtctggaaggaaaccccttattataactggtagcagctgtgtcatcaacacgtgacagtcatgagactttaggtttgtgaacttcttctccttcgtgcttattattcgctttatattcgtggagtatcctgatggtaccttgatgctttccaagcattcaaacatactgtttacacccaaatttggcatctgtggacgaaatagggaaaaattgccaaagtttggaaagtaacgggtttccttactcgggaaggcaggtttagtgtttcctttggtttctatcccgagttggatgtggagaagggcctatagagggtaagaccaacccctatataagggacaaggccggttcattgtaaaacccccgaatacaatctacttgaatcgttcttttactatgtcttctattttaccctagtttagtccatctttgtcggtttgcgccgtaaaccgtccgccgccgctacgagagtgcgacacctctttgtatgtttgtcctgaaaaccttccgttttgcccacgagacgggtagttatcctcatatcgatctaaatcggcctagaggctgattttgatctctaaatcggctccgctagccggtttaggttttgtttctacaaaacccatcttgatttggccctttggctagatcgaggtggttggcgactccatatcaccgcaaggcgtttaggtgttgcgatcgtgcttgtcaacttgtcaaaaaagttgccaacacatactttccttctctgccttgctaagagtgtagctggctggactcaaataatgtcttcgtttctcctttggtttcgggtgaaggtcgccgcgttgttccatatgcttcagatcattacgtgcttccagtgtatctttcgactttccatatacacatcggaagccaagaaggtttacgcaaaggttcttagtgaggtgcatcacgtcgattgcgtggtggacgtccaagaattcccaatagggtaactcccaaaatatggagtttttttttccacatcgccacgtgaccatcttcgctctctataggctagctgccaggcccctttccaaacacaactttaagatatttcaccatatcaaacattgttttaccgctgtgatgttttggcttcgtacggtggtccgccgtatgttcaaagtgcttgcctttcttccgtactgggtggtttgctgcaaggaatcgacgatgactcatgtacacaaccttccgatagtgcttaagatacgtactttctgtttcatccatacagtgagtgcaagccttgtaccccttgttggactgcccgaataggttgctaagtgcaggccaatcgttgatagttacgaacagcagcacttgt

SEQ ID NO: 88184 - DNA, 1454 bp, Oryza sativa
ttcctaatcacaatataatcattaggtagcaatctattctcgaattcatacaaagaagaacataggaacgagctcacctctaaattcaattgtcgcgcacgagctcttgttatcggtccttgaatgaccgttggaggattgctgtgtgtatccgaggtagtgatgtccgcatcatcctccccctcttgaattgaagtcgtccttgactcaagctcatccttttctcccaagtatggcttcaaatctgaaatgttaaacgtgggactaaccccaaactcaggaggcaactcaagtttatatgcattatcattaatcttctcaacaattttaaaagggccatcaacacgaggcatcaacttagactttctcaattctggaaatctatccttccgcaagtgcaaccatactaaatcacccggttcaaacttaacctcttgcctacctttacttccagcaattctatacttttcagtcatcttttcaatattgaacttggttgactcatgcattttcaaaataaattcagcgcgtgccttagcatcattatgaatcctctcactagtaggtaaaggcaaaatatcaattggagcacgagggttgaaaccatacactacctgaaaaggacttaccttggtagtagaatgtgttgcccgattgtatgcaaactccacatgaggcaaacattctctccacatcttcaaatttttcttcaaaatagccctcaacatggtatccaaagtgcggctgactatcttcgtttgtccatctgtttgtgggtgacatgttgtagaaaacaatagctttgtacccaacttgttccatagtgtgcaccagaaatgacttaagaattttgcatcacgatctgaaacaatagtacaaggcataccatgcaagcgaacattctcatggaaaaatagatcagcaatatgaacagcatcatcacttttatgacatggtatgaaatgtgccatcttagaaaaacgatccccccccccgaaaatactatccctccccttcttagttctaggcaatcccaaaacaaagtccatagaaatatctgcccaaggaatagaaggtacaggaagaggcatatacaaaccatgtggattcaaacgagacttagctttctgacaagtggtgcaacgtgccacgaacctctcaacatcctttctcatccttggccaaaagaaatgcatggccaaaacatcttccgtcttcttagctccaaaatgtcccatcaaccctcctccatgcgcttcctgtatcaacaaaagacgaacggaaccaactggaatgcatagacggttagctctataaacaaatccaccattgagcacaaatttgttccaagtacgtccctctttgcaatttatcatcacttcattaaaatcaggatcaagcgcatattgttctttaattaattcaaggccaaaaatccgacaatcaagtgggga

SEQ ID NO: 88185 - DNA, 1920 bp, Oryza sativa
atgaggacccaactgctgtgaagcataagaaaccactttgccatcttgcatcaacacacatcctagcccctggcgagatgcatcacaataaacctggaaatcttttgtctgatcaggcagaattaaaactggtgtggacaccaaccgtcgtttgagttctttgaaactcctgttgcattcagcagaccagataaacttttcttccttcttcaagagctgtgtcattggcttggcaattttagagaagttctcaatgaaccggcggtaatagcccgcgagtcctaagaaactccgaacctgagtgactgtccttggtggggtccatttggtgactaactccacatttgttggatccatagctactccttgagcattcacgatgtgaccgagaaactgaacttccttaagccagaggtcacaattgccgaacttggcatatagctggtgctctcttaacttttcaagtaccaactgaagatgctgctcatgttcttcctcggacttggagtagataagtatgtcatcgatcaaaaccactacaaacttgtctagaaattccataaacaccttgttcatcaaattcatgaagaaggcaggtgcattagtgagtccgaaagacataactgtgcattcgaacaacccataccgagtgatgaatgttgtctttggaatatcctcttcacggatactcaactggtgatagcctgatcgcaggtctatcttagagaaaacagtagctcctttcaactgatcaaacagatcatcaattcttggcaacggatacttgttcttaatagtgacctcattgagtgcgcggtagtcgacgcacatccttttcgttttatctttcttttccacaaaaataactggagcaccccatggcgacgtgctcgggcggatgtatcccttctgtaactgttcatcaacttgcttcttgacttccgccaactcgttggctcccattctgtaaggcctcttgtggatcggtgcagttctaggtaccaagtcaatccggaactcgatattccgttttggtggcattgttgtcagatcgtccggaaaaacctctggatattctctgactatgggaatatcctccaacttcttagtggttttatccactactacctcttgttcttcactagtagcctggttcagactgatccctggcttctgcggtactggagacgggaaggttaccacttctcctttcgcattggtcaacttgatggtgcggctagcgcaatcaatcactcctctgtgccttgtcagccaatccattcccagaataacatctagatccttggattcaagaaaaatgaggttggctggaaaaatcaacccttggatttcaactgtcactgacgggcaatagtgagttgtggtcatgccacctccaggagtatgaactcgcataggtatcttaagcttcactaaagataacccatgtgcaccagcaaaacgcttggaaatgaaggaatgagttgcaccagagtcaaacaatattactgccggtgtcgagttgataggaaatgtgcccaatataacctctggtgctgactgcgcctcctctgcatacgcatgattgacactttccaaccgtgtgtccgggtttgttacaattgaagcagagtttgggctttcctccaaacctctggggctgttctggctgagctggcagagctgactgaactgactgatctggaatcattagtcgacttagagtaaggttgaggctgtgctgcttactgttactgtgcctgccactgttgttgatgccgttgaaattacccgggtggtacggacgatgttgccagataatcatggtggaaggtgcaccctgacatcccatcgtgaagcgaggcttctgacttttcccctgggaagtcttgaactgacctttttttacggttcattttg

SEQ ID NO: 88186 - DNA, 517 bp, Oryza sativa
aatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgatcggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgagg

SEQ ID NO: 88187 - DNA, 590 bp, Oryza sativa
aggggtccactgtatcaggcaacaactgtgcagcagttgccactattggtttggttgatgaaacaagttgacctggctgcttgatgcccaatgttgaaaatgatccaattcaaacaattttagagcaggcgcttcagtaaagtgtggttgagaagtatgaaagagaactagaaggaattgaaagcttggcaagtagcaactgtactgaattcatggaggttccagaagtggtcgctggaccgatccttactgagaatggtgatatacgcttaagtggacatgaagtgatctgaattggccttccagatggaggttttgctttctgtgcactcactctgtactgtgcttatcctttcatttcgttctgcttaaattgactgacctataaatatgaatatggtgttggattggtttgcaaagatcttttcaggtgtggatccggatgcatcccaggtttgaaagcattcttgaggcatgtcttgtactctcacccttcaaatttaacatttaaaatgttctttttgtctatccggtgttgtttggcaccttctctgccatggaagagctcgtctgtcatgaactgagcaatt

SEQ ID NO: 88188 - DNA, 2087 bp, Oryza sativa
tctgggtagtggtgggggtgcgactgctcctcattctctcccgctcgcgcgctcaagccgctggccaccgccacgtccgccgcggcggccgcgctcaagaccctgcgtgtgctagccgccgcctcgtccccgctcgtcgtagtcatcgcgacgtccaaggcgacctccaagtcctacaaggcggcatgcacactcagtctcgccacatgcctcccttccctcccttccgacaagtgcctgaaggccgcctttgccgccgccacgtcgcttctctgcctcacggccggcgcgccgcccccctccccccgtcgcttcccccaccgatgtcgcggccctcgtattcctcaagtctgggtacaagctgtccaagaacacgacggcgacgacgaagacataggtggatacagccgtggcgacgacgacagggaggatgcggcggcgacgacacgggagaagggaggcgacggcagctacgacgcttgagaaaggaggtggtggctaaggcatcccgtgcgacctcgtggtcggaccgtctgagtggcccgggaggcgtcggcggcggcggcgcgggcgagctcgaggatgaagatcccgcgcggcgacgaggtgagcgaccttgacggcatcacacctgctgtcgatgacccctacctccccgtcgacgcccgcgcacggccgctgcacgcctgcaccgttctcgcctcgctatcgcctccccgggcccatctttggccaccgcggagctccgccgggaggccgccgtgctttctcactgcggccgctatcgccgccgtcgcggcgctgccctcctctcccgcctcgccccgccgaccggcctacaggtagagagagataggaggaaccgaggaagaaaagagggaggagagagatgatgtggcagcctgacatgtgggcccatgtgggtcccacactgactcagccgccacgtaagataaaaccagggtcaaaaccactgaaggacctattgtgatcggttttgattagttaagggacgctggatatctggttttatggttgggggacaattttgtaactcaatgataagttgagggaccttcggtgtacttattcctcataagtatttgctccacgcgctttgcattacgagtccatgttagtgttagactttagaatttgttgggctggccatgtaaattccatatctcttctggaccaaaaacctgctcgcctaggcccactgctcgcgcctaggcccagtgtaattgcattgggaaattgaaaagatttttttaaaaaaaggaagaataaagcgcttgaagtcactcgcactaaataaattatcatctaatgaattgaaagaaatagcgtcaaacaacactacaagttggaaactggcctggccaaattggctatgtgtggtcgtgcatccagttcaactgagattccaattaattctagagtcgatatagtgttcaccagtttttgaaaaatatacacatgtgtgtgcgtccaatgaattcatgtgtaccacattttgagaatttgtttgggcaatttgaaacatcggaaactaaattgatactagagcaaaactctacgtaccgtatcggttattcacccttaatatacctacaggtacagaaacacgaatacttactctactataaaaaaattcacggaaattttagcagcaaattgcaaggtttgtgtaaatgtatgaaggaggatatatacaaaaccaaaactaggagcaagcaaaccgcaagatgagatatttttgggagaaaattaaaccacaagatgagatctgaaagtcgctagagtccaactatccataacagttggagacttgtatgcctcgccaaccttgtataaataagatgcaaggccatgtaaattccatttctcttcttgctttccatgaatatgctgctggtctcctcagaaattctccaacaatatatgatgacgaccgaggcaactctaaataaacctttgtaccaaataaaatgtcaaatcgtacttctaacattcgggtattcatcgagggtctaatttaagcttagaaatttcatctgctctctctgatcataaccatttaatgt

SEQ ID NO: 88189 - DNA, 802 bp, Oryza sativa
tgttgggcgcctacatcttcaccgaccggcttgccttcgtcgccgccggctggtgtccttgcctgcacggctggcctattatgccgccgttgttgggcgcctacgtcttcaccaaccggctcgccttcgtcgccgccgactggtgtcctcgcctgcacggctggcctattatgccgccgttgttgggcgcctacgtcttcaccgaccggcttgccttcgccgccgccgactggtgtcctcgcctgcacggctggcctattatgccgccgttgttgggcgcctacgtcttcaccgaccggcttgccttcgctgccgccgactggtgtcctcgcctgcacggctggcttattatgccgccgctgttgggcgcctacgtattcaccgaccggctcgcctttgccgccgccgactggtgtttccgcctgcacggctggcctttatgccgccgttgttgggcgtctacgtcttcaccgaccggctcgccttcgccgccgccgactggtgtccacgcctgcacggctggcctattatgccgccgttgttgggcgcctacgtcttcaccgaccggctcgccttcgtcgcacgccgactggtgtcctcgcctgcacggctggcctattatgccgccgttgttgggcgcctacgtcttcaccgaccggcttgccttcgccgccgccgactggtgtcctcgcctgcacggctggcctattatgccgccgttgttgggcacctacgttttcaccgaccggttggctttcgccgcggcgactggtgtttccgcctgcacggctggcctattatg

SEQ ID NO: 88190 - DNA, 517 bp, Oryza sativa
cgaaggtaagaatatagtctgccctctagaactggaggtgcagaagatacacgcatgtccgaatgattgtatcctctatcgtggtgagaagtacgagaacctagaagcatacccggtctgtaatgcactacgatacaagattagaagagtctatccaggtgaagttgacagacaagccttcgaagaggagagttgctgctaaggtgatgtggtatttccttataataccatggctcagatgtttgttcaggaacaaagagcatgaaagaatgatgcgatggcacgcagaagaacgtcaacaagacgggatgctgagacaccccgctgatgggtcacagtggcgaaacatcgatagaaagtttaaagactttggaaaggatgcacgaaacgtaagattcggtttaagtacggatgacatgaatccatttggagagatgagcagtggccataccacttggactgttacgatgtgtatctacaacctccccccttggctatgcatgaagaggaaatacag

SEQ ID NO: 88191 - DNA, 1209 bp, Oryza sativa
gctcgccggcggtggacttcagacggtgtagtggtgctggacgttgtccatgtcgaggcccttgagcctgacggtggactccatctggcccttgagcgtgctgagctcgcgcagccgggccacctcggcgcggcgcttggcctgctcggcgatctccgagagctccctgtagctgctccgctcgccgccgccgacgccgccgaggtggtcccccatctccggcgtctgcagcccgtgcagcgtcctctgcgccgtcgcccactgcgcctccctctcccctctcccgtaatccttcttgctcgtgaaggcaatctgcacgcgcacgcacgcaaggtgtttgtagttattccgcgaggagaaaaacacatgcaggcaaggtgtttgttgttatggcaaggttaccttgtgctcgatgagggtgtcccaggcgcggccgctgagggcgtagcggacggcgaacttgaagatgtcgagggggaggaaggtgacgatgctgtagagccagatgacgccggcccacccccagccgatgcccttgatgtgggcgaaccccaaggtggcgtacaccgtcaccagcgtcgcgatctgcaccaaatcagtccatcaatggcggcaatggcattggcatttgcagcaccaaatcagtccatcaatggcggcaatggcattggcatttgcagttgcagcagctaagaacaagaagatggagatcgagatgcttacgatctgcgcggcgacgaaggcgccgcagagcagcatgccggggcgctcgacgaagcaccagctgcgggagcgcgtcacgaagatgagcgcctggctgatgatgctcacctgcaggtacagtgccgacatcatctcgtccttctccatcagtggcttcacatggaacgtgctctgcgcacacaaccaaattcaatttgaattcgatcagagcagtggaatcaaaaggtttttgaggattctttggatctgtttgtttgattgtttgcttacggtgaagaaatcggtgctcctcatggcccagaagaagaggacggtcatgacggcgaggtaggtgccgtagacgatgccggtgatgaagatctccggcaacttccagctgtccgggtgcggcgacggcttcaccctgtccttggatattgtcatgatcgttcctgcatcatcaatcaggtacatcagctaaaattgtgtgtgtgtgtgtggatcaga

SEQ ID NO: 88192 - DNA, 794 bp, Oryza sativa
ccggtcggtgaagatgtagacgcccaacaccggcggcataataagtcagccgtgcaggcggaaacaccagtcggcggcggtcgaggcggccggtcggtgaagatgtagacgcccaacaacggcggcataataagtcagccgtgcaggtggaagcaccagtcggcggcggacgaggcggccggtcggtgaagacgtagacgcccaacaacggcggcataaaggccagccgtgcaggcggaaacaccagtaggcggcggcgaaggcaagccggtcggtgaagacgtagacgcccaacaacggcagcataaaggccagccgtgcaggcggaaacaccagtcggcggcggcgaaggcaagccggtcggtgaagacgtagacgcccaacgacggcggcataaaggccagccgtgcaggcggaaacaccagtcggcggcggtcgaggcggccggtcggtgaagatgtagacgcccaacaacggcggcataataagtcagccgtgcaggcggaagcaccagtcggcggcggacgaggcggccggtcggtgaagacgtagacgcccaacaacggcggcataataggccagccatgcaggcggaaacaccagtcggcggcggtcgaggcggccggtcggtgaagacgtagacgcccaacaacggcggcataataggccagccgtgcaggcggaaacaccagtcggcggcggcgaaggcaagccggtcggtgaagacgtagacgcccaacaacggcggcataataggccagccgtgcaggcggaaacaccagtcggcggcggcg

SEQ ID NO: 88193 - DNA, 711 bp, Oryza sativa
cgccggcctgcctccgtcgccgccgagtggtgcctccgcctacacggctggcctattatgccgccgctgttgggcgtctacgacttcaccgccggcctgcctccgtcgccgccgagtggtgcttccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgtctccgcctacacggctggcctattatgccgccgctgttgggcgtctacgacttcaccgccggcctgcctccgtcgccgccgagtggttcctccgcctacacggctggcctattatgccgccgctgttgggcgtctacgacttcaccgccggcttgcctccgtcgccgccgagtggtgcctccgcctacacggctggcctattatgccgccgctgttgggcgtctacgacttcaccgccggcctgcctccgtcgccgccgagtggagcctccgcctacacggctggcctattatgccgccgctgttgggcgtctacgacttca

SEQ ID NO: 88194 - DNA, 1068 bp, Oryza sativa
atttttgaaaccccacttgttccaataatattacgtctagaaggtggttcaattaaagtccaaactttgtttctctcaaaattttcaagttcttcatgcatggcgttaatccacgattcatcagttaatgcatgtgacacatctttgggttcaaaataagcaacaaatacagaatttgcacaaacatcatgagtcgttactttagaccttgtagtccgctcacctatattaccaataatttgttccggcggatgtcgtcgttgaatgtgcaaaggagcagcgacttctgaagttgattcacgttctgtatcattactggtcgaagtagtaatttccggaggaccatctcgatcagcatcaacagtacccaaacccgatgaccctagccggtctgaccgctcctcaggagccggtctgaccggaggtgtgccggcggtctgaccggcctggcgcccggtcttaccggccgagccgacctcatcgtcgtcgtcgtagtcgctctcatcttcaataatacgaccatcctcccctgaacctgtgacagtgtacctgcaatatcgggtctagtacctggactagcctcatcaaaagaaacttcgcaagtctcaacaattttgttagtccctaaaataagtacacgatagccatgagtatgagcaaggtaaccaagaaataatccatcggtagaacgtgcctcaaacttatctaaatttccagatttcaagacaaagcacttgcaaccaaaaacacgcaaatgtgaaacattgggttgatgaccaaatcgaagttcataagaagtttttccaagtttagaacgcaagaaaactcgatttgaaatataacaagcagtgttaattgcctcagcccaaaattttctaggagttttatattcatctaacattgttctagccatctcaacaaaacacgatttttcctttcaacaacaccgttttgttgaggaacacgaggagaagaaaattcatgttcaagacctctttcgttgcaaaattgttcaaatgaagcatttttaaactctccaccattatcactttgaattcttttcaaaga

SEQ ID NO: 88195 - DNA, 515 bp, Oryza sativa
aggtcatgagttggataattcccttcgtgtggacgcaactgccgcgaggcatatgcaaccactctgccctcttgcattaggacacatccaagtccgtgacgggatgcatcgcaatagacttggaagtctttcatctggtcgggcagaatcaaaactggtgcggatactaatttcttcttgagctcctcaaaactcttatcgcactcagctgtccatttaaacttctcatctttcttaagcaactgagtcatgggtcgggcgatcctggagaagttttcgatgaatcggcggtaataacctgcaagtccaagaaaacttcgaatctgcgacacggtcttcggtggggtccatttggtaactgactctacgttcgatggatcaactgccacaccctgagctgtaatgacatggcccagaaatttgacttccgtcaaccagaagtcacacttgctgaacttggcgtatagctggtgctccttcaacttctcgagaaccagacggagctgttgctcatg

SEQ ID NO: 88196 - DNA, 565 bp, Oryza sativa
ccaatatgatcggcatccatgacgtgttccacgtgtcccaattaaagaagtgtttaagggtacctaaagaacagcatgattcggaacgcattgatattcagcaggacctaacttatgtgaagaaaccggttcgcacacttgacaccagcgaaaggagatccaaaaacaaggttacccggttttgtcgagttcagtggagtcatcattcgtaagagcaagcaacctgcgaaagggaagatgagttaaaagccgcccatccgcacctcttcaccagctcgtcagaatatcggggctgagattccgtttaaggggggtaggtttgtcacgccccgaagttttcctccagagccaggattgtaattttccaatgaccccaaagataatgcaggtgaaatcaggagaaaaccataataaagtaatgcaaataataatcggacttgacatgtggaatttttcttaagttttacatgtcaaaattcattaacaggatttttagtggtattttcagagctctagaaaaaattttaaccaattaaaattgggcaagcaatattttaattccagg

SEQ ID NO: 88197 - DNA, 627 bp, Oryza sativa
caaaatcaagagcgcaagctctcaacatatcttccaagatttgattgactcgctcggtctgaccatcagtttgcgggtgataggccgtgctgaaatttaaacgggtccccaattcttcttgtagtttctgccagaactttgaagtgaactgactccctcgatcagatacaatctttttgggtaccccatgtagacacatgattctcgagaggtagagctccgccaaccttttgcccgtatacgtggtatgtactggtatgaagtgagcaaccttagtgagtcgatccacgactacccagattgaatcgtgacccgatgatgtccggggcagtcctgttataaagtccattccaatctcctcccatttccattccgggatttgaagaggttggagtaaacctgctggtctttggtgctctgccttcacccgttggcaaacatcgcagagtgcgacgaattcagctatttctctcctcatgctgacccaccagaatttctctttgaggtcctggtacattttagtactgccgggatgaattgaatactgggtctgatgagcctcggtgagtatcagatcttcagttccttgtcgtcaggtacacacaatctttctcccatccagattgt

SEQ ID NO: 88198 - DNA, 1436 bp, Oryza sativa
ttctttccgggtgcacacgagtgagcacaaagtgtgcagaaaagatatgtgttggtctgtgagggcagtttatgacctatgaaagctatcagatgtaagcgggcccggcctgggggaaggcgggacgttacaaaatggtatcagagccaactctcgcggtttcacgggcgcgtgtgtcgcagttgcgcaggcatggtgcgcatggctggtgtagaccgggagtggttacacagcatggcacatgcgctggcactggacatatggacgtggccaagagaggacgttcctggcctagggttgatcgacggggcgtcgatctctcttaagggggtgagggtgtaacatcccggcctagggcttaataggattaatagaatactcatatcaacaagttgcaacttcttttccggaagccaatctcaaaagaactccagggttaagcgtgcttggcctagagcaatttgggatgggtgaccgaccgggaaattctttccgggtgcacacgagtgaggacaaagtgtgcagaaaagatatgtgttggtctgtgagggcagtctatgacctatgaaagctatcagatgtaagcgggcccggcctggtgggaaggcgggacgttacaactgaaaggagctaaagtgttttctaagatagacctgcgatcaggctaccaccagttgagaattcgggaagaggaaattccaaattctttccgggtgcacacgagtgaggacaaagtgtgcagaaaagatatgtgttggtctgtgagggcagtctatgacctatgaaagctatcagatgtaagcgggcccggcctggttggaaggcgggacgttacaactgaaaggagctaaagtgttttctaagatagacctgcgatcaggctaccaccagttgagaattcgggaagaggatattccgaagacggccttcaccactcggtacgggctatatgagtgcacggttatgtctttcggacttaccaacgcacccgcattcttcatgaatctgatgaacaaagtgttcatggaatttctggacaagtttgttgtggtgttcatcgacgacattcttatctattcaaagtccgaagaagaacatgaacaacatctccgtctggtactcgagaagttgagggagcaccagctatacgccaagttcagcaagtgtgacttctggttgacggaagtcaaatttctgggccatgtcattacagctcagggtgtggcagtcgacccatcgaacgtggagtcagttaccaaatggaccccaccgaagaccgtgtcgcagattcgaagttttcttggacttgcaggttattaccgtcgattcatcgaaaatttctccagaatcgcccgacccatgactcagttgcttaagaaggatgagaagtttaaatggacagccgagtgcgataagagcttcgaggagctcaagaa

SEQ ID NO: 88199 - DNA, 865 bp, Oryza sativa
aaattcagagcatataacttctgggaagtatatttcaaaccaccccaaatataggaccaaatatatggctatctcactctcctgagaaagatcaatagtgctaataaaatctgaaagagcctgaaactcagtataagcttggtgagacaaaggcagctgaaaattgtctgacatttgagctgacagatagccatgcacaaatgatattttgttggcagcaaatgaataaagtctaggcattgagaaactgagagggggattatcagaccaaatatcctcccaaaaagaacatgttaaaccattccccacattgcatctagcaatccctctatagaaatccatcagcttataaatatctctacaccaaaaagaccctttagagatgacaaatgaggggccacttgatcataataagaggaccagataagatcaacccatggcacattccttctattatagaatttgtccaaaaatttcaccaaaagagcttgattccgaatagaaaggttgataacaccaagccccccttttactttaggtttacaaactttgtcccaagctgctaaattttctgcttgaattcacatatgaacatctccaaagacaatgtttccttgcactatcaatattatcaattactgtcttaggcaacattatagtgcacatgtaattggttggcaaggaggagaaaactgaattaactagagtaagcctattaccatataacaagaaatctgagtttgcagacaatctcctttcaattccttcaactagaggagcaaaatcaaccactctaggcttagttgttcccaaaggcagaccaagataagtaaaggggagtgaaccaattttgcaaccagaaacc

SEQ ID NO: 88200 - DNA, 956 bp, Oryza sativa
ccgcgagagttggctctaataccattttgtaacgtcccgccttccccaaggccgggcccgcttacatctgatagctttcataggtcataaactgccctcacagaccaacacatatcttttctgcacactttgtcctcactcgtgtgcacccggaaagaatttcccggtcggtcacccatcccaaattgctctagtgaggccaagcacgcataaccctggagttcttttgagattggcttccggaaaagaagttgcaacttgttgatatgagtattctattaatcctattaagccctaggccgggatgttacatcagttgatcaaacaaatcatcgattcgcggcaaaggatatttgttcttgattgtgacctcgttgagtgcgcggtaatcaacgcacatcctcttcgtcttatcctttttctccacaaaaatgaccggagcaccccaaggtgaagtacttggtcgaatgtaccctttctgcagctgcttatcaacctgcttcttgacctctgctagttcgttggccgccatcctgtacggtctcttatagattggagcagttcccggtgccaagtcaatccggaattcaatctctctcttgggtggcatggtagtgaggtcttcggggaacacttctggatactcgcagactatgggtatatcttccaattttctcgagttcttctctacggtgtccactgggatttccgcttcaatctgattcaaagagacccctttctttggcgagactagagatttgtacaccacggtttctcccttctcgttggtcaaggtgactgtgcgatttgcacaatcgatgacccccttaaacttggtcagccaatccatcccaagaatgacatctaggtctttggattcgagaagaatgaggttggctagaaatggtgatctttgaatttctattgttatagaagggctgaattgaaccgaagtg

SEQ ID NO: 88201 - DNA, 611 bp, Oryza sativa
  unsure (1)..(611): unsure at all n locations
aaagctagatttttgacccggctggaaacagttgacaacgtgcgatccattcgcctgattgggcgtgtcgcgtatcaaaataaacaaccactaatacattctcaaatcatcctacttgccctacactntgcagctaacaatgattcatttttaaactgtgctctcaaattgtaatccccccaaattgcaacacaaatcatgtggtcaacaccaacgaattntgctgtaaattaagcntgctgtgtgatttaccttgtcgagaagaatgttggaggccttgaagtcgcggtagatcaccggcgtctcggcctcgtgcaggaaggcgagccccttcgccgcgccgacggcgatcttcagccgcgtcgaccatggcaacgaagcaagaagatctgcacacccaatgaatcacacactcgattagcaaaagctgcaacagctaacacacggtaattaaccccaaatcatgtggtaattagtaactacttactcttgaacaggtggttctcgaggctgcctcttggcatgtactcgtagaccagcatcctgtgatcatcttggttgcagaatcctaccagcttcaccagatgaggatggctcagcatccccagata

SEQ ID NO: 88202 - DNA, 723 bp, Oryza sativa
  unsure (1)..(723): unsure at all n locations
gacgcgcnttgaagacaatttgcaagnccccnnnnnnnnnnnnnnnnnnnnnnnnnnnnnnnnnnnnnnnnnnnnntgtcagacccggatgcattgcagacttccatcttgttgcatcgaactaaaacagttcaattcctgtgaaaaattgaaacactgcatcaggttgtaacagacatcatgaataaaccggcaattgatgtccgcgaaccatacatgagtttgcatatatatgatataattgcatagcataggctgccttaccatccatgaaccatccaccatcagaggtgatgtacgccttcgagatggcgagatcgagatcgctcagaacttgcaccacctccaacaggatgccattcttgttcatgctgtcgacctacctccaaacgcaaacagacggtgctcgaagcaatcagtgaaacggttcttgaatattggaagcagtgttcagtaagattatccagtcaagttttgagagagagtagtaagtagttcttaccttcactaaggtgcagtcgctgcaggtgctgttgtcaatgcataccctgcagaaaattatcagcttgttagctacagaaagtagcggagctttcgacaatagcctggaatgaaacaggataatgatatgaggagctctggaatttagatgtttaaattagagatccacctaaggagggttgatgcgctgactgaagttctaatactcgggtcaaaagaagg

SEQ ID NO: 88203 - DNA, 727 bp, Oryza sativa
  unsure (1)..(727): unsure at all n locations
agtgtgccttttgagtgactaactcctnnnnnnnnnnnnnnnnnnnnnnnnnnnnnnnnnnnnnnnnnnnnnnnnnnnnnnnnnnnnnnnnnccagtaaattgattctccactctctgaaggtactcagtgggtggtacaagctgggattgctcagtactatttttcatgaggtgtttggaatggatagtggagatatggagccaacaattcctttgaaaactttccatgaaatcaagaatttttttgtgactatagatttacactgaagtgtaaattaaagttgaagtgaaaaactgaaaactgaagtggcagtatcaatttggttaaaattgcaggcgttaggcccagacagcaacctgctgggtggcgcgaagggcgggtcgtcgccggtgaggtcggtggggatgcactccatcggcgaccacaccgccatcgagctcaaggggcccgaccggacgggcctcctctccgaggtcttcgccgtgctcgccgagctcggctgcaacgtgctcgccgccgaggtgtggacgcaccgcgcccgcgtcgcctgcgtcgtgtacgtgaacgacgtcgcgtcggggcaggccgtcggcgacccgtgccgcctgtcccggatcgagcaccgncttcgcctcgtnctcccgggccacgccggcggcgacgacggcgacggcgacgacggcccggcgcacgccaacttcttcttcttcggcggcgccgggtcg

SEQ ID NO: 88204 - DNA, 648 bp, Oryza sativa
cccccatggattttagacaaaccggaaacgggaagaaaattcccgaaaacgggaataatccttcccgaaatcaggaataaccttcccgaaaacggtagacacccaatacaagaacaagaacagtattaaaagatcttcgtccgagaattctgacgaatcctctgacgcacgtctgaagaaatttttatcaactcatcctgaagctgcggtctacacaccatccggtgcgaagtggggctctgctgaagacctcgagacagctaagtggatttcctccagggtgaagctgattaacccaacctgcaaagccccggacatgacctcctggtctaacactgttcgcctgatgcgccagatagacaaccggtcgcaccaggacatctgcgcgctgtatgactgggctagcaaacaccacttctggcagaccaacatcctgagtcccgaaagcctgcgtaagcagtgggacaagctgacaatgcagcgtaacgccggaggtgagcagcgcgctgtcaagccagatctggacttcaacaacactgactgggcctatggggggatccgatgaaatctcttgcagagcagatgcgtaaccacgaccgcgagcagatgagccgcatggtccataacctgccagagcagtaccaggag

SEQ ID NO: 88205 - DNA, 731 bp, Oryza sativa
  unsure (1)..(731): unsure at all n locations
gcgcgttgtattatcctnnnnnnnnnnnnnnnnnnnnnnnnnnnnnnnnnnnnnnnnnnnnnnnnnnnnnnnnnnntgatttattataagcagcgacggatggacatgccgatcgtgttctgggaaaaagacttatccatgtgccggtggttgcggttctctaggctattgaaaaacaacctactgatcggggtgattccatccgctgctctcacagtttccaaatttgaagattttcgtttttgcgcgaaacttcttatttttgtggacggtaattaccgagctcccagctgtataattgatgcgtgccctggaaggacttggcacataacaaactgagtggaacggatcctacactggtatatggggacgacgttcttcaatacttgtgagttatccatattcagcgctgccagttccaaaattgtgcacaatgtctagcttatgacgcttttaatgccttgcaggtttgtacctacttgcatgccattgcttttttactgtttttttggaaaatcattcgaatctctttaaaaacatgttttaagcttttttacgctgctcaaatgtatattgactttatgttgactcactaccattgtacgcaggccgcgttatgtcaaatactgacatctcttatctgaattgtggctgaactaacattgtccctacgggattacgcgctcttaacttgatacggcagtgattgccaccgatatatgcccagctga

SEQ ID NO: 88206 - DNA, 691 bp, Oryza sativa
cctgcagccccgtccgccggggaggtcgaagccctccgcttggcaggcgagatagggcccggcatgctttgggacggcgtctcccgcctagattgcgccggtcggcaagtgggcctctggagagggcggaccgtaaagtacgccgccaaccagggaggcctcgcccagcgcctctcgaagatggctggggctctccaacggctccccgaggagctcgagaagacaattaagtcatcctcgagggacctcgcccaaggagcggtggagctcgtcctggcgagttaccaggctagggaccccaatttctctccatggatggcgctggatgagttccctcctgggaccgaggaccgcgcgcgcgcgcaggtccgggatgccgccgaccatatcgtcgacagcttcgagggctcggcccctcggcttgcgttcgcccccaactccgacgaggagggcaatgccggtggtgcagacgacagtgacgtcgaggccggcgatccgggcgcatcggattgagcccccagacccccgccattcttcagttttttcttcttttctttcttctaaggccttcgggcctcttttttgtatagatcaacttaatctgtaatcaaaaatgaagaaatttttgtgttaatttcatcttgctgtgagtatgagatgaggatgatctgtgccgtggtccttttgtgtc

SEQ ID NO: 88207 - DNA, 662 bp, Oryza sativa
tgatgcagttcgacggctccctgtctcttcagggggccggtgcgggggtcacgttgacctctccgagcggagacgtcctcagatacttggtccgcctcgactttcgagcgaccaataatatggcagaatacgagggactccttgccggactaagagtggcagctggactggggatccgccgcctcctggtgttaggcgactcccagctggtcgttaaccaagtctgtaggagtaccagtgctctgacccgcagatggacgcctacgtgcgccaagtacggcgtatggagcgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatgcgcctgaccggcccctgaggcctgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcgacgcg

SEQ ID NO: 88208 - DNA, 5907 bp, Oryza sativa
tcaggaggaatttgattaggaaggatttggattcggaaatgagctcgacgatagatcggggttttgagatctgagatggcacggacactagacaacaagcaaagaaacaaatttcgcaatttaggtttttaagagataattttcccgctaggcgccacgacggaacgggcgctacatttagtgagcctagaataccttaatcttagtcaaaacagtcttgttgattccattccaaccaagatcattaacttaaaggagctcaagtccttggatctttcagataataacctctctggacatattccggagcaaattggtaatttagtgaggttgaggtccttaaaacttaattctaatcaactttccgggcacattccaaacaacttagggaatttggctaaactctgtttcttgtatcttcaaagcaacaaactttcttggcacattcctcaagaactaggttccctgttgaacttaaaggacctacaactttacgataacaagctcataggttccatcccaaacagcttagggaatttgaccgaacttagtgtcttgagcctttctggaaacaccttgacgggttctatcccaaataacatttgtaatttgactaaattctccatcttatctctttggagaaaccaactatctgggtacatttctcaagaactaggtaaaatgttgaatttagagagcttatatctgagtgaaaacatgctcacaggttccatcccgaatagcttagggaatttgactaaactctctttcttggatctttctagaaatcaactttccgggcacattcctcaagaactaggttacttggtggacttaaagaatttatcactttatgacaacgtgctcacaggtttcatcccaaacaacatagggaatttcactaaactcagtatcttgagcctttctggaaacatgctcacaggttccatcccaaacagcttagggaatttgcctagactctccaccttatctgtttggagaaaccaactttctgggtgtatttctcaagaactaggtaacttggtaaatttagagaacttataccttagtgaaaacatgttcacaggttccatcccgaacagcttagggaatttgactaaactcactgccttacatattcgttctaaccaactttctggatccattcctaaagaaattagcagcttaatgaatctaaatattttgcatatcgatcaaaacaacctttctggtgaattaccattgggtctgtgcgctggaggccagctacagaatttcactgctcaggataacaacctggttgggccattgccaacaagcttgctaaactgcaaaaccctggttagagttcgtcttgagcgaaatcaacttgaaggagatatctccgagatgggccttcatccaaaccttgtctatattgacatgagctcaaataaactatatggacaattatctcatcgctggggtgagtgcgccaaacttaccactctacgtgcatcaaataatcgtattactggagtcataccatcgagcatggggaaattgtctcagttagggagacttgatgtttcatcgaatgaaattgaaggacacattccaccagaaattggtaacgtagtgtctctattcaatttgagccttgcaaacaacatgctccagggaaccataccaaaggaagtaggttctctacaaaatttggagtatttagacttgtcatcaaacaacctaagtggacagatacatggatcgattgagaactgtttgaaacttagattactaaggctaggccataatcgcctcgatggaagcattcctgttaaactagggatgttggtaagcctccaagaattgttggatctaagtgacaattcattttctgggatcataccaagtcagctgggtgctttgagcatgctcgaagctctgaatctttcacacaacacactgaacggcagcataccatcatcatttcagggtatgatcagtctctcatccctggatgtatcatataataatttggaagggccagtgccacatattaacttcttggaagaagctccgattgagtggttcatgcacaataaaaagttgtgtggtacagtcaaagctttacccccttgcgaccttaatcagaaaggtggccagggaaagaaattcaaatccattttacttggtatagttggtgctgctggcatgtctattgtgtttatcatgtcactagtggcatggcaatgcaaaaggaagaaatatggggaacaaagcgaaaatggagttggagacgcaaaagtgttttcagtctggaactttgagggaggagaagcatgcaggcagatttttgaaacaacaaaatatttcaacgaaactcactgcattggaactgggggaaatggatctgtctacagagctcagttaccaacaggtgagatatttgcagtaaagaaaattcatatgatggaatatgacgagctaatatttaagcgagaaatagatgctttgacgagaattcggcatcgaaatattgtgaagctctttgggtactgttctgcagtccacggcaaatttcttgtctacgaatacatggatagaggaagcttgtcaagatatttggagaaccataacattgcgattgaattggattggatgcgaaggataagtattgtcaaagatgttgctaatgctttgtcttacatacatcatgattgctttgcacccatagtccatcgagatataacaagcaacaacattttgctcgatcaggaattcagagcttgcatatctgattttggtatagccaaagttctagatgtggaggcatcgaactgcacgaagcttgctgggaccaaaggttaccttgccccaggtaaatttgtactaaatcagttgctctgtccttttgtatattagtttgtaactctgacaaatattcgagctaactgttaaagtattcgtcttactagtatatctttgattcatagtagtatattagatacaattaggcaaatttgcatctcattttgtaaaaatagcatcgaatgccttctatactatttacatatgcaaatttgttgaaacaaagtcttaaatttttacatggcagagcttgcatacacaacaagggtgacagagaaatgcgatgtttatagcttcggagtgcttgtctttgagctgttcatggggcatcatcctggtgatttccttttgtccttctccatggccaaggaaagtacaacattgaaggatttgttggacgcccggatcccacttcctaaagctgagacagcaagtgaaatatttagagtgatcatggctgctgtccagtgcttggaccccaacccatcacgtcgtccaacaatgcaacatgtaactcggatgttttctacagctgaaggacctagcaatcctgaccatctacatgttgacataatcatccctgcgtactaccagtgaatgttgtcagaaaattgctgtttctcatgttgctcagggttttttccccacaagaatgtggcaattcacaccataggtaggtcagtctattgcacctgttaatgtcaacttgtcaagtattataaagcatcacttgtatgatgatttgtgttctctctacttcgttggtgttaattgcgtggttgtcaaacatacctgcattttgtacacgaccctaatacgtgttgctggtgatgttcttgtgcttactatgctaccttgtttgatcaatctgctttgttgtaaattgtaatacgaatctctaagatttatgatggatggtatacatggctaccattttctctgactacatggcaatgaggcttcttgttctcctattctagcaaatactgtataattgtatgtttagtatcaaagttttcagatgcatcttttgtctctgctctccttgtgttggtatgtttcagtgatgataagtagtagctgcttaaaacggtttggttttatcatttttgaaattgttcatgagataagctgagaattgcttactgtttgcctgacattcaaaacggagcctgataaattgcagaattttcaggtcatcttaattctcagagcttcagtagacttgagaggatgtgtaatatcgctttttccgcctccgtgcctcatgcggcatgtcactcttctcccatgatcacctcccattccaaccgttgtcgtcaccaccgctgtgtttggccatcactcccaccctctccacttatagtgttagaataggtgtcgaatatccttgtcttatgaagccataggactgggatatccaacatacagaagaatttctttctacaaagcaaaattaatggacaatctgaccgaacaactcatcaatgttgaaactgatgcaactcatatcatccatctcaatgaagttgatgttgcaaactgcaaaggtcatccatgctctctagaactccaaaaatccgtgagcactggcacctccatgacgcccaatgaaggagtgcttcttctggttattaggcgacgatgtcacatcttctactggagagtcgtccatcacaccggatggatgaatcggtgaactgagagatgatcaaaccacaccaattacacctctcatcaccataaactccagacaaatatcataccatgagctatacaaattctttaggaccagtaactgatttggcaagacgggtcatctgagggttcgctgcggttcatttcttataaatgtatcgattagttgtgttgataaggatcatgatgaaattgcaagtacaaatggattgagacctgatcagttctgatcctttggcatgggaaattcttccttttactctctcttttgaatgagtcgtagtgcgctcatcaagaaggggaaagatggatgggaaatgcttgtcaagctcggttctttaaagaatagcatcctcatcttcctagtaaaaagcacattgggattctctacttgtggtggtggtgagccgtgtgatgggaaaccatcccgcacagttcggagagtaccgaaggtgaatgagaggttcaccaccacccatatactggatcaaataaaaacactgggcttccatcaagccactactacatcaattgcattaggaatcgaggatcttttaacaataccctctaagggatgacaatgcaacggttatcattggtcaaaaaagaaatccaaaaggaactcgcgtttttggcacgatcgccgaggaagcagctctgatcggtgccattagagcaagtttaatagtatagacagctgtaagctgtaatctataaatagtttatacatgtcatctatagataagtttagaggggcttcaacccctccgtcatgagcgccgtcgtcccagtgtgccacacccgccgctgtgcatcgtgcagccacggagccattccaaccgtcatgcaccgactcaattaccgcgtgccgccccaaccgagagagggagggagttgcttctgccgccgtcgttgtgagagaagggtgaggaagggagctgcaaccgtgcgccgccactaccgacgtgcgcagacgctaccgccgtgcgacgatttctcttccaccgtcgcgagagaagggccaggaaggggttgggaatgcgtcgctcgcccaatgcgggagggaatcgaagggggtagagtggtggcattttcctataacttcagtaaaaaggaatgggtagtgctgtaattattttcggagtggagccgtggagctacattttcgccgctccacctcaatacaatattttggagcgatccaccccgttccgatccagtttttggcgaatctgaaccgtttggttgagcttcagctccaggtaaaatgaatctaggagctggagttgtaccaaacagacccgtaatttctataatactccctccgtgccataatataagggattttgatattttgct

SEQ ID NO: 88209 - DNA, 6914 bp, Oryza sativa
tcccaccgccccgtcgcgccagccgcctctttccccctatgtcgctcgagagaagagaggagaggagaaaaagaaaagaaaggagatatgtggggcacacatcattttctctcacttacatgtgggccccacatatttattttaactagttttgctgactaggatgccacatcagtgaaatcaggcctctatactgccttgggacctcttttgaacggttttgtatagtttaagggtacacatttctgattttgtggttaagggaccttaaaaaatctcgctgttaagttgagggacctccggtgaacttattccttatattttaggctctatctgattcgcatgatagaataaaacatataaaaaaaatacttgaaacgataatatgagctcttctgatggtgttataggaaaaataaaggtaagtttacaggtcatatcttttggtaattttcctatatattattttgtataaatcaaaggaaaatttaggggaaaaagtctataggatttaaatcctattaatcaaaggggctcttactcattatgtttttctattttccagaggttttcgaggttagacagtgagaaaacacgttacctaggttttgtttagaagaatttttagcagtggtaacttctcatagaatcagaaactcccccaaataaactagctttttttttatctaggttataagttgtagttacagaatccaaaaatgaattcgaagtcaaaagttgagtgattaccatccagctgcttattagataagctatatcttagttatttttctataggtgtttacaggaaggatggtcccaatctagtacttggatgtgatataatcctgtccagatttattgtactatattatatctcatttaagcaatccatttgtttcacaatgtaagactttctagcattgtccacatatatatagatattaatgaatttaaacacacacacacacatatatatatatatatatatatatatatatatatatattaatgaatttaaacacatatatatatctagattcattaatatctactagaaagtcttacattgtaaaacgaatgacaacgaatgaagtattagatatgtctagatttattatactaaattatgtcccatctaaatactgagttttttttttggcagaaagagtagggtgtatggagcgtgctccgtgcaacgagggtggggaagcgagtggacaaatgcctatgctattataaataaagatgcattaatagattcccctctccttctcccgtagctcaacacgtccctatactttgggtaaataacagtcaaatccaatattttatcctcggttactcttgtaggccatctctaataatatagatatatgttccgtaataatgtacgagtatattaatagtataacaaataatttagtcatttgtatcctcttcacaaatggaaaggaagccactggaaaaaaaaggttggttagggctttgagcgtgtccacacactaggctaggctatgcagtctgaatatcaccttacgcattaccttcttcaaggcccgttcgaacctgacgcattccactaaaaatagtgaaattcccaccgacatggcaaaatttcacaagcaaatacaaagcggcattagagatttaaagtaaaacataagtacacgcagaaaccaaccaaccattaacagatggacctccttacccaacgtacaaaatgaggagagcacattaggcacatagctgcttctttggcacaataccagacaaggccacattttccgcgcatgaccaaactaaaacattacttgatattactagacagggtaatgaagattaccataccaaaagtgcaatattcctcggagtcataaaagacagacgtaggcttagtctacttgcatcacaagagaatgggctccgatcacgcattctccttgatggcctcatctatagctttgatattgtccctcagtatcttccactgcacatgttaaaaagaaggtgagtgtttattgggaggaactgataacttgctagtacagtaaccaagatcacaatggttaccacagtagttatgaactagattgcgatgtaaaaagttatggctagcaataagaattgttacaggtataagttatttgtgtttcagtgcagctagaggccagaatttaacagtatgcatatcatatctggcatataatatacttgagatcattctcgtaaattagataggtagttctcaccaatcttgcatagcactatctcctgatgagttcaggatatctaagcatgtgaagcttgttaggaaatttttcataagcggtacttgctatccacaatgcagcattcaaacagataatgatataggagtatcttttaagggaatcaagtttcgtgagcgtgtataggacaaataaaaacactgacctgatccatcgggagctgtatacctgaaaagaagggaaaaggcacaatattagtaatcagggaaactattgcttatcttgagcacattaccgctggtgctggagatatggaattaaattacacaaccactgttttttactatgcatccacacttttatgttataccatgccatctgtgttatctaccatatggaatcaattttagaattggaacccatgttctgggcttagaaaaagcatatgaaagccccggaatatttgtttgcaaacttatcattacactctttggaatctaataccagactaaaactcattcatagctatcaacttgggtgactgtgaataggagtattatcgataaccccccaaagtagatggtctcaaattacaggtgatgagatgagagaaacccatattgttgagggcatatgcaattgaacagggtaaattctccctcaacaattttctacctaaaattgtgaatcagtgatgggttcttcagactttcacgttcatttatacttgcaaatgaccaccagctcaagcttcgaacttcgaacacaatacattaaggaatcattatgtcgacaaacacaaaaatggaaagcaaccatttcgccgataatcatacacggtcctaaaggccagcgggcatggggtatctaagctaacgaagccgctcgtctcaccagcgtcccgcatttagttcaagaaacgaacctcaccctttttttcttgcagcctagattatctcccatgtaaatcattcgttcaaacaggacaccaacaattcaacatcatcattcacaagacatgaacacatggtgtggtactatctagtatctactcaaaaagctagaggtggcatgcctctagcaacatttaacgaatcttggccaatccaatcccgtgctattcacatccataggggaccaaccaacgggaagacagagaagaggaagatttcactgtgatattacctttgcggccggggagggtcttgccgtccttctcgtagaactcgcggatgtcgacgacgaccttgccgttccaggtccgcaccgccaccctcctgttcttcgatatctatggccaaaccaaccccccccccccccccaaaaaaaaaaatgaaaatgaagatccccgccgcgctagggttttagtgaggtttgagtgcggggattagggaagcacctgggcgacgacgatatcgtcgtcggcgctctcggagggcccgtcgtccccggcggcacggcgcttggccgccggctcgccgccgccgccgaaccgcttgttccccttccgccacattcttctcacactttctccctctggacttgtggagtcttggaggaggaatgttcgaatggaatcgacctaaattggaggttttaattcccaaatcagaatagtagtagtagtagtactgaattagtgatggttcagttgggccttccaggccattttagtgtgtggaaaagatgtccaaggccattttaggcccagtatcagtaatcctcctcagcataacgggaaggaattaagggtgaaaacggtacggaaattttccggtcattaccgatactgttttcataaaattaatataatagtaatttgcagataactgcaaatgtagtcactaaattatttatttgctacaacattagcgacctaacagtttgatgtaatgataacggagaaaattatcacaaaaccataactttgaaggcatcccaatgttactgacatttggggcccacatgtcatagaggtggtacccagcataggcgagggacggagggacatgtcagcatgatacgtcggcttgtgcattgcagcgacaccgctgtgtcggcagactgctaagtccgccactttgatttggacgccttgtaatgatctaatccgattgaaatgccactcgtacttaatcagtgcaccaagtcaaaacccgtcaagcttcaaaagagtagagtgtaagacaaaagtaccattgccgtaacctagaatgggttttgacccgattacgtcgacctagcggattcctctgccgacatggcatgatgctacaacgtactgctccgtcccataaaaaactaactcctaactacaaatctggacacatgtatgtctagattcatagctaagattaaactctttttggaacggagggggtatgtgctaatgtgctatgctaacaagtcgtctgggctctatgtgtcactagcttatggtgctcttggacttggagcaaactataaaatatattagtaatgttgtagcaagctgatattttagtcattaaatttacggttatctaaaatttattcttaatataataataataatatctctaccgcctgttaccgtttctaaaatttagtttttctattttttatcatcgttgcattaaagttgacaataaatacctaagttcaaaattttactaccatttctgtaataataaaagataataataataaaatgaccgaacatttccatccctaccagtaatagaaagcggcaaacagacccccactccctagtaaaatcagtaattctagccgtccatctttactttaccctctcccctgttattttctacttatggatgaatgcgcacaatttccaaacttctaaaccattcgatttgtgcagaactttgaatttcttaaaaactgcttttaatccatttttcaactttataatggttagttcattcatttgtactctcaaataattatcacaaattagtactacctccgtctcaaaatataataacttttagctataaatctgattaagcaccttttcatattcataactagaaatgataaattttgagacaggagtaacatatagctatttagtcattagcacaataaaacgcaaacatcgagtctccatccatatctcaatgcatatgacatttttatcccaaaacccaaagaactggattaaactggaggatcagcacattttcattgtttctgtccgtctacatatatatacatctagacctgtcttaatgtaggaatttaaagttttcctacgaaatttctacttcagacaatgcctcgatctaacaaattaggccgagagccccgatctgacttaaatcacttctctacattctccagttgtgaatcatctctctccttttcttcatcctctttacacttctctacatcctccatctgtgaatcgtctttctccttttcgctatcctctccaactgtgaatcgtcttttgttggcactcagacctgatgaatgtagctgccctcgtttcttaacaagacgtgctgcagtttcacgatcagactttgcttcattgttgtcaggctgtggaaacaaataggaaaagtaagatacttatataattttttttgaggggaataagatacttatatatgatagcttgttgttttagaaatatatatcgcagctaacggatgcatggatggtaatcagaacaggcagttggttgcaaagcaaaatggatacctcgattgctaacgccttgtcaaaagataatatagctgaatctggctccccaaaatttaactgtgctctgccaagtgtaacccaaccctgcaagtcaatatatatgaacatatctcattcatgccgctgataaatataagggctgagaactgataggattcacgcattaagtaatactccaggagtagtgtttctgccctggggatgcctactaacctcaggccataatggatccaattctgttgcccctgcatacccgacatagagtaattaatataccagaagtggagaaatggaaatgacacaaatatgctgctgggatcatatactaatatagacttcacatgtgaccaaaataggcaactgcgcagtaattcattcacaaattaaaattattcttcatttttatgtatggaatgcagtaattcttctttgttcttgattgaggccctactatttatagatgttttatgcattttgcaatgacctgttaaaagtaccaccaaaacacacttttgacgggaaaaaagaacatggattgagtaaatcctagataccgcaaatcggtgctaaaatgataatccaattaggaaggatggtactgttcccaactcatggcatcctagtaggtcgttatcattagaatccttaaaagggcaagtaaactgaacaagagcatacatactggttgctgctgtcagtgcacgccatgcatctcccagctcaagtagaatctgagctttctgttcatgaagtattgcattattgggcatcaaggtaagtgcagcctcccacttaccaagtgcttcatggtacttcccttcctaaaacaataacaataagataaccattatctgccttttaaattatcgtttagcgtgtgctgaatgttaggtaaccctgcaggtgcaggccccaactgcaaataaaatctagtacatactgtcaaaaggaatttgatgtaaaaaatga

SEQ ID NO: 88210 - DNA, 1117 bp, Oryza sativa
ccgaggcgaagattgcagatctagagttcagggtatcgagctacgagcgcagcatgcaagaggaggtggcaaggaaggctgatgaacgcatagccgcacatcggtcccatgatccccagccgaccattcctcctgcaatggtgagcccgtcaggaaaccgtagcagctgcgtctcaacggggcaggtaggatcacagagcatggacgccatgcaaacccaggacgaatccacctgccccgttgatgacatcactcagcggacaccatgtgagctgcatattcctttcaagaacttatcaataaaggtaagctcgtagttcatatattttagatttgcccattccgctagttgctgcttatatatgttgattactaataaataacctctcatcacatgaaggtggcgtcgagcatggccatcccaacggacccttcaggtacttaccactgcaggccgattccagcaggatactctgtcacgccctgatgttcccctttttagctttaaaatttgttaaataaatcgcctaaagaaattgttgaattaacctagagttgaatccttaattaataaatgcaaataataatcggaacggacatgtggaatttttcttgggttctacatgtcaaaatatgctaacaggatttttagtggaattttcagagtcttggaaataattttaaccaattaaaataagcaaagtgcaatattaaatccctgggaaaatcctttttcccttttctcttttctttttcctcccttttccttttcttgggccgtcggcccatccttcccgcgccggcccgcttctcctcccctccccaaagtcctccctccctccctctctccttcgggcgccgacaggtggggcccacctatcggtcgtcttcctcctctagccgttggagccggagctccaaccgccccaagccaccgccttccccgctccacgtcgcgcctccactacgcgcccgcacctcgcacccacatcgccggcctctcccccgccttttccggtctcgcgcgcgcgctcgccaagggcggattcaattttgaatcccctcccactctttttttctctcgacctcccacgtcccggcgaaatcgggagcaccc

SEQ ID NO: 88211 - DNA, 2320 bp, Oryza sativa
aaaggagaaaggaatccattacgtgagtccaccagctacactcttagcaaggcagagaaggaaagtatgtttgaatgcttggagagcataaatgtaccgtctggatactccacgaatatcaagcgaataatagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagatggtcatcgatccggatagattagaagcccttcagaatgatgtggtgcaatgtctcgtcagttttgagttgatatttccaccttcatttttcaatataatgacgcatctgctttgtcaccttgtgaaagagatcagtatctcgggcctgtgtacctacacaacatgtttcctttcgagagtacatgggtgttctgaagaagtatgttcgtaaccgtgctcgtctagaggcaagcatcgccaagggttatggaacagaggaggtcatcgaattttgcgtggaatttatcgaagatcttcacccaatcggggtacctgaatcacgccatgaagggagactacggggaaagggaactctcggaaggaaagcaataatgacggtagacaacaatttattccgtaaagcccatttcatggttctgcaacaatcttcattggtagctccttacatcgaggagcacttggctctagttcgcgccaggaacattggtaagtccgatgcatggattacacggcatcacattgatactttccccgcgtggatacgacaacatctcatgggtaacgagtcgatcaaccaacaacttgccttcctggcgaggggaccgtctgggtcgatcgcgacattccagggatatgagatcaatggatacacattctacacgagagcccaagacatgaagagcacaaaccaaaacatcgctgttcgtgttgatgccatgggacacgatggaacaactggcacgtattacggtgccattgaggacatatgggaacttgactatggtcctctcaaggtccctctgttccggtgccaatgggttaggttgactggtggaggcgtaatgattcatgacagtgggatgacaacggttgaccttaacaaggttggatactcggacgaaccttttgttcttgccaatgatgtaacgcaagtctttttcgtgaaggacatgtctagcaaaggaaagaagggcagagggcctgacgagcctaagcgtcacgtggttctcccaggcaaaagaaaaatcatcggagttgaggacaagactgacgaggattacgatcagttggatgggcaaccccctttcacggtgacgattgaccctagcatcctcctatcaaatgaagacactccttactcacgtagcgatcacaaggagggaacaatagtgaggagaaagtacgtgcggtcaaccgtcaccgccgatgtattgccgtaattattgtgcacacgatgtaaactattttggatgtattgattatccatataaatcaattgatgtatggcataggttaattacgcatgattattagaggttttaacaagtttaaatcatgtatatgctagttatatgcgatacttacaatttttaaaagttttaaatcacgcaggtggcaatttcatatgtgaattagagtttttaacatttaatttactatcattcatatgctaattataattgactagagaatttttaaaagtttcaaatcatgcatgtggcatttacatatgttaattagagtttttcacaatttaatttactatcattcatatgctaattatatatgactattcgaatttttaaaatttttaaatcatgcatgtggcatttacatatgttaattagagtttttaacaattaatttaatataattcctatgctaagtatatatgatgattacaatttttattaattttaaatcatgccgtatgtatatacatatgttaattagagtttttaccaatttaataatatcattcatatgttaagtatatatgattattatattttttttttattaattctaaatcatatatttgcttattacgtcgtatccacttaatttattacagacaacaataatttttcaaagtaattgtcattaatctttgtactttaaataattgcaatgcattatcttctattttaaaaacacatatgtaatggagaataatattcattgcgcttatcagtagtcctggttcttaaccctaaccaggtttttaaagaatttggaaatagcgggaaaaga

SEQ ID NO: 88212 - DNA, 666 bp, Oryza sativa
cgtccgccggggaggtcgaggccctccgcttggcaggcgaggtagggcccggcatgcttcgggacgccgtctcccgtctagtccgcgccgggcggcaggcgggtctctggggcgggcggactgtgaagtacgccgccaaccaggggggcctcgcccagcgcttctcggagatggccgggactctccagcggctccccgaggagctcgaggggacgattaagtcatcctcgagggacctcgcccgaggagcggtggagctcgtactggcgagttaccaggccagggaccccgacttctccccatggacggcgctggacgagttccctcccgggaccgaggacggcgcgcgcgcgcaggtccgggatgccgccgaccatatcgtccacagcttcgagggttcggcccctcggctcgcgttcgccctcaactccgacgaggagggcgatgacggcggtgtgggcgacagtggcgacgaggctggcgacccgggtgcatcggagtgagcccccaggcccccgccaatctttaaatagtttcttcttttcttcttccgaggccttcgggcccccttcttgtatagactaatttaatctgcaatcaaataaagaggaaattttttgtgtcaattctatttgttgtgtgtatgacacgaggatgtctgtgccg

SEQ ID NO: 88213 - DNA, 914 bp, Oryza sativa
ggcaaaatttatagggtcaaaatggaagtagatattttatcaagaaacaatacaaggctactggtgcaggtaagttgtataagcatgtggcacatttcactcgtacacccatggatgcaaatgcatacgagatgcaactgagaccacaatggatgatgcttacctgctcaaaacatgcatttcggatgcgggcaaaatcacgggcttctccccttgattctgagtacatgtttgctattgatttgcatataaacataaagagatcagtctatagttgtggaacagaataaatcatcaaacatacaggagggaaacacgctatccacacaaatgacttggtatatcaagatgggcattacctactgcatctccagtttcgagccatggagcagctcttgcactgctaacactttgaaacttgtttccagaagatgttttggtcgtagaactgtactgcttgggtacagaaacagttgaaacaccattaccgtattcaggacctttcttatacttccaatggccagaattttgcgatgcaagtttgcgaacagctgaaacaaaatcaccagtaccagtagatacagagggtgagctgcgtccattgaagatgcttagaatatctgcattgcctttggaaaaaccattttggtcttcaactgttggcagtgcggggaagtcccctgtgctaaagtttggtgtcctgggggtcagagttggattggaggtagcatcaacttgcatctgaaaaacaaaaatgatatcactagacagacaatgtaaaaactgttaaacatgctagtgcccgcagaagatcaagatggtcagcatgacaatgggatgcaagtgcaactgcaaccagttattgctgcgttcctaacgagctctaccaaaaaagagtaaatttcagaaaactg

SEQ ID NO: 88214 - DNA, 7545 bp, Oryza sativa
ttttttttaatgagcggtacatatatattacgcatagttcaaattactccctcaactattgtgttcattcgatttaccatcatccttcactagctaggatatgtggtatctaaattgatttcacaagttgcgaagaggttaaaggttcaacattgcattttctcgagcgtgagttttcttcggtctatatatgatatatgtacatttatttattgttaattagttaacaagtactacataatacatcctctggtttgacactacgtggcaaaaaactaaaaacattgaccttttgcttttcgatcttaatcaatttaattagttggtctagtcttttctcggttgcttttcgatctcccgaggacgagcacgcaagaaactttaatttcattgatattatttttttcgcaaattatttttctccgtactatttgctccttgtaacaacagtgaatggatgtacgggttttttttttctttttttatttcagcaggcgcgtaagccaaggcaacgtcaggtaccggcccctagctagagcactgtgttcgctttggcacatactgatccatctgcgtatttaccgacagggtatagtattactgagttagctagctgctactccctccgtttcataatgtaagtcattttaccatttcccacattcatattgatgctaatgaatctagatagtgtaagtcattctagcatttcccacattcacattgtgaaacggaggaagtagctagtaccagtacgaacaaaactgatatgtttaaaaaaacctgaacttttttttaaaaaaaaactatgctcaagcttaatatcgatctgtattttttttaaccgccagcggtcgacttacaaaaactgattgatattttagctgatttttttacaaagttgatgaaaaatcatcagtttatactagtttgttttggtcggttttcgacgaggagtggttttcaaatctaaaattaaaaagtaaacatatcctggatacacgtttatactagtgcatgtctgattgttcatatgtgcgcgtgtgttagataagtctgtaaaaatacagaggatgcattcctagtatgagaataaatatagttggttatatacacgtcattgtaattcgaaaatcactataacaggtcgtggatactctcctatgacttaaaaaactttgtttcatgaaaccggcgattaatgattatcaatattaacctagcttattccttttgtggtgcgcatcggcaaaaaaatgagtggaatctgtgagaattcaaaaaattcaaagaaatttttttatcttaaactatttttaaaacataatcgtcatcattcttcctcccataaatccccccccccctcccttaaaaaaaattagctccgaaaagccacaaaacaacccattatgaaaaaccggtgtagaaaggaactgaatcatatttctatcttctgatcccgttgcaatgcacgggcatgtaacaaagtagtacactccgattgtaaacatgtacacaatctgcatttcttggttatgtgcgttgttttctacccaaataagtggccatgaaataacgaagcattccatgtagatgtgaaattgcatttatagcttctgcctttctatgaacagtaacacaaatgccttcttcaattcaaatctttgcatgcttgtgtacgtccaattaatactctctacgtataaactgcctttaagcacgttacagtgcttcatttagtctcccacagttgttgacaataacaaaccaagcgaaaggaataaaacaatgtcacgatactgttctctcatatgcgcgcgcatatgatatatagctcgggacaaaaccagatgaaccatttctgtcagcataagaacaaaacgcacagctaaactttcagaagaaacaaagaagcaatagcagtacttatgcaagtgtacaaacaattggtaccttggcgtttaattcaaatccaatgttcgacaaatcacacggccggttcccataccgattcacaaatgcaaagcttacaatacttgagcaaatctttaatttgctctctggtgtgttcagaaacgaggtactaccactgctgatgaatatgaactcataaatggtactcgatctactataattcctggagcgaagtgcatatgcatgtatagctattactcctatatcatggatgatgaagatcatatatatgcaacctgtacctgctcacagtgctcagcgttcaatggattgtatagctagctagctacagacaccttccgccatagcctgcgctcctgaacaatgtctgcttgatctcgtcggtgctgacaacttgcctcttcccgtcctcctatcatgcattgtcgacgaacccattcaatattgaaacaagagattaatcaaaacatatatatgcctatatatagctataggttaatttgttcgagcaagaaatcaaggtatagctatatatcgaccgatatagatgttcagaaatccgcactagctaagttgctatagctatcaagaattcaagatagatatatagaacttacttgtaagcaggaggcctgcatgccaaagtcactgaagcagctcacgacgcactgctcgatctctagccccagcacctccagcgcgctcaccgtcgacagcagcacgccggggttcgccgggcagcatatctcgatcctcgtgttcccgctgccccggttctcgacatcgaactggaggaaaatcaaaccgcagtttaattagttagtttcgccccatgcatcacaaagttcgatcgcaacaaccagattaatttagctgcgcggacgcacaagaaatatacaagcacatacatacatgccaaactaaaactccatcgatgcgatgcttgcctgcgtagctaagctaggtacgtaccttggtggaattcctcacgagcatctcgttgttgttgccgctggaggaatccttcatcgtgttcaacaggtcgagctcctccggcgtgacgccgatctcctcctcgagggttttgatcctctccgtcagctccttcacgtagtcgatggtgtcaccaaggatcgaggtcctgtccatctgcagcgcgagcgagcgattgattgattgtttaattacagatatatgagcacacgggacacggagacaagaagctagctacagctagctaggtcaattaattaggtcacaagacaacaatacaaatcaatgtgtgtgtcaccttgctaatcttgggcacgatggaccggagcatggacagccggtcgttgagccgcttgcgacgccgcctctcggccatgaggttcttcgacggcgtgccgtggagcttgctccgcgggtggacgccgccgccgacgcctctgatgccggccatcatctccgagctctctccggcgccacctccaaacatgaacgtcggcgacgacgagccgccgccgccatggagcagcgccttgtcgccgctcgtctcctcctccgccaccattgcgtcgcggagaggagtgagctgcgtctgcgtctggctagccgcctccgaggggacgagctgggcgccgcagctgcggtacgggttgcagacctcgctcaagcagtcgaagttgaactcctcgtgcggatgctgaggcggcggcgccgccatggacgccagctcctggaacggcgacgcgtccatcccgcccctcgcctccgcgctgccgccgtcgccgccgtagaagaggaggtcactcatcatcatgccgccaccgccgccgccgccgccgccacccgggtacggcggcgcctgccacggcgccgatccatcacgccgcagcgacatgagctcatccaagaaggactcctcgtcaagctccatgcctcagctagctagcacctgcagcaagctaagctatagtagtatatatgctccctttcctcgctagcagtcacctctcctgcctagattgcccaaaccctcacgcttatactatcatccgagaccgggacggcgagtagctaagccacatgtccaagttgcaggggggagcagtggcagtggcagtgcagggatggaatgaaaacggccgtgaccagagagaggggaatatgaaatgaaatggagctaggctagctgggggcacggaagcaacctgggaaatgaaacgcggtgggccgcgcgaggttggggttgccaacccaacccaagcaagcaatcgagcgacaattattcctcgcagctagttttggtttggtgcgtgcgcccatgcagctaggcgccgctaactagggtatatcggtcggtaagggctcgcgcgcgcgcgccaactggctggaccgccgggtcgcgcggtcggtcggtcactagctcgcgcgcagtctgagaatggaatggaatctctccacttgtttaatcgcctggcctggctacattcggtttcaattatcgaccatgtcgttttcgcctgaaatctgcaatctcgcggaagaggccttttaaaattcatcctgtatgtacgtcgctggctggcggcgatcgaggttaatttgacggccggccccgcccagtgcaaaaagaatttggtcgcgcataatttatatcttaccccctccatagctagctaattaatcggcgtacgtcgtcgtcgtgtacatacatagggatagggccggggtgcagtagttgtcacggccacctacagctagagggagcgggagagcgcgcgagtcaccgcggagtcaaaaagaacgggctagtgtagctaaacaaaaacgaacgcgcgtaatacgtaaccctcagctctgtgttgtttagcgcccagattcccctgccaatttggcgagcgatcggtggtcgggtcgggtcggggtcggccccgcgcgctagctgcacggtgagatgccatgggagtacgcgcgcgccagttgataatttgctggtgctgtggagacgtcgcgtgcgcggccggttcatgcctcatgcctagcgctactagcttgatcgcctcgttctcgagctgatcatcgagaggtagccgtcggggaggggagcaggggcgcagccgcgtcgctgtcgccgatcgagtcagatcagatcgcccatccgcgtacgcgtacgcgtgtacttggtggtgtgctggctatcaacgacgtacgtgccgagcaatcgatcgtctcctgggctattggctatacgatccaatatacgaatgcggcgcgcgagactagctagatcgatcgatccggccgatcacatcattgccgtttagttgcgtgttcgctgggagctcagcttattagctatagcgaacgagcagttagtagtacgtgcgtgtgatgatcgatcgatatatatgaaccgatcgatcgatccgagatggaatatgctggagtggtgggtctcattatctgggagatttgagggggattaatcttgattcggatgagctatcagatctgatggggggcatggataagattaaaacaatgcgcatggaacaaaaaccccagtcgattgtttatccgtcaagattactaattagacttgctgtactacataactttgtccttggtcgcgggctaccaatttaaatactcattttgtttccttgcaatgatcgtacgtataactagttgtagtatatatacttcttctattaaaagaaaaactagtcgtagtatgcatgagtacgtatttcttgtttagaataatgccagcactatcaactggatagaaacgatgctaactttttttgtatgcacgcaatatatttccagtaccaggccacgccaactcatcacccccaatgaccctcccaaaaataagtccgacaaaactgttagcatcttcgtcgacccatgctctataatccttcttatatatgtgcaccaaaattggtcttcactaactaaactaaataatggcacgcttttttaagcccatcacttctctgttattttcatccatcggtgatgaacctacagggctacactaatatcaaatgagagtaacccaacgaatctaagcccactacatcatacaatatccaatcctttacctaatatgcatttatcagctatcttggcatattaattaatgttccatgataatatatatatatatatatatatatatatatatataaagacattgcacttacatctattagatacatatacaatataaacatttgagaatactaattcatatgtttgtgttttgctacggataaaataatatgttctaatatatgttttttaaggttggtggagcaataatactggtagaataatttatgttgctaattgttttcattttaaaatatatagattgcatacaagaaatgagtgcgcaaaatctaaccccaaaagcaaatcagaaacaacatagaattcactcctatactggccacgtccctactccagctagcactatcttgaaatatcttactaggttgagaacggcggccaggagtgaagcgccaacctaggttcaattcctattggacccaggttatctcataattttcttctctatcaattatagatgctaaattcctccttggtactataaacaaaattcgctcttcaagaaaaaaaatgttactacgttgatgtatgtcacgtcactgaaaaacttagggggtgtttagatccaggggtgtaaagttttggcgtgtcacatcggatattatatagggtgtcgcataaagtgttcgggcactaataaaaaactaattacataatccatcaataaaccacgagacaaatttattaagcctaattaatctatcattagcaaatgtttactgtaacaccacattgtcaaatcatggagcaattagtcttaaaagatccgtctcgcaaattagtcgcaatatgtacaattagttatttttttagcatatatttaatactttatgcaaatattcaaacgttcgatgtgaaatggtgtaaaattttagggtgagatctaaacaaggccttagttttcagaccactagcctgtcttaactgtagaggagaggataaatgttgtggtgatggatctctagtagtttgccatggactgcggttgatagagatggaaaatggtatgtgtagttgcatacgagatgtcggcttacgattttaatacgagcaaacaccacgctgtcggtatggaagtggaaccaatttttctatgggaccaaaacttagtactgtcaataacgttagaagagaaacatttgatcggacaagtatagcaaacagaagatggtacgtataacggagctcgatagagaccgtggcagcgtggtcctgggggcaaagtagctattgcctgtacgaagcagttcatcacatgcatggattacccctctgaagaggtactgcagctgcagctgtcctacaaaagcttttgcttacgcaagcgaacaggatccagaatcatgttccccaagagcaacgatccaaaccaaaaggcgcacatgcatatgttcgtacacggtacacaccgctactagcctactacaccccatgcgttgcatggcattcaccaccatgtacagaccggcccgcgccccc

SEQ ID NO: 88215 - DNA, 591 bp, Oryza sativa
ggttttgtaaaggacaatggtacaattgttgaaaacccagttgcttctgaaaatgtgaaagtgccatctctctggaatgatatggatgagagccctgttgcatcttcgaacggtcacatcaaggctgagagacattacagagctggtgatcatgcagctgagagtgacttagggtatgattttggtgaggaatctgtaaggagccccagcagtgctggaagaagtgcatctgaaagtccatttgtgtcttcaaattttgcgatgcatgactcatctcccagcaaaaaggaaacctacaggtacaagttttcccattttggatagtgcacaattcttattctataatgtttgacttgctacctacatgatcactagaactgagatatgccaggcatagtttaattgaacagaatgggctgtatttacaaatttgaaacaagtcagcatgtttctctgcagtatagtgcggagccatctggtgccacaacatgggtccactttcagtatcctattctagtccacttgtaaatagttcatgtattgctctggctataagccttccatcttgcgaggctgtgacagttttctcca

SEQ ID NO: 88216 - DNA, 600 bp, Oryza sativa
atgtaatccaacgttatactccgggagtttgttaattttccggccagacttcaatggtcttttcacatgtctagacgatttcatataatctttaaagctattcactttgcaattaccgtttgattgtcacagttcataaggatagccggcaccggtttttcaacaacaggcagatccattaatagatcacgcaaccattctgcctcaacagtagcagtatccagtgccgttagctctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccacaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattgtcttg

SEQ ID NO: 88217 - DNA, 1906 bp, Oryza sativa
  unsure (1)..(1906): unsure at all n locations
cattaacggcctgaatacttattgtattccgtggaaatntactaattatatttgaaagtgaagcacactgcaatctcttatgtacatgttttancataanctcccccccccccnncccatgggnntttgattgattgattnacgcattgnaagnannccancanagggacttaaaaatcaagaacaagaacaatgataacaaaactgaagagccagtacatgacacttgatacacattgactccctggaaacaaaaccgtgaaacagaatatcacatacgctggtcatcctcaagagtaatgatatgccttcactgcaccattgatgctggcatggcatgaacccttctctagcataaaaaccgcgttatagccactccctggacatggcaattgctcagggttgtgtttcgccttggtggtggatttcgcgaggaagcctgtctttgcaagttatgcgcagctcctccaccaaatccacttctgctcgcctttctgctgcctttcgcctcggcgttgatcttcgcaatccaactcctttccttgtccttgaacttatcatgggctcaagttccttttttcgatcatgccactttagccatgaagacagaataagtacttcaagttaatgtcaattcaggtagcagcatattaaagcatgtggaagattgcaagaaacaaagtcaaaacagtgaatgggaaccacatctgggactttatttgggaacgatattgctttgaattattatgacactagtgcccaaattgttgccttagctatgcgaagaagagtagcacaaatattagcaataggatgcaaatttctgcatatgtgggcttgttcatgcagtgcaatcaattttagggcatggccgttaccttggttaatctctccttgagttttggtcttgtagatactaccactcgtgtcggctgagcatctgattttcgcagaaccaacttctgatgttgcagcttttttatccctctagtttgtagtttacttctctctgctgcctgaagcttcttggctacaattttcgcctctgccttttcaagcttcttcattattctttccctctctttattccataggaacattgatatcatctcaaactttatcctgtcatagctatcccaatccagcttatcttggcagtagtcaccatattttgctgcttctgcaatgctatttgaccatatgcgaagaacctcctgtcttgctttgacagccaccattcgccttttcccagatctttctcaatgcagcacctattttgtctttgcttgcttgtctgaaacaggatcagccatcgattgcttcagagtatgcatagacatgttttatatgcatccatctaggtagcagaaacacgcatttacctatgcaattgtcgatgtcctagcattttcttcctaacctgggaatattaaagaaaacaaaataacttgaattgaatttatgtagacaattcacagtccatagccaagtaggcctttggcagatacaagtgtcatgtgaaggtttcttacatgacatcaccttgggatctctaagagcctcggtagtccttcgcttgatgagttccttgtgctctacaggtgaatgagagactctcattgtattgtaataagagactgcgtatccactcattctaatgttaaatgtactgaggcaaaaaggacagaaagagcttggtcatacctttgcttagtttcctcccctgaggccagggaaaataaaaaccctcacctttgggcgtgaaccaaggttccggcttcctttaatttccttcattcgccaaccacttgtataagcattatcctgtcaaagttgaggcctgacaaggtgaaatgtttttgcactagcttcttaacatcctcttttttggcgatgggtgcgaacg

SEQ ID NO: 88218 - DNA, 5234 bp, Oryza sativa
aaaaaaagacacatgcaacagttgtgaatatctgataaattcagtgaaacgcagaggaaatgtatttcttttgcgaggtggaaaaaggggaaatgcatgacaccaatatttcacatttgcacacatgacacatctcatggctaagcatgcatgactaaacacgttctcaacaactagatgaaagtgggcgtgcttagtagcttgctgctggtagtaggtaaagtttttagagtagaagacttacgcctcttgcattttgatgatgcaacagctctttggacgagtttgttcttcttgccggcaaagctgggtctttcaaaatgttaaatgttcttcttgacctctcttgccgctgaaggacagagctgtcttcacggcttggatatatcttgcaaatctgaaagaagaaaagtgaattttaaacaaatgtctggaacgaactaatgaacaaagttaccaagaaaagctaaaccgcacttccaatttaccattgcacaaaggaattcagttacctgcttgataacacgatcgataagcttatccaaagtaaatagtacgtaggagttgggcccaagaaatttcaagcagtgctgctcaaagttccaattgtcagtagacccatcaatcaggctgcagagtttctccttgaaactacaccattcaataaaataaaaagttgttgttaaaacacagatattcaatggtgaaatttgaataattctacttatagataataggtgagaatcttagacgttactgtgcatatgaatcatgggtgcttgctccttctgaaagattcttagctactagtagtctctcgtacataacctgccacataaattaaaaataaaataagatcataatgccaataattaggtatagaggccaatagtttgtccagaagaaatatcatactgctgtctattagattaacaatcatggtgatgcatattgagcaagccgtctctttcatgtataacaaagtaagagcatacataaatatttttttgaaagtaagagcatacatatttgtgttgaactgtgtagcttgctgtcttgctcagtgctcactggcatattaaaagtcgccaatccaaacaaaaatatgtaataggaacatactgaaatacctggagaagccggcagagcacagccagagtgcaacaagatattcctctgtttgcatcacattctttagatgttcttccaaaatattctgaacttccaacctcattgttggagtcatctcttgatgatttatgctcttcagatccactccaatgtccataggtactatgcatagaattattggtaggcaaacatcgaacacgcaactgtatattttctacatctggtatgaactcaccctcctcaacctccgcgtcaaaatgatcaagcgaagaagtagactcattggacttggctcttagactttccacttcctgaatggaaaataaaaatcatgtagctttacttacatttatctttcaagtcacccaagttacttttttttttcgccgggacggcgaagaatgccgaccgatgtatattaaggaaaaggggaaaactgtacaaacacccaagttacttttacttgataaagatgagaaagtaagtgttcatcaattaactttcatgacagaagctatttatgcaaatccaaaacacgaaatcatcataattctaagagtaaagtgttgtaagtacatatacctttgaagaaaaaacaaactcattagtaagcacagcaacaggaatattattgagaaaatctctgctcatcccacaatgttcacaaacgtttctgcgagaaactgtatccttcaagtctggccattgaaacttcacagaaacaaatgcctttactaactttgtccaattcatcattggcttatcttcagtagaacaacttctactatatgcatagttaatgataacgcctacgtcctcatgaatgtgaatatcagtatgagatttgatccgactgatttgtttgtcttctgccagcaaagctgcaagagagatactgaaatgagtaagaacgaactaataaaatggtaaaatttccatgaattataacgcagaacctagcttcagcagtacataatagtaaaagtaccttttgggctcatcctttccatgtctagttgtttgaaggagggactacaatgatcaagtgatctgtagtaattattggcaacagtatctgggcacattttattcaaggataatcgtgcctcggagaaatctcctatcttctgatttagacgagaaagtataacagcaagagcagaactggtgttctcagattctgacaaagcatcaagcatgtcaatgccagaatcatcatatagctgttcaatgcacctcttatgtagagctgcacatgtaaaaacaaggaaaaaatgtaacactcagctaaccactcgaaaagttttggctccgaaaaatttacatagtacagtatacttacgagttaggtgttcttgaattttcacattgctgccaaaccgatattgaagatcctcaataaagtcagcagttgctctaaacctctgcaatagcatgtcactctcaaacctaaaaagtagtacacaacattcattgattatcagtgaccaggcaaatttttgctgatagctgaaagaatgaaaacagtgctgaagcatctgaaaaactaacatctgtgtacttacaagtcatcttcacacttaaacatgttttcttcatattgatttttagttctgaacttgtagcaatcctcacgtccagatgtaacagaaaccaaagaatcatttaaaatagaccttccaagttcagtttggtagcttgactggagagtcacacactgagatcaagaaagagaatgttagaacagatgccaatgatttacatggaaaacttgtgcgtttgtaggaatttacattctttggtagcaggcaatagctaggagtgcaatgcttgcaattactaggatccacttttaggggtaattcgttttctcgtgaggtactccactgaagcaaaggttcagccttgtgttcctcatcatcttctgcatgaggtgatttgtcatcacctatcataaatgattaaacataacttcaacacaaggggttcaattaaatatatacaaaatacaaaaacaagtggctagccacacaaaatgatactgcatttgtctgttgttacattgtatcatgtgcacatcaatagaaagaaactagataatataaaaaccaacacacctaactgttggaaaacagttgtactcagaagtcggaacatcatgctgtacaacatttgaattgaatggttcacaatagcggtcctcatagtttctttttaggataatttaggaagcacgaaagggtttaagaaccaatatattcaacttttaaccttttcatttaaaaaattctaaggtgcattcctcctagagactgtaaattgtaatttattatctagtaacttgcctccacgttcgctctcacggcctagaaattatcatattaatcggagaaaaagaaaaacaaagtccatatagaaatacaatttagagatagctgaaattcggaattaaaaaataaagaatattggaagagaagactacagtccatgccggtatacaatttagaactaataaaaattcggaattaaaaaaaagtaaattaaaattaggttagagtccatatagatatacaatttagaaataactaaaagtcggaattaaaaaagaatattgaaagaagagtatatagtccatatagaaatataatttagaaataaatacaatttagaaataactgaaatgaagaattaaaaaataaagaatattagaataagattatagagtccatataggaatttataattaactaaaattcggaataataataataataaaattaaaagtagagtttaaagtccatatagaaatacaatttacaaaaaactaaaattcataattaaaaaatatgggaagaagagtctagagtccatataggaatacaatttagaagcaactgaaattcaaaattaaaaaataaagaatattaaaagatgagtctagagtccacatagaaatacaattagaaataataaaattcagaattaaaaataaataatattggaagaagagcctagagtctatatatatactccttccgtttcacaatgtaagtcattctagcatttcccacattcatattgatattaacgaatctagatagatatatatgtctagattcattaacatcaatatgaatgagggaaatgctagaatgacttacattgtgaaatggaggaagtacaatttacaaataatgaaaattcggaattaaaaaataaggaataatattggaagacgaatctagagtctatatgggaatacaatttagaaataactaaaatttgatattaaaaataattaataactatcacgtatatacaatacaatatgaatgtactgttacacattggtagtttggttagtacaaaatttaaatttatgttgtcattttaataataaattgagaatatatttatactattatatgagagaaaatacaatgatgctagccgcgtaatctgcgcgggccaccatgctggtttcatatatgaaaataagctctagcaaatgtagcactcaattgctgagaaatttgatagtgacactccacgatgtgggcttcgattatttgacaccctggcacacttctattccctcaaatggtcacacatgtcatctcacaagagtcaattaaagcaaattggcgacgaagaaagtgtcaaattatcaaatttctctcaattgctagggcatacttcgaaataacatctgataccatgaaataggtgaatgcaaagatacgcaaatcatttgtgcattctctagcaaaaaggaaaacagttgggcatgtatgactgttattaagaaagggttcattatttgtgtctaacttcattatttcctgagaaggatgttaaagcaaagcacctagggctcgcctgtatttggagaataaacaaattaagagaaaactttcacacaccttgctttctaggattttcaatcaggccagtggttctcttagtttgtttatgcctcaaactataacctctgccttcatggttttggttttggtcctgagtatacttcaatggagtcgcttggtttcttccattggttgcttttactcggagaccatccaatttattcatagcatctagag

SEQ ID NO: 88219 - DNA, 585 bp, Oryza sativa
ctatagggcgaattcgagctcggtaccccataggcaactacactttgccaacccgatccgatagcgacacctatagataaattagaaaattagtaatttcattgttaaattttgaattactttgatatacttgtccttcaaatggaataacatacctgagagcactggttgaacactattcaacaaaatagagaaagctagaaggggagcaagatcagcgacttcatctgctactgccttactttcagtaaatatgtatgcaaggcttccacggaagaaaaggaagagcacaaacaacacaaatcctatcaagaaagaagtggtgaccacattgaaaatggcaaacttagctcttcttgcactcccggctccaagttcatttgccacccgcactctaaaaatatacatgcattaagtatatgtcaaatttatggttcatgttgcatcagttagatgaaccacatagtgagtgacagctgagatcgtgaagttaccctattgcagacaaaaatccgatagaaatcatcatctcccaaccattgatattaaggctacaaagtttgcaagtgaaaacaacaatgttca

SEQ ID NO: 88220 - DNA, 1574 bp, Oryza sativa
ttttctacgaacagggggcctgctcaattacaagcggtcttctaactggaatgtacgacataacacatgcataaatatagtgtctatgcataattagaaaatttcggaataagtgatttaggggttaaaatctttcaaaatcaaagttctggtatcatagaaaacaactgaactagcagccactcaacaaagctaatggctacataaactaaataacaacttccaagatttggagggtattcatttcattttcagactataagatacataaggtgtataattcatcggaatccccaataatcctgaacacaagtctatggtgatatccagtgacctatattgtagaagagtgtcggtccttatccatagaatccatgtagccaaaatattatagaagtagaactaaagagaaaaagatggttccaagtaatgcttcgggcaaactatcaccaagaatggtatcaacaagaaatgcatcattttaaaccaactaggtttttttgaacagccagaataacaggaaaacacttgctacaagtctcagaccctcagttatattagcgaaaacatcagcccatgcacaccaacctatgtttacacaaaacattagagtgcaaataccatcaagattaattatatgcatacattaatattctccatgctaatctgttgccccagaagcctagctaagatcaatgcctgcattccaagatgaacttgttagacctcatcatctaattgacaaagaatgaaataatcaaataaaacatctgaacctgaacataaacctcccttatgtcaatgtctatgcaaggttattattgaaattccaaataggataagtgcatgatataggccttcctgaactttagtatttatgatattgatgtgctagtgaatatattttggatcaaatcatggtatgacacaattaaacaaaaaacagatacacagcagcagctcatgatatattagttcatggacttaggagtagaaaaaaattgtggcaatggttaacaaaggcacatataaagtgaattatgaagcgtagcatgtaattcatcagatgaaaaattaaccttttctagctacgtccatcccactgagatcatcacgtggatctaccaaaattgaacaactgagtaagtgcacttatcacaagcatcagtagactttcggtaaatatgaaatctgtaattacagataaggaattgaatactgagtacacattgatgttataatgtccaatgaatgaataaatttttagacctggttctgtatagccaagagacttggcagttttcacaacttcactaaatttctttccatcctccagctcactcatcacataaccaagtgtacctgcagaatcataggaatggaagtgtacattgctctgctatttggaaaacagacaccttttacaaacaaataaaataataactgtgtaccactcagactgccaacaatacgagaaactggatctccagaggcaataatacgagtcacagaagctattacaggcagactggctccaacctaagagtaggaatagtaaatatcagcagagaccc

SEQ ID NO: 88221 - DNA, 643 bp, Oryza sativa
ccgctacaagaagctcgcggcgaggcccgcacgccgccgccggctccgccacgcgtgctgcgccgccttttgcgcgggcctcctcctgctcctcctcgccgccggcttcgtcggcgccgtctacctcgtcttccgcccccgcgcgccgtcttctccgtcgcctccctctccatccggggactcgacgccctcgccgggtcatcgttgactccgcagatcgacgccgccgtgcgcgcggacaacggcgccaacaagaagaccggcatcgactaccgcggcggcggggaggtgaccgtctcgtacgccggcgagcggctcgccgccgggccgtggcccgcgttccaccaggcgccgaggaacgtgacggtgttctcgacggcgttggccggaggaggcgtgagcttcccggaggagcagaggaagcggctcgccgcggagcaggccgccggcgcggtgcccctgacggtggaggcgatcgtgccggtgaggttgaggttcgggaaggttctccggacgtggacggtggacgtgaagacgaggtgcgaggtgacggtgaacaagctggcggcggcggcgccgccggcgaacagggggtgcagggtcaaggtccggccgctctggtggtggtggtgatcgccggcgg

SEQ ID NO: 88222 - DNA, 746 bp, Oryza sativa
  unsure (1)..(746): unsure at all n locations
agaacaactgancggtcagctctgcacccgatacatccgctcttngttgaagtcgaagccgtcgattgggaaaacgagcaaggcaagacacatcatcttgatcatattgaatcccagtttataaaattatgttgatttaaattattgcattatcgctttatttaaattcccgcgttatcactgttttatttagccatgcctatttacctttgctatgaccatattattattggcataggtattattattaccttgttcaccctagacaaacaaaaccccaactagtggacactctctactcatagtaccactagtataattctagggagatgcttcgcaagttaattaggcaacattaggtggttttacaactctagacccgggaaattctgatatcatttggacaccatggaatggttggcttatgttggaattggacacacacctctttttctttttcaaaacccctaaaacctgttttcggtggggtttgggtgcatgccagttgtgggaaatagcaccccggccactataaggactaaagcttgggccttttgtgcaaagcactaccgtacttccacatgtctaatgggtaaagcttaatttggggctcagtctagtcataaacaaaagtacacagattggagatggatgaagtcgggggtcgatggacattctccagtgcaaatgaaggcttcacgagctgcgggcccggtagtcaagatgtcatacggcggaggggttgg

SEQ ID NO: 88223 - DNA, 629 bp, Oryza sativa
tttttacatatattatgttacattacacaccatcgattcaccaaaaatcaaaatatgaaagaaaaaaaggaagagaactttttaatcggttcatacacaatcagattcattcatccaccgaatcctttgaatgccaaatcgccaataccaccttacctactgatgatgctgatctactcgcacgacgaggccgaatcaaatccacggcgatcaccggcggccggtgccggaggaggtgtcggaggagcagtcgcattcggccgcggcggcctccacctctcgcctgtggaagctctggtggcagccgcaggcggcgcaaaggagcgcggcggcggtgccatcggcgcccgacgccatgaactcccggcagccgtcgacggcgtggccgccgatgctggcggcgtggttgcgctggcactccctgtaccgcaccaccttgttgttctccttcctccccgccgccgccgccgccgccgtgctgccgttcgcgtacggcttggccgccgaccggtcttgctgaggccccatcgatgatcggtcacagatcacacctcgccgccggcgagcgtcgacgacgttaggtggcgaggaggagaaagggaaggaaaaaaaaagaatggaaaaacttt

SEQ ID NO: 88224 - DNA, 760 bp, Oryza sativa
  unsure (1)..(760): unsure at all n locations
cccgcttgaatgcaatctacttgtcacccnccgcaagccaacatgatgaatgctttcctccaccacctccaaaatctgccacagcagaatgctcccccaccacctccccaacactccaaactcgccgaattcctccgcatccgtccacccaccttctctagctccaacaaccctgtggatgcgttggattggttgcatgccgtggggaagaagctagacacggtgcagtgcagcgacgaagagaaagtcatcttcgccgcccaccagctgcaggggcccgcatctctatggtgggaccacttccaggctacgcagccagaggggcaaccgattacttgggctcgcttcaccgccgctttccgaagaacccatgtgcccgctggagtcgtggctcttaagaaaagggaattccgggagttgaagcaaggcaaccgctccgtgatggagtatttgcatgagttcaacaatctagcccgttatgccccggaggatgtgcgggaagatgaggagaagcaagagaagttcttggcaggaatggaccctgagctgtctgttcgtctagtctctggggactacccggattttcaacggctggtggacaagagcatccgcttggaagccaagcacaaggaactggagtcgcacaagcgccgcttgggcgaattccgcaatcagcagggtgctaaccagaaggttcgctacaccaatccctacccagggggtatcctcctcgcaacagcagcagcagcaacaaccttct

SEQ ID NO: 88225 - DNA, 747 bp, Oryza sativa
caatcgaggaggccgccgcccacacggggtcgacgaccaccgttctcgttccgggcagctcggcttcgatcatgtgctgctgctgctgcttggcttcctcgccggaggcatcgtcgtctgtgtccctgcctagagggctgtacaccgtgtacgctccggcgacgacgggcgcgacgactccgaggacaaagaagaaattgtcggcgaattcggatcgcgatctgctgcggtaagcccagtagaggttgcaaaccacgtactgagaaatgcaagtgacatggaggagagccaccacgacggacatgtgcgcccgttcgccgggacggcggtcgccattcttgcagtacaccttctgtagctccgcggcgtcctccggccgccatcgcagagaagaacgaggtggtggatcaggctgggatgctggtatatgctcatgagcgtgaagagcgcgttaaggatctggttgtcgatctctatccagtgatgcctcaatggcttggaagggaaggccctgttcagcaatcctagcaggagcaggatcaacatgccaccagctgcagcgacgcagagcagccatgccaggagagcaatgttcagagggtgcttgagccagttcttgcagaagctgaacaccgagctccagttgattcttctgacgaagtgaacctcgacatggaggtaccggcgggggatcctctagagtcgacctgcaggcagacaaggatagtcaaatactaatggcgcgcg

SEQ ID NO: 88226 - DNA, 782 bp, Oryza sativa
  unsure (1)..(782): unsure at all n locations
cgtgtcanataggatactacttcttgtctgcctgcacgncgactctagaggatccccgatatggtgcttgatctggtctgttcgttatcgagtgaagaaaagttcgccactatattggacagcgatgaccaacaaaaacaacttatggtgggtagcaatgctcgcaggttggctgtgcacggtaggagtgttgaaaagcacaaccaccctcagctggttaatgtgggtttggagaaagtgaggtccttcaatgccactcagtgcggcgatattaatgtggtaacatcatactttcgagttctacgcgttttaactttggaggattgtagtgttactggggaagcttgtggaaaacatagattagagcatgtagggaatttacgccacctgagatatctggggatttggaatacacgtattgatgagttccccaaggaagtaggagatctcaagtttctacaaacgctgaatttgtcaggtactggaatacaacagctcccggaggctgtgggccttttgaaacaactgttgtgcctacgtatcaatgacagtatagcagttccagctggtttgatcgggaatcttacttcattgcaagagctgaagatatggccggttgatgatgtctcaacaaggcagtttgtgaaggagctgggcaagctgaaggagctaaggattctccggtgtaccattcatattagcgatgagggcatggagagagatttgntagaatcgctagcaaatctgcacaagatccgcactttgtgtattttgggctcaga

SEQ ID NO: 88227 - DNA, 768 bp, Oryza sativa
  unsure (1)..(768): unsure at all n locations
gccgtaggtagatcanactcagtctgcctgcacgncgactctagaggatccccattacaacaacattcaattgaaattacacgatacaagtatttagtccgaacactcatcacatcacaacaacattttatttcctaaatcgatagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcattttttgttagtatggccgcgcagatcacacttgctgcagcgtaaagtcctcccacctgcttctgactcatccatatcatttctgatgcgtctagtttggcgtcgaccctttttcacccttaacttagatggatctggaatgtaaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgcttctatcaacacacattatttataccgatgcacttgtgtgccttgagcaacaactctatgtct

SEQ ID NO: 88228 - DNA, 3238 bp, Oryza sativa
  unsure (1)..(3238): unsure at all n locations
tttttaattagtgatggaacttttcacttatgggaaacaaatacatgtacgtcagaaccatggtcttcatctaatggatatgtatctgtaagtagtattcattcttaaataagtactgttcaacatttaacattgttatttaccatgtcacaaggaatggattcttaataagtcatgaaatgaaagggcaaatgctttgcatgttatgggcgattgggttgtgttttaacataagaaattgttatctcagatctattggaaaatgatgttgtgtatatacatgtatttatcttgaaaactagtatatttagcatgattatgaagattgataaagcatattaccttatttaacaagtgatttcaagcaatatatgttgaaagcatgcctgtatcaagcttctgaacttgggttttattttgtatttataactacctttcagtacctttttattttttaatgtattgtcatttcaacatctgatcattatgattcttttggcatctagaataaaaaatatacctacaattttgtttgccaacaagggtaattgcttgttcaacagttgatttttgcttcagtttactttataaattgtaaatattacataaagctcattttcatttgaacctccccaagaatatacataagatcagttttacagaaaatgtatctcattcacttgtaatatgtatgttaccccccttaaaccagtattttgaattaaatatgggtgttgtgactagttctggagttatgatgttttatgcttttatcttgcttgcatactagggagcaaattgggatccagaaggccgtattgtgttattgtccttttctaactcaacaacactgggctcaattcacttctcatcaaaaccaccatctttaggtatgcacagctaccctcatctcactacaacatttttatgtgaagttatgccgttatgtttattgtctgtatcctgaacattatgttgtgttcattgacttcagatgcccatctcctaccagtcgaacatcctgaaatttcctctctgattgtcaggtaacaacagttggcctaccattctatacccctgacctcatgtgcacctgatggaacatattttgcttctgtcttaaatgctaactttaactgatgatattttgactaaccacatttgcaactggttcggaagtcattcatggtatgtttttaaagaaatcactcatagtatgtaacttatgattattagcaaactaagtaaaggcaagttctccctaatcaatgttagcgcctcaaccattttttttcttcaaaataatatatttagatctggcttgtaaaaagtctggctcttgccatcatttagtatatactcagatgctttcatttaggataaaccttacataaacaaaggttcatcacttcatccatgacagtctagaaaagtaacttcttgtccactccatatacttatttatgctttctctggttcatctagccgaggcatagataaattagcatgggattcttcaggagagcgcttggcattatcgttcaaagatggcaatgaaatgtatcatggccttgttgctgtctatgatgtgaggagatctccacttgtctcagttttactagtgtaagtacagccctctaacttaccatattatcttggtcatgaacattgtatctcgatagttttggaccattgtctgatgaagttccaatgtgcatatctagtggattcattagaggacctggagaaggagcaaagccacttgcatttgccttccatagcaaatttaagcaaggaccattgctttctgtggtatgagatcatcaaaagttttgagcctattagttagtaaatgataattgtggttgctcacattgttgtccaactgttcatgcagtgctggagcagtggctggtgttgtacgtatcccctcatacttcgcccgcattgactccctaaaaggaggtaaatctcttcggctaaaagtcttgaactttagtggcatgaaatcagctatgtttattaatctgaagttcattttccttttatgtccagtaagtaaggtcaatagatgattggcatgctattgaattatcttttcagagagatgcattctataggagcctaaaaaatgctgctaagattgttatcctcctgtatgtaaaattcttctctctggaaacggtgctattcaatgaaggcaaaaatagaaaaaaaaattctgaaatgtatttggtagcataacaaatgtctgtattatacttatttggagggggaaatgtattgtctgcgcttgtgtttatgcagttccccaaagcaaggacaccattgtcttaccatgtgtccttttagtgcatgattactgttcattaattggctgcactattgcatggtaagaaaccttgaatgaaaggtttaatcagtttcaattggacttgtgtttgagatatcacaggtatgttctgctgcatcaaatgaaatgtcacccttatcacttggtatgactgaaacgcaaggtaaacatgcagaataagtatgaatgaaatatagtccaagacattcttcatccaccnttcattttccncctccctgttggctgattcagattagctaggaatcattcaagctgagtagcngnagcttagtgtgatcaaaggaatagcttattgacaatgatattaattagcgttaccgctaggttcgataatgtgacaaccttaaactactcttacagcgtcataaacaacagggtcacacgaagtgtgattagcaaatgccagaatgcagtatatacactctgttagctttctgaaattcaggtaccacacctcacgtaatcatcctgtgttctattctctggtataagtgtgcatcattgcttcacatctctgccacgagcttgctgtactgatctagagcgaggtcaaatgaagtgaatgaataaggagagagcgctgcttccatctcttctgaagcatctggcagctcgcttttaaccggtacgacctgcatccatcgttcacaagatacttgtacgttagatgaactcgccaacacctgagaatatcgtgtgccacactgagattgaccctgtctgcgaaaaaattatcgagaaagactagagaataattccagacagctaaataaacaatttcttaaaagcttacaaataaagctgaaagacagagtttgcttacgacatacggcttgcatatgtgtgcattctataaagttgtaa

SEQ ID NO: 88229 - DNA, 1069 bp, Oryza sativa
agcggtgttctctttttccaccctatcaatggagctacttggcttgttctacatctatctagctactgcattactttcaagtttagtcttttaaaacttagccctgaaccttgcctttttgacattgtgaaatggatgtgattgaaatgtttaagactctactctagtctctggaatatggttttgcctgttacctatgttgagttatatttatgttgttaagatgatccatactgcaagtgttatgctatgttaagatgattctgcgagtagtgttgctgtctgctttggtaccgctactgttatgttgtgattgtgacatgctcatttcaggtagttagggttttcaaatttcaattaattcccatggaaatgcttgttcagctccttagggttgcaaatttcaagtaattccaatggaaatgctcgtttgctgtattgttgcttattgtcagtttgagttttaatactattgatacatgtatgtgtctagtgcatatgttttaagttagcggatgcaattcatatatcgagtaataattatgcggaatatgtcatcaacacttgcacatatgtggtctgttgatcaacagttgcacttctataaatttaattagtcttatctaataacaatcatgcaagttgcaattctatctggtatatgcgtatgaacacttaattctgaattcagtgcccattcctgaagttaatctttatggtttgcttagattaggagcttagattatgatgcttaatttgatttaaacaaatggcctgctactttttgatatttttacttatttggtctggtagttgtacacatattgatgtgataatcttgtacagatgatttgcgaagagtttgtgtgctattttcattgtagcctatgtcagctctcttttaaaatgcttttttcgatcacatttactgtttgaggttttcaaccatccttgtatacctccccataaaaggaagtaccaaaactaaccttataggttgaaatagaattggaaattttcattataaatttctgtggcatttattgcattcttagaggtatgtatattt

SEQ ID NO: 88230 - DNA, 543 bp, Oryza sativa
acagctcttaatgatgcgtgcctgtccggcgatctagaggatccgattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattcattaagggcatcaaggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaaacacggcgattcatggatcgaggagttgccagcggtgctctgggcaaaccgaactacaccaagccgagc

SEQ ID NO: 88231 - DNA, 588 bp, Oryza sativa
cataaataggttggaagaatgcatttcccatgaagaagcagattttgttttaaaaattataaattggaacgattgttaaacaagttttacctgctttagtacaccagcctccatatcttttatcagaacaaacctcgacaatgcttagagccacagaggcatgatttgagtttgcaagctttgaagggttttccctcaaagccagggggagcacctcttgtaccataatcataagtcagttcagtcatgggagggatatgttccattgcaaaaaacatgatatgtgggtagctgtcatcgccatggtcatactgtacagcttgccaaaggagatttggagaacagctatggttcagaaaacgagccacattcccttcattgtttgctcttatgatgattggtagtttcttaaagttcttggttatcacagccgtacttttttcttcaagtaattcttctcccaaattccagcttaaagccttattgccgggacatgaagcgcgaaaggtatatttgtcttcctcaacatctatgtccatcttagtttcatcaatgacttcaccggcgtactcacaaatgaatgtgcca

SEQ ID NO: 88232 - DNA, 2430 bp, Oryza sativa
  unsure (1)..(2430): unsure at all n locations
aagccatagcaataccaaagatataatattcctctatttctgaaaatgttatatacactaatgtatttattttggcatagcttctcacatttgtttcattcatatagcatgtttaattgcattcttcatttgttccatgcatcaccataagttaggaggccatatgcaatgtcaaagcaagaaaagtacttcctttagtttttaatgtttgacgtggacttttggatatatgtttgaccattcatgttattaaaaaacaatgcatagttatcatttattttatgtgattttcttttatcattataagtacttcaagcatgacttacatttttgcatgtatacaaattgttttaaataaaacgaatggtcaatcatatgtccaaaagtcagtagcgtcaaacattaaaaaccgaatggagtaattgcaaagagacctatatctagtctcttggcttgaggttaagttggtttatttatttcccttatgactgattacgaaattcatttttgtgcgtagttcatacatgttaagagtcctaaggattcacatgatcctccatcaagcttacttttgcacattatagattcctcaagctacatgtcagatgaagatatttcttttagcaagttgacaaagacaccagtactgatgtgctttatgtctactaaggtgactccacgtggtaaattttaagttatcccctaaacgtagggttaataaatcacttttgtcgataatttaatgtggttacacttttcagacatttctaaggttctaagaaatctatgagtaataccacaaaggcatgtaactgaagtagaaaagaaccatgctcttcaaaggacagaagaatttaaaacctaataatcctttttgcagtgtaaataacgatggaaccacatatatatctatgttggatttttcatggtaatggtactttcatgtgttcatcctcatcccgtattgaactttttttttctacgtgcatcccgtattgaacttttttttttctacgtgcatgaggcattatctaaaaaaatgtggatgacaggattgatcttaacttgcataacggtactgcatctatagtttgagagttttggatgaggtctgatttgaatatcccatctgatgtttgatttttgtgtatgtttattttgaatgtgactgtacccattgaaaaatcctacaactatataaatcaccaatttgtgatagcacattatttttaatttgtggcccaattaccctgcatctttcaggtgatactaccaacaaattatgcaactaattactccattgataaccagatgttcattataaatttttaagcatacatatgtccatttattaactggaagtatctgaatattaggcattctattgatgcatactcatcagcgacagaacatattggactcagctttgatgcaattcatggccaaggccattggtgttgagccgaagtcgttgtcaagtgtatttgaagggcaagctaggggtttgaggatgaactactatccaccgtgcttgaaagccgacaaggtgttgggtttgtcaccgcacactgatctggatggcttgacactgcttctccaggtgaatgatgtgcagggcctgcagatcaacaaggatggcaaatggttctccgacaattttgtgtgatagcaaataacttgcaagattttcttggtgatgctagaagaattaacttctaacttctgcattacgagacacatgtagtcttacataaccaagtttggaatatcctgagtggccgttagggctcgtcgaccaatgattcattgaaattatatattagcgaaaatttaaacatattttttttaataataccatggccctaattttaaacttctaaaactctttttaatctgctacagattggtagctaaagttagaacatactaggagaaattagggatatatggccggtcaacatctccaaggtgatgggacgacagatggtggtgttggaatgagatggcgctgaccacgaccagtttgtgaggagggaggtgactacctcagtggggctatacaggttcgtcatagggatggctcggattatgatatccctaaatactgtccattggtcttcaaggttgatcagggggatggctcgtatcancacgccttcctcgtctcatcaaatcctatcatcattatcattaatcacccatcattatcattaattagtactccttaattaattaacgaatcattactgcttaattaattaccgtatctggcgggatgggtgatgatgtccatgatccccttgtagatgtcgcagaagacgacgtcggcgccggccagccgcggccgcagcgccgccagccgcgccgccaccctggcgttgtacccctggacgagctcgttcgcctcctccacgcagctccggccgtcca

SEQ ID NO: 88233 - DNA, 588 bp, Oryza sativa
cctaagacctatcatagactgatcaaattttagttccagtgttcacattaaacaacgacggttctgtccaccatccattgtgatcccaaggatagcttcccgccattgagtcgtcatggttttctgaggacgtccaccttccctcctctcaggaagtggctccatcagcataaaaatcaccatgcaatatcccatcccacacaagttaagaatttagagtctagccaagtgtaatacatgtcccggtgctcaataaccgcgagcacggctattcgaatagatttggtttactcacactgcagtggatgtacactttacccgtactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagggaagtctcacacacatattaaattatggttcaagttaagttctctctctcacacactcatggcagtcctaccaatggcgacaccgatgtagggca

SEQ ID NO: 88234 - DNA, 546 bp, Oryza sativa
actcaatgagcacacgagctgggtttccaatgcctctgttggggccaggcattggtatcaaggaatgatttgaattaacaccattgtgttgccccacgatgaaaggatcatctgtgcagcggccgaagatgtagctgcgtagcgcgtccaaatgatcccgtactgcaaagtattcatacaagtgaactgagccatcaacagtagcagtgatattggataacttgagcgagaatatctgcatcatgaattgttcttcgtgaatattgcaagcccacatgtgtggtcggcaattggttggatttgacagcatcattgcctccttgagagctgaaacgcagtatgtaggagcattttacatcagcggataaagttaaattttaaacccaaattgaaataaaggagaaaacaaacaaatcaagaggacggacagaatattgatacaattaaggttttaaatagcaaacttggcgctgccatggatccaaactcccaaagcgagctatacaatatcgtataaggtggttttaattctattctaattaagaa

SEQ ID NO: 88235 - DNA, 609 bp, Oryza sativa
ttcttgctttagggtttgaagctggagccaacacatcaaacattgacccatggtccatcattggagatgaatcctctgtgcacgtcacaactgatcgctcatcctgtttcagtcaaaatccggttgctgtaaggatagaggttgtctgtgacgattgtccagctggtggtgttggaatatacaatccaggattctggggcatggtataagttctctctcagcatatagcagctcattcccatatgaatatgcaaaatagatcttgtaatcgaaagaatcttttttctgatgatagtttaaagtatacggtgctgccaccgaaggtaattatagcaaagttattattcttatcaaaatactgaagctaacagataactaagctaacctattttttgtttgctttcaatttgcattgatcgcataatgctggttttctatcttattgccgtgcatcacttgcttggaaagtgtaatcagtgttatagcttttcgtcaaaccattttcacttttaccttctgatattttaatgtgattatgatcatttcaattttcagaatgtagaagaaaggaagacatataatctagtcatgcatatcagatcattagaa

SEQ ID NO: 88236 - DNA, 745 bp, Oryza sativa
ttctacatggtcataaatggagcttgagtttcatgattattttaaaaatgcaagcttgatggagcaaagaccgattgatgattcatcggtcacttatgatactattttggttacacctattgctaagaccggaattgttagtaatccccttcctattgctcctattgattttgacaacaagaaagtagtgattcggcctagtcaagccgaatccacaaaagggaaaagtgttattattggggatcctcggtccgagacaattaggattaataatgctaaggccgaagatcataaagttgtaaaggatgagtcatctagttcccagaagactaaaaagccgaagcttacttttgagatgcttatggctaagtacaagaaaggattagccggtcaacgatttgataatcagactagtgattcaaaaagactaagatcatctcgtaggaagagaattggtcaaacgctaaagcaattggagccatcaactataccaacttcatacaaacctccggttgtgatgccatggtatccatatccaatgtcactatatggttatcttttttatgtattacatgccatggatggctcaatcacctatgccatttgatcaagaatggaggggatcacctaagtcaaaatcaagtcattcatttaactctagacaagaccattctcacaaaagaatcgatccgatggatcaaaggtgaaaaatgtgaagaaggtgtgggtgagaaaagaagccaaa

SEQ ID NO: 88237 - DNA, 715 bp, Oryza sativa
ctatggtgagatgcttacaatatttggtagcaccatggctacgggaaagtatgcaaaggactcaagttcagtcctaggaacagaggatgtccaagaggaaaatgatgaagaggaaaatgatggccctgccactactgatgatcgtccggaggcatcatctgcaagcaagccaaagaaagctagaacacaagaaattgaagatgatgggctgattggtgcattcaccagtgttggtgacaagttagcttctgctatactaaaggtcgctgagccagacaataaactgccagatggtttatttgaaaccttgaaaagccttcctgggtttgaggagatccacgtatctgtttactatgctcatttggttgctaaccctcacattgttagagcttttgatggacttcctttcgaaaacaagatacattgggtccatttgttcattaatgagaagtttcctggatcaatgtagcgttgttagatgagttgggtagttcttttggtattatgtgttgccggtgggcccatggtcatgtatgacttgtactgccaatatgttgtaggcagtgaactcttaggtgcaagacttaaatttgctattatgtgtaagaccttaattggctattatgtgcacgacttgaaacttcttattatgtttggcttggactctatgtatggattgaaatgggatcagatgtgagctaattatgtgtgattg

SEQ ID NO: 88238 - DNA, 653 bp, Oryza sativa
aactcgttttgagtttatctccaaaaccgagtttttgatttcccggagcgatttcttgcgggaggagtccgatctattcaacccaaggctataaataggaccccctagtcctcctctttcgtttgccccctctcccgtgatctcccgtgcctcgtagcgccgccgccacgtgctccaccccgccatcgtcgccggccgagttccatccgcgtcgcgccgccgcctccgtcgtcgccgccggtcgccgtcaccaccgttaggtgcgcgggagggtggagaagcccggccgcctgacccccgaagccgccgaccaccgcagctccggcgccaccgccgaccgaagtcgtcgccgccgctcttcctctccgccggccgtcgtccgtcgtcgtttgtcgtatcggtgagcaccattgagttcgcaatgttgtcctctacgcgtatgtgtcctccaaaagtccggccgaccaccctagctccggcgaggtcgccacccgtgccgtggctgccgtcgatgacgtcatgacgtcatcatctcctctttttcagttttttttaatagattaaatcttcggaaattcataactaaatcatcgtaactcggttttgagtggttcaagttgctaaattcatctaaaatcatgatctttgtactg

SEQ ID NO: 88239 - DNA, 605 bp, Oryza sativa
ttctttggatagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgctcgaggcatcgaggccaaccccgagaagatacgagctatagagcggatgcgccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagttctcccccagttctggtcgccccggagccaaatgaacccttgctactctacttagcggcgaccccgcaagtggttagtgcggcgttggttgtggagcgcgatgaggacaattctcattccgcgcacccccaccctgtgctggcttggccccggagagagcaggaggagaggccccc

SEQ ID NO: 88240 - DNA, 530 bp, Oryza sativa
atgaagaaggtttatcggatcaaaatggatttagaagagtagctttacctgttattatctctggtcggggacgagaagatccttgaaccttaacaggagacttggatcccgggtcagcgttggcatccttcttaggagggctatcggcttgggcctctgctttcgggatatcttcgctctgagttgtgcccgactggcttccagttgggggctcctgttcagcactgacgttagcttcggccgactagtttccagtcgggggctcattgctagcttgtgcattatcaaatgctggttgatctttactcgggtgatcttcagtagtcggcccggtttcaactgaggggccagtctctgtgccgatcggcgtggggtcttttccagaaggatctatatcagatggctttctgcaaattccatacacgttgtcagctctgctacaatgatgagcgacttatgatacagaggcattttggtagatgatacacacctggatgactttcttatttttggcatgggacgaccggatg

SEQ ID NO: 88241 - DNA, 1997 bp, Oryza sativa
ccaactgtataaaaaataaactcaaacggacaaaatatgttacatatagaattttccaaaactctaccgaaacggacaaaatatgtcatctattaaaataggcgtaactttctcatacggactcggaatcagacaaataatatatgcatggacatctacagaaaaagttacatccgattctcccaagcttcgccaggttcggcgatattaaaacctccaaattccgcttgtaagattgtgttttcgaggagagaagtttttcggtagagctttggaaaattgcacatgccacatatttcgtccgtttgagtttattttttacatgattggttcatgtgagttcctaagtgtgaaaaaaatatcaaaaaaataaaataaaaataaaaaagttgcacatctctttcctctgcactagttcagagagagaggagaggagaggaaaaattctacatgtcacatattacgtccatttgagttcaattttttttatgtttggttcttgtgtgtctctaagcgtgaaaaaaatatcaaacaaataaaacaaaaataaaaaatttaggggggtgggcgtcagccactctggcgcactccccctagccacctcagcatcgccccgcaacgtcggcaggggggcgccccaaaaaggaccatttttaggataagtttttctagggatctatttacgaaataagtttttcaaaaggaccaaaatgctgatccttgcactgattattctgcaataatccgtccactacaacacacatgaccttttgcgaagaatttttcctgacatcgaagctatttataattatgtcattcagttttatttcgctctctatgggatagtgtaacttagcgacaaaaataaggggttcatcaatgagacgaactacaaatcgtcgtaacctagtctagtggcaatattattgtgacgagtgttattttgtcgtaagaggccaaccaacaaacgtcacaagctcatgacaacgttgatttatcataagtttttttttctaaatattttttttaaaaaataaaagtatagagcaggtcccctttagatttcacacgtgaatacgtgataggaaaaagtccactttgactcccttaattgtatgccgaatttaattcgtacctctcaaccagaaaaccggatagaacgactccccgaactattgaaccggtgcaatttgactccctcagcggtattggagggcggttttgctgacgtggcgctaacgtggcggtgttgacccggtcttcgtcccacatggcgcttaagtggcattagaattaaaaaaaattatgggacccatctgtcattcacacaaaaaatatattgtaggacccactgacatatggggcccaaatgtcatcctctctctccaatccttcttcctcctcccttcctctctctctctcccctttctctcccccttccccatctgcggccgaggacgctggagacgagagcggcggcggcgggcgagcgagggcgtagacgatgaggaaggcgaagaggaggttggcggctacgcccgcggagacgacgaggaggcggtcggggacggggcagttgcagaggaggtccgggtcgtcgggcgcgaagccggagtctgggtcgtcatcggggaggtggcggcaaggaagtggcccgactcgtgacgaggacgatggtggcgaggacggaggcggcggtggcaacggactggacgctggcgaggaggtcggacggggcggcggagatggagatgggcctggaggaggaggaggaggggtggaaggggaggtgttgcccgcgtcgctcgccgccgtctccgcttccccaacatgtcgtccccaccgctgcagaggccgacagatacggccgcgccctcgcccgcaccggccaccgccacctccccccagccgctccctcgtgccttcctcgttgccgcggcctcctcgccccaccgcgaccccgtatccccgacatgtcgtccccaccgctgatgcgg

SEQ ID NO: 88242 - DNA, 551 bp, Oryza sativa
gtgcccgtgcgttacaacggagaaaataattcacacctaactacgactcaatatataaatgatgcaaaattgtgaaaaatgcaaaagagaaaggaacagcttacgcctaaatctcttattctaacatgaacatagaagagagagagaaccatgcatgatactagctgtttctgaattttatcagagtccacgaattccgtagcaatttggctgtcgatcaatgcagccttgtccgatcacttcttggccgtctcctcggctgccgccttgttcgcctgcgcatccgccgccgccgcggcggtcaccggcggaccagccgcgggctccttctcgcctccggccgcctttttctcaatctctccagctgccttttctgcctcgccgtccttgttggcgtccgtgtcgccgccggtgtccttcgctggctgcgggggaggaggcgccatgtgcggcggcggggtctgcttgagcttcatgaggacctggcgcatccgggagaggtcggtgggcttgccgggcttggtgccctggacgaccaccacgccgggctg

SEQ ID NO: 88243 - DNA, 616 bp, Oryza sativa
cgcccgttgctgcctccgctgcccaagcatggtagctcgcaggacgtgctcgccgtccaggtcaccgtgttccctcgcgccggcatctgcgtcggcacgacgctgcaccacgccgtggccgacggttccagctacgtgcacttcctcaagacgtgggccgccattcaccgcctcggcgacgagcgcaggaaagcggtggtggtggaccacacgccgccgctgttcgaccgtggcgtcgtgcaggacggcgacggactccgggaggcgtttatccgcgacctccgggatctcgtggagtccggtgacaagcggctcgacgactgggacctcagccggaggccggacaccgtgctcgcgacgttcaggttcacggacgagctgctccgcaagctggggaggcatgtcgaggcggagacctcggcgcggtgctcgccctacgcgctggcgtgcggcgccgcgtgggccggcatcgtgcgcgcgcgaggcgtgggcggcggcgacgtcgcgcggttcgggttcgtgaccgggtgcaagccccgcgtgagcccgccgataccgtcgagctacttcggcaactgcctggggctgtgcttcgtggaggccaagcgaagacccc

SEQ ID NO: 88244 - DNA, 700 bp, Oryza sativa
ccttttatttgatgagatacagtaattgttgtggacttgaaagcaaagttatgagttcatcacagtacaaagggacgatgtttaatttttaagccaaaaattgtaaacatataattgttctgtagtggcatgtaaatgtgttagttattgcagtttaacacttcagcattttgtttcttatggcatgccagtacagcagtgtttgtttctatattcataattttcttataactactatgtgtaaagatacactaataatttgtatttcgtgtattagtccaatagttgaggtttcttatctattatctgagatggttcagcacgggcttcgctgcattgcattctgtaaaacaaggaagctctgtgagcttgttctagcatacacgtaagaacccattttcttctctgctattcatttttgtgttgttttttcttgttttacattacttgtattcacttatttcttcatatgtcattttgtattgtaggcgtgaaattcttcaagagactgccaaagaattggtagatactatctgtgtatatcgtgcaggctacattgctgaggtcagtattctgttctgtctcacctaatgtcttctttcattgtacttatcaaattttttattgtttcttagaatgaattttggtttgataaaatatgcctcatttagaatttcatcgtgctctcgaactgtatgga

SEQ ID NO: 88245 - DNA, 715 bp, Oryza sativa
ttctgcggcactggagactggaagataccacctctccttttgcatggtcaacttgatggtgcggctggcgcaatcaatcactcctctgtgccttgccaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggcttcgggcactttccaaccgtgtgtccgggtttgttacaattgaagcagagttcgggtttttctcccaacctcttgggctgttctggcagagctggctgaactgattgagctggaatctttagtgaactcggagtagggttgaggctgtgctgctcactgttgttgtgactatcactatggtgggtcttattgaagctacccgggtggtagggacggtgctgtcggataatcatggtggaaggtccaccgtgacgtcccatc

SEQ ID NO: 88246 - DNA, 505 bp, Oryza sativa
gctgcacacgtggaaaccacatggctaccaagcgtgcacactaacacggtcaccacacacacaagcgaatgactaccgacaccggtacacaggtaccggggtcgacaaccgcacaacgggcatgggcgacaccgaaaggacgaggacggggcagtgagaggacagatccttaccaccacgcgacgaggcgtgggaacgacgacaacgaacgggcgcggctgagacgaacggcgagaagacgacttcggcggcgatccttggatgaaggcgagacgcggccggcacaaggcttggcgacgcggagccgaggacgaagacgatgacggggctgcggcacttgacggagcgaggacgacgaacgagaacggcttgacggagggacgaacgccacggcgaccgggaacgacgggaggacggcgacgatgacgaccggggccagcgaggaggcgatgtgggcagccggcagtggctggacggagacgaggacggcgtggaacacgccgtt

SEQ ID NO: 88247 - DNA, 513 bp, Oryza sativa
cggacgttggtgggaaaagctttccgacaagggtttttctggccgaacgccctcaaagacgcctgcgacatggtgcagcggtgtgaagcctgtcaattttacagcaaacacacaaaattgccagcgcaagcgctccagaccatccctcttacttggccattcacgtgctgggggctcgatatactcggaccattcccacgaggacagggcggctacaggttcctgttcgtggccatcgacaaattcaccaagtggattgaagcgacgcccacgggggaaatcaaggccgataaagctatcaagttcatcaaaggaatattctgcagatatggattgtctcaccgcatcataacagacaacggcttccagttcatcagtgccgacttctaagattacagcattggattgggagtcaagatttgcttcccctcggtttctcaccctcagagcaatggacaagtcgaagggcaaacggcataatgctacaaggaatcaaaaaccgcgtctatgaca

SEQ ID NO: 88248 - DNA, 1057 bp, Oryza sativa
ccctttgatacaagaacttagatcggctatatctatttagcttctaactattcctaaattattcttgcaggtcttagccgatctgttctcttttgacattaaggactatctcgatgagacagaagaggataccacaagcgaagccttggcccctttatccgatgatgtgaagaaaactcttgaagatatctcttatcggctagaggcatcatcactagacagtttggtggtcgactgtggatcaattagggcccggctacacgaagttcaagctttaattcctgaagaactaaccgatgtcctcactccagctgcttattttgaacaacatcaattcaaactggagaaagccaagcaaagactagtcgaacgccgagaacgcaaagagattgaggctaccatccaggccaatcggcaactcgtgcatgaagagaagtcaaaacttgatcaactatctgagggcccgatcaggtctaatattgatcggcttgaagctcgaaagattgagctcttggcacaattccaagaatgcaatgccgaagtggttctggaacacaagaagctagccgatctcccatagtctgtcgaagaacaaaaggcaaggctaaaatcggctatcaagaacgtcgctgatatgaccaagtccctaaaagtcatccctggaaccgatgctcaggatgcccaattcattgaagaagtagaacaaattgggcaaagagctatatcggctatccagcgctacttgtctcagtgatattttgtgtaatagactctaggaattttatgccgattcaatataactccatattttgctaaaaaatttgcaattttgcaatttctcatatatgtgccccctaattttataatgtccaaaacattgataaaattataatttgaactaagggcgatataacaatatcagccattgtacatcggcaaaccacaaccgattacaatatgaaaacaactaagggcgatataacaatatcggccatctcaaggcgctgcaaatgcatcggctatcatgtaccggcaacatcagccgatcatgcattaa

SEQ ID NO: 88249 - DNA, 3955 bp, Oryza sativa
ttttctgggtgtatcattctgaaacggaacagcacagttaatacaaagaaatggtatgtcctgcagatgtgttcaaaatatttaaaggtgaggatggaaggttcaccgatgcaatatctaatgaaccaaggggattactaagtttatacaatggcgcacacctcctcgtccatgatgagacagaactcgtagaagccatctctttttcaagggaccatcttcaatcaatatgtgattcaagtgagctcaagccccctctagctgatcaagtgaaacgtgccctagacttaccattaccaagggcatacaagagaatggaagcattgcattatatgttcgagtatggacaggaggaaggccatattgtggtccttctggatctcgcaaagctggagttcaacctcttgcagcatgtccatttgaaagagctgaaatccttttctcagtacgcatctttccttgacatatacacatatacaaagtaatagaaaacaataaaagtaatcaataatgatatgaactatatatctcataagatataatgatgtcctaaactactacaagccaaaatttgtgtagagattaatttcaattcatttataatataaattctttcaattcatgataaaaatctatttcataaataccagacacggtatagactgttatgagatatttcataaaaatatttaaaaatgtatctgttaattatcaaataggcttgaaaggagacactatgttcgctatggaggtcataaattccaatattaatcagaggaaaagaaatggagagttcaaacattgaaatttggaattaaaaataaggaatattacaaaaaaaagtccataaagaaccaaatacaagattaattaaaatttgaaatcaaaacaaaataaaataaaaaattagaaaaggaaaagagtgaactcaagtaggaatggaatataatttagaaataactagcatttagaatataaaataaggagtattgaaaacacaatccatctgcaacacaagacgagattaagtaaaatcctgaattaaaaaataaattccaaaattaaaaaaataagaacatgagataaaatagaaatataatttagaaataagtaaaattctaaataataaatactccctccatcccaaaatataagtatatttagcatagtgacaattcaaactttttaactttgaccattaataacaaacaaaatgaaaaacacaataatgtaaaattgatgttactagatttatcattaaacaaactatcataatataaaactctttttatttaaaatatcttacttttataaatattgttgatcaaagtagtatctttggagaccgtgttagtaaaaaaatgcttatattttggtacatagggagtaataaatattgaaataatagttcatctagcaaaccacataagattaattaaaattcaaactaaaaataaaatatattttgaaattataaaaataaaaagaagagctcaagtagggataaaatctagaaataactaaaaattgatattaaaaataatgaaagaagagatcatctggaacacaacatgggattattttaaaatttggaataaaaaatacataacagttcatgtaggaatatattttagaaataaatggaattcaaaataaaaaataatttaaattccataattagaaaaaggatgagagttcaagtagaaatataatttacaaataaaaattaaaaggaataaatttagaaataactgaaattcaaaactgaaaggaataaatattggaagaatattccatggagacatcaatacgatattaattaaaattcaggaaataaagaacataaattctaaaaatagaaaggaggaaaaaagagggttcaagtccgaatacaaattagaaataactgaaatttaatattaaaaagaatatgaaaaaacatatatgtacaacacaacatgagattaataaaaattttaaaaagttaggaaaataaaaaaaaataagttttcaagtaggaataaaatttagaaataactaaaatttggaatagaaaattaagaatattgaaagaagagagtaaaacataaaataagttaaggttcatttacaacacacactgaaataagtaagatgcagcataaaacatgaaatataaaaataaattagaaacaaaataagagttaaattcagaatacaatttagaaataaccgaaattcaaaataacaaaatagggaatattgaaagaacagtgtacaaagaacataatacaatattaattaaaattgaaaataaaaaataagatctgaaatgagagaaaatgagaattcttataaaaatgcagtttagaaataacaaaaactagacattgaaaagaagaaatactgaaataggggtcaatctaaaagacaacgattgcaaatgatgatagagcgggtagcggcaaaccataaagaagtagctttggttgatagaccatttattctaaaaactataaaaccaagcctcaatgacgattaggttctatttttataatcctaatgatattaagaggaagggtgacatgcaagctatgaaagagtagggttgaagcggttgacaagacttctggaaagtaaaaagaggaaacctggccataacaatgaatagcttcaatattttaaatccaaatgacaataaagaagggtgcagtgggcaagccgtaaagaagtatggtagcggcgtttaacttgctttctaaaatctataagatccaattgttaaaggttttaaggaggatgaatagaagccgtgacagacagggcaagcaaataaagagacggtaaagatcttggtggcaactggtgtaacttttaaaaatataaaagtgaaaacccaataattataaggttcaaactttaaagtcctaagacaacgagatgattatttaataattttaaggaaaatcatgtgtaaacaataagataattttttagggtgctagctgtgtaattgcgcaagacacccaactagtttcaataatatcatatttgtttaaatatattgtatagaagcccacttacagacattgtagagaaggttttgagacatttcataaatattgtctagtgttgatgtttagaaactgtaatttaccaaatgttaaaagacatttttgataaagttatttcccccctgctgtaggcattatttagggtacggtgttaattcgtgtgtactggaaactgtaatttaccaaaaagttaaaagacatcccgcgtaggcattatttagggtacggtgttaatttgtgtgtactagaataaatataagaggactgatgtaggacatgaacaaatagttccagaagtcaatatgtgaagttttgatgagatggttagcatatcaaggtataagatggagatctggataggttcagggattgactgtagcatggtttacttgcttatacgtgttactttgaaaaatgttactttttgccactctgtttttccagaaaaaatatactgttctctttttttgcaactgttaatacaagttagtacaaattaaattatatgttatatttgtaattttctaaatttttgtttatgtaagggtgtagcagcattttgagggaaaattaatgcttgactcactactacaaaatcagttttttttctggctaaaatcaactttggcaagcaggcggccaaccgcctgcaacaaaaggctagagaaaattgtgattttggctggcgggcctcatccgcttgcgaaaataaaatttcgcaggtggcatcctagaaatccaccggaaaaatggatttccgctgatggcacatttaggtcaactgccagtgaagagattttccaaaaaaaaatccacatattccataggattttcaaaacaaatttacatcaatatattcatcaacagatcagcagattcacattaatagttctattacagtg

SEQ ID NO: 88250 - DNA, 622 bp, Oryza sativa
ttcaagagaatatttggcaacaccaatgaagcaaagttagtacgttggcatgccacagagagaaggaatgacggtttgctaagacaccctgcggattcgattcaatggaggaatatcgaacgaaagcacaaagactttgctgccgacccccagaaacatgaggatatgtttgtgtacggatggcatgaatcctttcagagacatgagcagttctcacagcacttggccagttctcattgcgaactttaacctcccaccatggttgtgcttcaaaaggaaatatattatgttgtgcttgttaatccaaggtccgagacaacccggcaattacatcgatgtgtcttggagcctgttatcgatgaccttgagattctgtggaaagagggtgtggaaacttgggatgcatatggtcaggagaacttcacactacgagttctattgttttgcaccattaatgattatcccgcgctgggtaatctttctggacaaaccgtgaaaggaaagaacgcatgctctgactgtatggaacatacacgcagtaggtggctgaagaaatcaagaaagatggtttacatgggtcataggagatggctccccctactgcacgcctttagaagaaaga

SEQ ID NO: 88251 - DNA, 684 bp, Oryza sativa
ttacgcatacaaaaaatcaccaccataattaaacattgtaatgataagatagataagaagtgccatcgatacacggtacaaatttgtcgatcccgacgaatcaagcatgcggtaacctatcggccccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttatgtaaccctaatggattgttcctccagtctaagcttgcaatttccacccgacgttcgtactccatccaagcatgaatgaactgtatggtcggtgcaggttgcgttatcggcccgccacttgaagtaactctgactgggtcaatccattgtacgaaagtgtgttgtcgtgagcataagttgttctagcaccatatgaatgaaaagaact

SEQ ID NO: 88252 - DNA, 604 bp, Oryza sativa
aaccgatgtaaatgtatgtaggtcatagtaagtattattattcttctgggcaatggtggctaacaaacgaggcaaattatcataagaagcttcgaatgtgccatacttcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaagcttaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgtccaatgcttcaccgcctccttcatctcatctttatgagcataccttgcaccttcaattacctcgttctccttatactcatagggtacatgatcaccatctgatataacaagtccagagaagtcctcatttgcccaatcagaggccattaca

SEQ ID NO: 88253 - DNA, 563 bp, Oryza sativa
caagcagagataaaaaatattacttgtgtagatcaactctagttgagatgtccttaacaagacattcttgtctcttcccaaactatcgcatgacatggtacggaaggtggtactcaactgcccagaaacaaatcaattggcactggtacatgaagtaatcggagcctcgattgcacaacgagatcagtgtaagacttgtagcctcagtggtgtggtatggtaaccactcaatctataaatgttgaagagttgtcgtaggttagtatttcaatcatataagtaaatgacgaattagaagtgatagtggaagtacttatatgtgtaggctgtaggcagtccatcacgttgatgtactgcttgtatgcgacgtcccggtgagcatgtgcagtggctatactctcaaataggtaggccactgtcttctccatgtctggctcattgtagggccaaagggtaaagctttgcctccacttatgcttgccaaccggttgtcttagccacatccacatctgaatcaccagcacacaaccacttatgttggatgatggggcctggcgacaacc

SEQ ID NO: 88254 - DNA, 600 bp, Oryza sativa
cggagtttccagtgagccgagattgcaccactgcactcaagcctgggtgacagagcgagactccgtctccaaaaaaaaaaaaaaaaaaaaaattaactgggtgtggtggcaggcacctgtagtcccagctactcaggaggctgaggcacgagaattccttgaacccaggagccagaggttgcagtgagctgagattgcaccactgcactccagcctggcaacagagcgagacttcatctcaaaaccaaagaaagaaaaagaaatgaatcattaaattcatctgaaattttggataacacagcgagactccatctcaaaaacaaaacaaaaaaaacataaagcaccgggcacagtggctaacacctgtaatcccagcactttgggaggccaaggcaggcagatcacctgaaggctggttcaagaccagcctggccaaaatggtgaaatcccatctctattaaaagtacaaaaattagccagggatgatggtgtgtgcctgtaatcccagctactcgggaggctggggcaggagaattgcttgaacccgggaggcggaggttgcagtgagctgagatcatgccattgtactccggcctgggt

SEQ ID NO: 88255 - DNA, 2181 bp, Oryza sativa
atcgaggtgttaggattcgtcagggagctgaggttgatggcttttgaggtaggctatgaagttgctcccgagtatcgccagatttcccatgaccccgacgaggagaagtgtcgtgttcgtgtgacgttggctagtgatagtgaagaccttccgtcttataagttcgaagctggaggaagatcgtactgccatgcttgtcaagaagtagctttggtggctattggagagttgcgtcaacactttgaagaagagttggattcatcagctttccagtatcatcctcataagcctcatggtcaagattatggaacctatacctgtccagatggtgaagagagtgccactctgatgcatgtggtgcatatgcttagtgctatggatgcagtaagtgtggagcgagacaaagcagctcatgatagggaaaactggaatcgaggcaagatttgcaagttgaagagcaaggtgcaccgtctacagaaggaattagctgaacttaaaggagagacgccaccgccaacatccaagcttcgcctcactgcaaggaagagaacctgtccgccccctcgtctccagttagcttcgaagattcgcgtgatgggtgaagctgtgcccgattgtgctcaacctgtcatcgacatcataagtgatgaggaagaagaggaagatcctaaagaaagagagccagctactccagaggaagaagattcatcgcttcgttccgacgcaaggcggaagtagacgtttagttagatcgttgccatagttcgttgtgttagattgcttgtttaagtttgcttgtgagtgtgtgggttgtagttgttgcttacatcatgggtgggatgtaacagcatgagtctagttcttttgcttgtcagagtgtaagatagttggtgaggtagtgttaatgcaacttaaatgtaatcatacacagttaagagcaatatagaaatttaaattaattaaataacttcgttctaaggctgtctctctgtcgttctttcctgttgtctctgcttatcgtcagatggtgaacacgcgcaccggcactggaagtggaagtggaagtggagccaataacaatgaagagaactcaacgctagctcagattttggcccaacagacacaactgatcaatctgttagtgcagcaggaacagaatcagcagggaaacaatcagaaccagaatccaccccacctccccaaaataagttggcagatttcttacgtgtgagaccccctaccttttcaagcaccaccaatccagtagaagcaggagattggttgcatgcggtggagaagaagttggatttgatccagtgtactgagcaggagaaagtttcttttgcttcgcatcaactgcatggacctgctgctgaatggtgggatcattttcgccaaggcagggcgggaggagaacctattacttggcaggagttcacagctgcttttaagaagacgcatataccgtcaggtgttgtagctctaaagaagagagagtttagagcactcaaccagggatctcgttcggttactgagtaccttcatgatttcaaccgtttagctcgctatgctccagaagatgttcgcactgatgaagagcgtcaggagaagtttttagagggactgaatgatgagttgtcttatgctttgatgtctacggatttccgggatttccagcagttggtggacaaggcgattcgccaggaagacaagtataaccgtatggagcagaagaagcgcagggctgcccaatttaaggcacaacagggcagtaatcagaggccgcgtctcgttactggacctcaagctccatcgtaccctcaaggaggatcttcgtcagttgtccgtccccaacgccagttctacaacaacaatactggtaatcgtggcaatgacaaccgcaacgtgatagctcgtcctgcagcaactccagttcagaatcagtctgtcaggaaggaacagggaagcaagcccgtgatatgcttcaattgtggtgatccaggacattatgctgataagtgtccgaagcctcggcgtgtgaagaacgttccagccccgaacaactccaatgttccagcaccgaaggctcgtgttaatcatgttgtagcagcagaagctcagaatgcaccagatgttgttttgggtatgtttcctgttaactctatacccgcaactgggctg

SEQ ID NO: 88256 - DNA, 657 bp, Oryza sativa
gaagttatgctatgattgccccatatgacgtagatggtaaccgtattacgtacccttctcttgggggacgaaactacaactctactacccctgttaaatttacaaaactagcaaaaccacttaaagtcggggatacagaggtttttgtagaagatgttagtctatggaacggacaggcaccgcaagactaccaacgtagtattatcatgtggggttataaaaactcgttcggctatacttatcccgatggaacgtatagtcagctaatgcagatgaggacatatgatattggtgcagttgacaccacagctaacaagattacgttaaacaagccatgggcagttgcaaacccaaatagttcagatgggattttcccagtagggcatacacttagcccaacttctgacggctccacatatttgtatttgaatggtcacgtaaatatacaagtacctactacgtacaccaagtacagccatttgattagtggctcttctgagtttgctaatacaacgattatcccagtagaaacaggttttattcaacttggattcttggtgaaccgtgatacaacaggtgaaaaatcttggctaaatggtttacgtctacgtgactatacagatacgtataaactaaacgatgacgttagagaaacac

SEQ ID NO: 88257 - DNA, 1085 bp, Oryza sativa
tagcaaaatgaaatgatatagagaatgttaaatagggcatacctaaagtgacattactgaaagggcttccactggcaaatactgcattgtctccaacatatttgaatacatcttcaggagtacattcggctgtaataagaaaaatataaatatcaggcatttatgtttgggtatcctagaagtaaatattaatgggtgaggtgaggaacctttagtagttgggttggacattgcaaaaattgcaggacgaggggaatcggattctttcatagccttgagaacctgcagaggtacaaagataaagttaagactccaatgttgaaatttataagagagaacatatgagtataccctaacagatgaaatccactaggatcatgatttagcacttcgcaacaagccggcttaatattattacatttgcaaaggagagaacttttgaaacctaacaacacaaatacatatttgatgctcttgtaaccatggtttactcacaaatcataatgaagcaaactaaaacagtatagaaatggcccattaatgtaaacctcacaaaatcctttataaggttggagaaaatattctaactcaatgtgctaccaatcactagcatcagatttgaaagggtgtactggctattgctatattgaacatataaatattactggtactgtgaaatacatctagaagttgcggggaactaatatgggagccactttttttagatggattatttactgcactgaaaagtccctagtctgactagtcatatttataagtgaggaccattcttcaacttttttttggggtagaattatgaaatcaacatgttaggaattgttgattcttacctcctcattaaatatgcccccaactccagaaagtcctaaaagcacatgaggcttcactttcctgacctgatgatcagtataaagccgtattagttcaagcacaagcacagaagcactggaaaatcttctgttacaataaaatattttagctccagcagttgaggggaaaaaaacaatcccagaattatttttataccacttcaacaagagctagccccctcatggagatattgc

SEQ ID NO: 88258 - DNA, 718 bp, Oryza sativa
tatagggcgaattcgagctcggtaccctccctttgtaatatgtggtttccattatataatcccataccaactggattagagctattacctattaaggggtctgaaccagtataatccctatttcttgtttgcttgatgtcgtattacatagatcttcgtaccagcgtaccccaataccctctatatccgatctacgagtatccatcgtcgacaatgtgtataaactttatatacgatgtgtacaaactttatatacgaagtgtgcaaactatgtatatgtacgtattaaaaaaccaaaaaaaacatcatatgtatacatatacgtatacaagtatacatactttatatatgtacgcgttaatcgccttaattttcactgccactattcatgaaatcaaaaagatgctttcaggatcaccatctatctgttgttctagtactacaaagtacaaaccctcagtaagattcaggcattcagtaagccattttgatacttatttttcttaagataaagcaagcttttacatcaagctgatagaaccacactaatcctgatatttttcttcatgtagaacaaattcagcctatgtagaacaacagttataagaaaaaaatcaactaaaagagttagttatacaaaaagagtagcagaaaatgttagttattcagaaatcgaatatctaatttgctcgaatcctaccagcagggagatgagata

SEQ ID NO: 88259 - DNA, 614 bp, Oryza sativa
ccagctagagctaggttattcagtggttttaagctgtgtttgaatcaactgaagatgaaaataaagataaagattaagtgttttacgtaaaataaggtggtaataacttgtgattaattgagttttaattattataaacttaaaaaatggattaatttgatattttagaacaactttcatatagaaatttttttgcacgaaacgtaccgtttaacagtttaaaaagcgtgccataaaaatccaaaacttaatctcccatctgttgggttctcgaacaggaccacgaatctaaacaggctcatccacatcttagtactacaaatatggactaagagccaattcagattcatcgtactaggatgtgccacatctaacataaatctcttatattttgggacggatggagtagttgattgcggtgtgtaatggtgaactgcgtttgaatcaactgaagatgaaaataaagataaagattaagtgttttacgtaaaataaggtggtaataacttgtgattaattgagttttaattattataaacttaaaaaatggattaatttgatattttagaacaactttcatatagaaatttttttgcacggggatcctctagagt

SEQ ID NO: 88260 - DNA, 627 bp, Oryza sativa
agctaggtagctcgagcaatggcgaagtgggcggcggaagcgacggtgatggtggttctggcggtgacggtggcggtggcggtggtggcggcgcatgcgccaccgccggtgcagtgcgatcccgggaagctgtcggcgtgcgcggtcccgatcttctttgggactgcgccgtcgaagtcgtgctgctccaacctgcgcgcgcaggagaaggacgggtgcttctgccagtacgcgagagacccgatgtacgcgtcctacatcaatagcaccaacgcccgcaataccatcgccgcctgcggcatcgcctttcccagctgctaggctagcttcgatcgccatgatgcatggcgtatattaaatatatggtgtgtgcttgaataaaggatgtgagtttgaatcagtaagaactatcgatcgattaatgcacccccgtacgtacgtgtttgatcgatcgatcagctggtgtctcctgactatttaagtttgagctaaatttcccggatttcccctttttttttggttgggttttgggggggtttttaaacccccctttttcagtagtagtactactacactactactagtactactactataaacaaacatatattttttatgtataaaaaa

SEQ ID NO: 88261 - DNA, 651 bp, Oryza sativa
cttggtcactgctacaaaagtgtggatgttggtaccattaatggggtaattccacatttataacaagccaagaatctgaaattgattttatctgtgtttgaaaagttgtctggcttgaaaataaattttaataaaagtgaattattttgttttggccaggcaaaggacttttatgaataatattctactatctttggttgtaagttaggtacttttccagttagatatcttggtattctaatgcattttagaaagcttagtaacaaagattggaaagttattgaacaaagaattgagaagaaacttagtagttggaagggaaaacatatgtctgttaggggtagactggttttgattaattctgttctttctagtttagctatgtttatgatatctttttttagattccaaaaggggttcttcaaaaaattgattattatagatcaacattcttttggcaaggggatgatcataagaaaaagtacagacttacaagatgggatattatttgccaacccaaagatcagggtggtttgggtgtccataatttagaaatacaaaataaatgccttttgagtaaatggttgtttaaattaataaatgagtaaggggtttggcaagacttattaaaaacaaagtatctttataatc

SEQ ID NO: 88262 - DNA, 728 bp, Oryza sativa
  unsure (1)..(728): unsure at all n locations
cgcccgtggtntagtaagcgctcggatcgaacnnncacaaccgngagaaggtccgccgcgacgaggccgaggcggcccgggaagagcagctccagcgcgaggccgtccgccgccgggactccgacctccgcctcgccgggttcgccgcaaccgcggcctccagtccgccgacgcggcgcccctccctccccgggcgcccacctacgccgcggagcagtgccccgcggatccggccgacccgtcccccgccgccgacgactcagacggcggccacatcaacctcttctccgcccgcggcggcggcggtggtgcaaccgacttcgccgtgctcgcctccgccgacggtgggaggggcgccgccagggagcgggagcctcccgcgaaccctaaccctaagaagcgtaagaggaaggaggaggaggtgagggcggtggggcccgacgaggagaagtacaggctcgggtatggcctcgccgggaagggcgtggcggtgccgtggtacatgtccaagccgtcggcttcatcctccatggagaggaaggatcgccaggcgggagaagggagtgtggggaagaagaatggtgggagaagagccttgcggagctttgggaggaaaggacgaacagtgcggtccaccgaaaaggaccgtaatctctcccctgcttgtcccccatcaatgaaggcaaattctgcgctccggctccatgacctcgggtgcaactctcgct

SEQ ID NO: 88263 - DNA, 2235 bp, Oryza sativa
  unsure (1)..(2235): unsure at all n locations
tactgttaattttattgtacttagtangatgttagcgtacaaatattatcttattacganttatatttagttctttaggcatttttttatatttcnanacannccnnnnncnatgtgncntttagancnctggtcggacccctgcaataggacngntgactgatcttcagacactgtcaaggtttgtcacaagcaagaggaacattcttgacaaccacagcaatattaaggagctagataaattggacaatctctgcggggaactactcatttcaaatctgcatgttgttaaggatgcgcaagaagctgcacaggcacatttggcttccaaacaatttctccaaaagatggagctcttatggaaaggcaacaacaaacaagctgaacaaattttggagcaactgaaaccaccctccggaataaaagagcttaccatttcaggttataccggcatatcgtgtcctatctggcttggttctgaaagctacacgaatctagtcactttgtcactctatcatttcaagagctgcaccgttgttccttccctttggctattacctcttttggaaaatctccacatcaagggatgggatgcattggttaaattttgtggtagcagttctgccaatttccaagctctgaagaagctacatttcgagaggatggacagtttaaagcaatgggatggggatgagagaagtgcattccctgcccttactgagctggttgtcgacaattgccccatgctggagcaaccgtctcacaagcttcgatcactgacaaagataacagtggaaggatcaccaaaatttcctggtcttcagaacttcccatcgctgacgagtgcgaatataatcgcgagcggtgagtttatttggggatcatggcgctccctttcttgtcttacgtccatcacccttcgcaaactgccgatggagcacatcccacctgggttaggacggctccgttttctgcgacaccttgagatcattcgttgtgagcaactggtgtccatgcctgaggattggccaccttgcaatctgactcgcttctccgtgaagcattgccctcagcttcttcagctacccaacggtctccaacgcctgcgagaattggaagacatggaggttgtaggatgtggaaagcttacctgcctcccggagatgagaaaacttacttcactagaaagactggagatttcagaatgtggctcgattcagtccctgccaagtaaaggtttgcccaagaaactgcagttcttgagcgtaaacaaatgcccatggcttagttcgcgttgcatggttctgggaagtactatctcttcactatggattgacggtgaacttattaggtactagtatgaattggatttagatttagaataaggggatgacaactctgcagtacagagtaagttaagcctcttttgtttgattccgtaacagtttcagaatgtaagttaagcctagtgtgcctcaaatgtcctacatgatcttgtttgtggagaaatcatctttcttctgtaatgtaaagtactgtttcatatgtattaacttggataaacgtgccagcaaaagcacaatgccagaatgggaaccaaaatgacccagtatgacatggtatctttctgtaagacatccttaaaccttgtgttttgttgaactttatcatttgcaccgaaccttttacaagcatgtctaatcacatgtgatgctagagattcgtgccgcaatttcaaagtccatcaaaggttttctggcaaagcaaattacacgaactatctttccattctcgctgtttcattataaaatgttttaagtttcctttcaaaaaaaatgttttaagtttgttttagtcaaacttgttcgagtttgattaaatttatagaaaaacataataatatttataaaacagaattagcttctttatatccacattgagtatattttcattgtaaattcattgtgttgaaaacgttagtacactttttataaattttgacttataacaaacgtaaaggaacttataaaatgaaactgaagtagtattagagcttatttggtaggacgtcaacttctaaatttaactttttaggagcggagtttggagtagagctgtggagcagtcagaaccccactctatcccagtagcctgtaggttatttatgtcagatcattccagcccactccactttattttcgatggagctgaaaccgttaggtgatactccaggtt

SEQ ID NO: 88264 - DNA, 2981 bp, Oryza sativa
gtatttttatgtaatgtacatgtcaattttgccacattgttgttcgcaacataggttaaatacaaaacctacttattttgtgttggtaagctgatggtattttcttttcctgtgtccgttactcgattttgcccccaaactccagatacagcttgcccttggtacagactcaagtatttctgttggatggcaaaagaaggatgaaaaaaattctgcagcaggggatgtgaaggtaattctgaaacaactctgttatcagctaagagttgacatatctgtttggaatttgaagtacttgccattttatgccctcgcacaatttacattgcctggttggattcatttttagtagcacgtagcttcatgttgtttcgttctgtagaattcacggttttattttctttcaaaacagtgccctgtgtacttttatccatgacacttccgaggaggtgtagttacagcatctattataagttcgccgctgtgttcttacttctgaagctagcacagtagttagtataggagtgtttctaagcaatcagcagctaaagtaaccagctccccatggttgccatatggttcattagtacttacagatatctggaaggtcattcaattttccaagcaatctcatcactaaattaacagcacctattctgtgtaggactgtagggccttgaaaattgagaaagttacatctctgataaattgtgaaaaacaggcttcacagtgattataatatatataccttgactgtaatgccttcaagaactaattgttttatagattgtttcactttcttacatcaggcaactatccgatgcttgctttttgaggacttgtattaacaacctagcctttttctttccagcttggtactaattattttggtgcatctgctcattacacccgttatttctccaccaagtctcatggtcgcgttgctggtcgagttggaaggtgtatactatttgatttcacttatgtatggccgtattgcattttttgaaagccattacatgagtttgtaacccctattcctctctcttgaactgttttcttgcagcacggcccttgattttgaaattggaggaggaaggcggatatctgagttcagtactgtaaggatgatctataatataggaatccaggtgaagtgcttgtttcttaggtctcatgtgtttggtgggattttgctctaatctcttgcaatatctgagaaaattctcttggtattttgctaccatatcaccatatcgattctgttgaaataccttgtgttaatgctactccctccatcccagaatataagtattttagagttggacacggttattaacaaagttggtatgattaaatgggagagtattgtgattggaggagaagtggaggtaggtgggaaaattgaatggtggagggttgtgattggttgagaagagaatgtcgatagataagttgttatattttgggacaaattcaaaggctagaagttatattttgggatggagggagtattttttttaagacaatttgattttggataaacagtgttgtataggctgtgttcgggaggaggggttggaaacccctcttctccgggacgcaaaacgatgtatacattaacgcatgattaattaagtattagttttttttttgaaaaatggattaatatgattttttaaggcaactttcatatataatttttttttgcaaaaaacacaccgtttagcattttgaaaagcgtcgtgcggaaaacgagagagatgagttgggaaagtgaacaaaagaacccaacttcctattctatttaggtccgctcctgcttttgtcctttccgaaggtatccctcggggggttaaaacatgactaaacattggttccttattgatgatcacaataaatataggctaattctcctcgcaaaaaaaaggctaattcactttatctcctgagtcaaagcaaattaataaacttaattgctgcatttatgcctatgatatttattcatggataacagtgcaagtaactcatgcacacttctatttatccacaatggaaataaacattttaatctattgctattactctgcgatgagtttgaaacatgtatatggaattattgataatgtattgttgtgaataaataattaatgaatctttattgttcttattcatacacatgcttctagtatgaatgattgtgagaaagacagaaagcatcctctgcagtgtttataatagctctgtaatgcactttggagtatataacctcttaggctctgttcttatctccaagttcccaacccatcttcctcgttttccgcgcgcacgcttttcaaactgttaaacggtgtgttttttgcaaaaaaattctatatgaaagttgcttaaaaaaatcaaattaatccatttttgaaaaaaaaaagctaatacttaattaattatgtaataacgcgtgcttcgttttgcgtgccggggaggagccccttctctctttttcctaagctccacaatccttcttatcacttgttttcccctttttgtcctctactgttctcactctactctgctcttctccatccccctccccagttttcctttccgatcttttttaacctctacaccggtttcctcttagcctaaatatcttttgtctctccgccctcccccaactcagattgccccatctctcgtaacgattaggctacttctgtcctcatcctttcccccaaaggcccgctatccctctctattgctctcccgcttcctcctccccttctctccgctacgtgcccttcttacattctggcattattctatccttcttctccgtcatcttcgccctcccttgtcttctctcttctctgatgcgggtctaacctaattcttcttctttgcacaatgacttatagctcttctccttaggttcgcccacatatctattcttctatttttgccgctcctcctctctgctctctccg

SEQ ID NO: 88265 - DNA, 639 bp, Oryza sativa
atgagatggtcaagaaagggtgttaaccagatgttgtttgctacacaggggtgatcacaggttatgtggcagctggggaattcgatgaagcccataagttcttcgatgatatgttgctgagagggcagcttccgaatgtgtacacatacaattccatgatatgctgactttgcatagtaagagaatttgataaagcatgctctctgctgaaggacatggagtcgcgaggatgcactccaaactttacagtgtatagtactctagtgagtaggttgcgaaatgctgggaaggattctgaagctaacaatatcattcagtacatgacaaataagggtcattatcttcatttattgtcaaggttcaggagatatagaagatgctgatatgtgaggccccatagtcagttacattgtaattttgttgtattgtttccaacttggaaagatggatcataagggagtactttgtgaggtaaccattcgcactctaactgttactatagcacatacgggtccttatctatttattcagtacagaaaatcaacactgggtacttaaactgggttacgcactaagtgaatgggaaaggatggggtggcctggccgtgtctaaattctaaccgacttatgatggaggag

SEQ ID NO: 88266 - DNA, 658 bp, Oryza sativa
atcaattttaaggtattattgacaacttttacgatgatctctaccaattttgctcacctgcacagtgctgcgggcgacgccgtcacccttgttgtaagtacccctactatcctccgtccattcgccgtagtccatcctgcatcgaaattcaagctcacccaccttaacaaagatctccaagaacagccatggcggatgtacatagctttcaagctaatttgtgccattgctagctactacttccttcgtccagaaaaataaacatagaattggacgcgatatatcctaatataacgaatctggtcaagagtcagtctaaattcatttcatatgtcacattatttaattctaggttcggtttttatttcatatgtcacattatttaattctaggtttgttttttatgggacgaaaggggtatgtatttacccgacgacgaaaaaggcatagccgtccatgtggtaactctgcatcctggtgtcggtgttctggaaaatgagcctccatgaagccgcggtaggtgccgttgattatggaactgggccatacagggggcccccgcccattggccgctcctggaagtcgagcgagtagaccccccttactccgtacgcttctgttagccgcaacgctgtttttgctgtgtgaaggcaaccct

SEQ ID NO: 88267 - DNA, 3271 bp, Oryza sativa
aaattatcaagtatgctattataagggttggattacaccaagttagtttttttggatgttgcaactaatttcttactgggaaattatctgcttgatgcagttcacagtgtgggcatctagacagctaagagtggtcctgttctttttgactgtatcagcagtaagcacaattggaatatgaagccttctaagaagacggagaaaaaaccaacttgctactaaaaatttaaaatgaatgacatgttgatttgccagttgagtttctatcgtgataataaaccaaataaggattcctatcattccaactgggcaactggcaaatagtctctaaacagctttgtattaaatcacaatgcttaggaaaaaaaagtatctatctgttccagtaggcacacatgctggtttttttaatggttttcttctttatttttttaaaagatcaattaagcactctttgtaccaagaaaaacataagtagacttttctatttctaaaccatcatcatgtagaatcacacaatggagtaaaacgggagacatggatttaatgtggaaagtcattatgaaaaaagacatgcacacaaagtgattagtccggagcagaggatacggagaactcggaccgtgattaatccggagcaaaagatacgggtccccaagtgacaagggtggctatgggggatctcttcctccacggcgggcgtctcatcctcgcgaaagtgagggcccctcgaggcaacctcaccagttcaccggtgagggctcgtctcgggatcctcaaacaccgcctcactaccccgccgttcccattggttctctttggattcacaccccagagcgggatcagttggtgattcggcagccccacaactggcgcctcaaatctgaggtggttgcgccccagcgggaggaggatcctcgcagcaaccgacgcaccgccaccgatgctcgtttttggactctctttcaacaagatttctatgagactgtgatcaagcacaagtctcatcccacggtggcgatgcagtggatcaactgggaggagttgcaatcttttgatgacccagatctcaactccgtcattgcagtttgtgaggaaatgggggttcgcgcgttcatgacacttcagcagccgtggtgtaatgagattatcgctcagttttatgccacgatgtactttgaccgtactcgtgacgtgcattggatgactcagggcacctggtactccatttccgatgagaggcttgctaagttgggggctttgatttgaactggatgcaacacttcgccaccttgcacgatcatctgatccccctcaacaccgagcttcgtcctttgtatcttcctggtggtgtcttgggcaagatagagggcatcaagccctttcactcttttctgaaccggatgttgtgccggactcctgtgccaaaggatggtgatgctagcaacatcaaccatgtctcccggaatgtcctgctcaggttcaatcctccctcccaccccttcaatgtcttcaatttgtatgggaggaaatctagttggcatcttttcagtacaagaagggcttaatctatgctcctcatcttatgaggatgatcgagaccgtgactcagctgcagtttgagcatgaggcacctcaccctcagcttcacctgcgcctactcaaggttgaccgcccctctagggtggatacttccactgcaaagctggggacattccctccacttcaactcagccacatgctcctgtggctcaccgcgagccttcttccttgttccacatcttgcgaagtcttttttggcctttgctctgcagaggctaagaagaattgcaaggcgcgaaatgaggttaagaagacggcccggcgcgtcaaggacatgcaaacttagttgaacttgcatctacaggtggaggcgcctccttcgcctctaggttttgaagcagagcctgacgagcctgaggaggagattgaggaccccttcgctggctatcctccggacaacgacttctttgtgtttatagtgcacacttctagggggagttctcactaaaactttgcatccacatcaataatttagctcactaaaatagtgaagatggactaaagttttaccctgccaggtggactcgagtggcccagcttagctttaccctgccatcgcctcatcctggagcacgtggctggctatccgtcgttgtgcgccatgcgcctcctgatcccgctgactgatgacgcgctagtttgtggggatcgattattagcatctttttgacattcattcattgattcatcatgtacatttgtgtgttgttgtgtgcgtctgtgattactgattagtactgtgcttactcctgattggctagctagcagtaccagagattgtgtttgttttggggcccggatttgacgacggcattccttcattcttttagtctgtctgatagttggattgacacatgttctttctcctgtgcttaattttacccccttttttttgcatagatagatgttcattcttttacacatgtgcttaaatatggttttttctgtatgcatgtgtgtgtgtgctgcactgctcccgtgcgtaaattatacttgtctctcatcagtgatggaagtgcatgcgtgtgtgcggagggaaaaaagagaggctacattgatgtacattgtttcctctgcttacattgttctggacaagtcgcatgcgctatctcgtcagtgacacatccacgtggcctgcgatgtgcaagacatattgattgttcgagggatttaaacggaaaaaaataaaacattcaacagttctcctccccccaaaacttatacttagattccaaatcttataatagagaaacaacaaaaggaaaacactaaatacccagctagacctgtcatgccaaacaacacactgagtcgatgtagcctgaactcccacacatcacattcatattccatctatctcttaccgaccccttcgccacgctgccccttcatttggacggatccattcgatccagatccgacaggctctataaacgcaataagggtgctccattatggccaatttacaaaagctagatcgccgacacaagaggatgttaatctagagcgagcttacgccagttgcttgaggggtgatgacacggggttgcctagacaacgtctccaagaagagaaaaccaacggtaagaagaccaccccaaccccccgggtttcccgggttttatttttgttttgggaaaaaaaagggggggtgtttttttttcctaag

SEQ ID NO: 88268 - DNA, 4010 bp, Oryza sativa
  unsure (1)..(4010): unsure at all n locations
cgtttaaggctcccatcggatggtctattcagcaaaaaaaaaaagtaaaattttgaattttccaacttaattttaatattgattataacatatttccaacgtaatttcttttttagcattagcttttaaatcaccgagaacccatatatatatatatatatatatatatatatataagttttatctataaatttatttttattctctaataaaccgttttggcttattaaaagaaaagccaaacaatgggcccctaaaccgtatgcatcccacttcccaagctatcatggcaacatagcaaacgtgatgctgtatgtgctatgatcgactatgacattatacggtactagtcacaggtattttattttctcccatatttttttctctcggttcattttttataccgttattggtttttagccctctttttatacgtgggattggctttttttgttttcggttgatcagtttccttacacgtggttatctttttatttagctgttttctggtttatatgattaagagggaaggagaacgatggtgcttttaagttcatagagaagctcacgaaaataggtaaaaacagtcttagttgttactcccttcattcaaaaatataaaacatatttcttttatcaccaagataaagaagtaattaactcacccgttatgtggcaaaactaataaccaataactactaataaaatgaagggagtactaattaatacttcctccgcctctaaatatttgacaccgttaacttttttaaacatatttgatcattcgtcttattcaaaaacttttgtgaaatatgtaaaactatatgtatatataaaagtatatttaacaatgaattaaatgataggaaaagaattaataattacttatattttttgaataagacgaacggtcaaacatgtttaaaaaaatcaatgacgtcaaatatttagggacggaggaagtattgtggggcctgtttagatcccatggcaaattttttcaccctgtcacatcgaatatttagacacatgtatgaagtattaaatataaacgaaaaaaataactaattacacaaattgcatgtacattacgagacgaatcttttaagcctagttactccacgatttgacaatatggtgctacagtaaacatttgctaatggtagattaattaggtttaataaattcatctcgcagtttacaagcggattatataatttgttttattattagactacgtttaatatttcaaatgtgtatccctatgtccgatcgacacaacgaaaattttcgatccaaacacagccactntagttatgacttgtttactggcactgttatctcgttgatgattctttcaggcacagcttccgaggcacattaggccactgcaacggtacagaagaccacacgatacaggcagtggcggcaggcgattggcagacgacccccaagtatgctcgccttgaacaccaagtactagctagcacgggagtaaagccaactcaaggtataagtaaggagcacgcacgcgactgggcctcgaggtgaacacgataggtatccggaggccatttcttattgcgaggtcaaaactgaggtttaccaccgtctctttaaacgtgtgttaagtgacatattctgtctatttagacatattctgtctatttgagcatgtgttaaggaacgtgttttgtaacagtgtgtgtgcgtgtgggtttattgtgtaattaaaaaaaagagtgttatcaaaccgccgtggactaggttatcgcaccccaccgataaacacggttaacatcatagtaacacaccacgataaattatggaagcagataaaattttattgaaaaagttaaaactatttttaaaatctgttttgaactgggggagttaatcgtgcaccgtatcgcggcggtattatctaactttggtcaaaacacacacaagtgaagccacaagcaaatcgtcagagcatgcgtgtgcagctgctgctggactgaagccgaagcaaggaacatgcccaaccccactggtaaagtggcaggcacgcattcttaatgccgcagctgctactatgtcagcttgttcttcagctaaaacagtggcagttaactactgtcacaagatggaggcaatgatttggttaggcttaatctctgaggtgcaagattgacagcaaaatgctggcctttgagcaagttatgaccagatcacccattgaatatatggggtctttttttctggtaagagcattgtgagtgtgctaggagtctcctactagtttgctggcagtacaggtgacaagctgtagttagtttggaattggtaagaaccgggatgtggaatttattagccacgaggcccttcataattgatgggggaacatggaccaactatgaagaattgcaaaggcagcagcagtcattaggaattaattccaggtagtttcattagttttactagagtattatggagtacaaagctttttacagtgcaaaagagttcagtagtagctctgaactttgacgacaaactgtgttgacgggctacaggagagaacgaaaaagatgcagcaaaggacacagaaatgatactgtcccatagacagaaagtcacctgactgacatgaaacctggatgctgccacacaacacacaagtttttggaggcgttgggcattttcctcaagacagaaagtgtgtgtgccacctgactgaattcggaatcgaatactgaatcccaatcatttcagaattcagacaaacattaagcatgtcctcagaataagaaacatcgatcagtgaaaggaaacttgaactgttgttctgaaccattctacttgaacaaacagggaacaaccctagttacaaatgaacaaacagggtacaatggcaagtttgcatttccacaacagatgacaaagtgcagcatctgatcttatactgaaggaagcaaaggattcacaggggcacacaatcataaatataccttttttttatagaactacagagaaataaattacaaataattagataaatagctctttgacaatgttagaacacagctctcagaatctgatggcctttgtacaacactacaaatcacgaataacccgcttttacccaaaccaaaactaaaatgaaagataagtagctatttctgtactactcatcgagcagcaactgtgactctccgaaggttattttggcactgttcttgatcgcctttacacaaacctccttttgttttccaaatgtacagtttcttttttgactatattatttcattcacctataattccttccctcttgccacaatctaggtacaccctacactggatcaccgtcccaccgagccgaaatcccggcaccaccgtgaaaccgaccttcggtcgcatcatctttccgagctccttgcttcctgaaaatccttttgaacgcacaatgttctccatgtaaaccaccgagtactccgctccctggccaatctggaatatgccgactgccggatcatacgcccaagccaatctatgaagtgtccatattgagcttgccattgcaacgaacagctcgtagagtggtccggccacgcccaacactggcaatttgccacaatcagaattcccaaacagtgaggactcaatgccaggatgaatgagctgcttgtactttcggtcacagaattgggcgaattcgcagtctgggcttgaattgataagctccattgggtctgcatctgagtgctcgatgaattgctgcattgactcattccttcggattgcgagatcgattcctttccgtgtggtggcatcagttgaaccaccaaattggtatgaatcgaagccatcaaacatggataggcaaacccgggagaggagcgcgtgccggcagtgaccaagcctggagtagctacaccggggagaaccgccgcggcggggcaacaagaacccaccctgcgcatcgaagaaattcgccagccaaccggtgaaacggtgggccactccgaccg

SEQ ID NO: 88269 - DNA, 1950 bp, Oryza sativa
  unsure (1)..(1950): unsure at all n locations
gaaaaatatatagtttgaggaaattaaggaccaaaagtagtttatgaaacaaattaaccagttctcagaatatccgcgtcaaggtacagccacacatcccacccaacaatgttttcaattgaattgaaggaaagcgagtggcatcttttcagtacaaaaagggcttaatctatgctcctcatcttatgaggatcctccgaggacttgaagtagcggaggacggcgacgccggcgacgcggcgccacacggtgtcgttcaccatgcgcgcgctggcgacgacgtagtagtcggagctcgcgttctggtcggtggtgacgaggaaggagtaggactggccgacgtggacgtccaggttggtgtagttctgctgcgtcgtgtaggagccctccgtctccaccagcaccatgttgtgcccctggatcctgaagttgaggctcgtcgacgtccccacgttgtgcactcggatcctgtacgtcttgcctgtgtccccacaccgacgtcgccgacacacgcgcaaaagataatagactcattgtaagtaggtagtaaccttctccgtttcatattataaatcgtttgattatatttttgttagttaaacttctttaagttttttttctataaacttaattaaatctaaagaattttaataaaaaaaatcaaacgacttataatataaaatggatggagtagttgcatcaatttgtggatgaagcaaacaagattatatccttttcatgagggtgaaagtattcagtgaacaattcgtcagtttcaagtttcatgaaatcggacagggtctctgaaagtctgtatttttggtactgttggattgactactctggcttctgttgtcacatcttttgtatcctagtttcggtaaaaaaaattttggcatttttactcctatcgttgatctgtttaactgaaaccattgcatgatatactactagcagacaaaactggtgaaaattcacgagaatgaactttttgtcagttaagcattagcggacagcttcagtaagcagagcaggctgccttaaggcttaaagcactatcttccacaacactttgtcctacaatcaaattccaaatttactatcacaaaaagcgaaggaactaactaaaccttactcctactagtactactgctatgactatgaaacaagattccaatccaaagaaaacacagtgctcgatcagcatgataaaagcaacgaaacctgctcatccagctgccaaaatgccaccccactgactctacgtacgtactacgtattgacgctgtaaaaaactagccgtagtacagagaagaggacccaaagtttcgtcaaaaattttattttacccggatccacattgatggtctcgtactcgatgccggccgggacaaggctgtcgttgtacctgtacgggcccttgccgttaatcagcacgccgtccggcatcccgaggtccttgccactgtccagcatcttcctcagatcctgcaacgaattccatccaaaatttcaccttctcaaaatcaaaaacctgtccaaaatgtttcatattgcggttgatttcgtgttgatttgattaccgtgtggttcttgttgtaccagtcgccgatgaagatggtgatgtcgccgtcgggcggccgaaggggacggcgatgacgtcgcggttgttgacgacgacgccgccgtagccgccggcggcgcgctgaaggccggtggaagggaagtagaagaagctgccgatctggtccttcacctggaactcgtacgtccagttccagcccgacgggatggggcagtttgtgcccagcaccccgtcctgccagcagttcttccggtgctggatcccattcctgcatacgttcgtccatatacagacccattattcacttgttccaagacgggatgggtaccgagttcgaattcgcccatagtcaacnggttctcact

SEQ ID NO: 88270 - DNA, 3866 bp, Oryza sativa
  unsure (1)..(3866): unsure at all n locations
cctcggagctcctcaagctgagagaacctagtactcggtgtggtgtccccgtgcaagttgtgtcgtanactggctagtagaccagtctaccggcgtgagacgaaaaggcccagttacgaagttcccgactgcaaatcatgctggacaaggcccatcagtttcgtacgagtatttaacagtagtaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaacaaaaatgaactaatatctgggctgaactgtaccgtgcgaaaccggtgctgtaggtcgcactgctccgaagctaggggcgcttgaaggcaaacgaggtcctgcgaggatggaacatcaagttacgacggggtgatgttttcgtagaaaaacagaaacaaaacttaagaaacctctgggctgagcagtaccgtgcgaaacaggtgccgtaggtcgaggtcctgctccgacggtaggcgcgcgaggccgtggttgtaccggaccagctggaggtatgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtacgagccaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaaaagaggtaaattatatggctcgatgaagtaatccgcctaaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcccaaggacgaaagtcctagcggtgctctcgcagcgatggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaagaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcagcatagggcagccagcgatgatcgctcccgcgtcagtcttcgtgcacgcctcacaaagggcacggtacgtggctgctagcacggcagaaccccagctccactgcggcacgtcctgtggctgagcatccgcgatggaccgtgcgtagtggaccagccgaaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactcatccggtcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcaatgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcataccaaggaacgtgacgggggtcgacacgcaaccactcgcgccacgtgcgtggacggaaggtgccgagctgtgcaccctcgactgctgacaggaacgagcggtggttcctgtcaatcccacggttcaacagcgccggtgtgtcgtacgccatacttgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaacattgaattgaaattacacgatagaagtatttagtccgaacactcattacatcacaacaacattttatttcctaaatcgaaagcattgtgacactatggaatcgcctgctgcgcgacgacgacttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatatataacacgcctgctcctatcaacacacattatttcataccgatgcacttgtgtgccttgagcaacaactcgatgtctccgtgcctttttgattttatcttccatgtactttgtcactacgttgccaaacactatgttgttatcggccatggacggaccaattttcttgtatcgatccctaaagtacgcttgcgtgccgggaaggatgaattcaacaatagcaaccaatggaagtacccccgaaactttccccttccgggcccaatttttttttaacccccccccccccaaaa

SEQ ID NO: 88271 - DNA, 2852 bp, Oryza sativa
ttttgacttataacaaacgttttggaacttataaaatgaaactgaagtagggttagagcttatttggtaggacgtcaacttctaaatttaactttttaggagcggagtttggagtagagctgtggagcagtcagaaccccactctatcccagtagcctgtaggttatttatgtcagatcattccagcccactccactttattttcgatggagctgaaaccgttaggtgatactccaaccctaggagaggtttctcggggaacatatcagtccattttcatcctgctgtgacagatatgtacaactaatcaacttgcccctatcaacttttgtgaaccaatggcctcatgttgtgaagcgaaatatttctgaacgttaattgtgggctagtggtgacacatctttcatttcggcaacaacacggttgatttgtgcttctgaattgcaaatggtgacatgctgcagttgagaatttaaaagatggttcatttaaacagggcgaagagtggtactgatgtgacgtatgcgatgatatacagggggtgtttgaatccagggactaaactttagtctctgttatattggatgaatttggagtattaaacatagactacttataaaactaattatataaatgagagctaattcgcgtgacaaatttttcaagcctaattaatccataattagcgcatgtttactgtagcatcacataggctaattatggattaattaggctcaatagattcgtctcgtgaattagtccagggatatagaatgggttttattaatagtctatgtttaatatttataattagtgtccaaacatctgatgtgatagggactaaaactttttagtcccatccaaacaaggtcataagggggtgtttagttttggcgtgtcacatcaggtattatatagggtgtcgcatgggatattcgggcactaataaaaaaactaattacataatccgtcaataaaccgagagacgaatttattaagcttaattaatctgtcattagcaaatgtttactgtagaatcacattgttaaatcatggagcaattaagcttaaaagatccgtctgtaaattagtcgcaatctgtgcaattagttattttttagcctatatttaatacttcatgcaggtgtttaaacgttcaatgtgacagggtgaaaaattttggggtgggatctaaacagggcctaaatattcttggataggatgaatgccagagtaagcgtaaagaaactacttcctcttctgtgctaaaatgtaagtacttttaagattggcacagatattaagaaagtaggtaggaatgattagaggaagtgtgtgattggttgagaagagaaaatagatgaaaggaaatagttatgattggttgagagaatgaggtagataaagaaatagctttattttaggacaaaatactgtgttagaaataggtgttgacccaactggggaacaacacaattatatcttgtctcaaatgatgcatgatcttgctttacaagtctcgggtgaagattgtaagggcatgtttagatctatttggaatggtaaatggtaaatgacaaaagttttggtggcaaaagttttagcattgcaaaagtattagtcggtgtttagatgcatcataaacttttgccattctagcactttttggtggagagagagagagtggtcccaaagtactttttggcacaatttgctactatggactagcaaatggcaaatggcaaattgtcaacttttgctattagtgtttagatcccaaatggcaaaacttttgctattttggaggatctaaacatgacctagatgttatatcatggggaagggagtacctttcaatcatgaacagaagatccggcatttaacagtcgatctcaacaagcaagccaatcataacatgtttgatgtgattcgggaaggcaaatatttgcgcacatttatagttgtgggcagctctgaaaattgtgtgccaagaatccttaatgactttggagataaatttccaagattactcactttagatttgagtaattctggtatatctgagctgcctagattgataggaaaactgaaacatcttcggtgcctccagttgcaaaacaccaagatcagacaatttcctaaatcaatctgtaatctctaccttctacaaacaccgggccttagaaactgctatgatcttgaagagttgccacgtaaaataaaaaatcttcgcaagctaaggcatattgatttggtgatgacctgtaatccctgccgcaatgactgcagcttgaagtgtatacccaaggacataggacttttgttttgactgatcttcaaactctttcaagctagatttgccataagcaagaggagcgctcttagcatccacacttgcaaaaaaggtattggggagttggctaacttgaacaatctcaatggtgaacttcttatttcaggtctggaacatgttaatgatatggaagaagctgtgcatgcgcatttggcttcaaagaagttcctcgaaaaggtagggttttcatggaacggcagcaatgaacaagctgaacaaattatggagcacctaaaaccaccaaccacaatcaggtggcttggttctccagactacaagaagctaatcactttggacgagggtttgaaatttcggttcaaaatttctaaaatttctgaaatttcagtaatttcgctccccaccggcatgctcaaatctcatccgaaattttcggttttttgcatttttttgtgaatttggccaaattttattaaattcattcaaattcagtcaaaatttaaaataattttcgcccgaaatttccggaattacctaaatt

SEQ ID NO: 88272 - DNA, 1433 bp, Oryza sativa
gacatgtggatcaccatacttgggcttctcgatggaaaatctctggtggcgaacaagcttctcaatgaaatcctcctcaccagggcgactgggaagctcagcatattctgaagcagaggctagaatctccaggagccctttcatcttagtcttttgagttagcattgaactgaacctctcaatagttgtgtagctaatgtagtagtacgaagcaatcagaccaaggttgaggggcttcaggtacatatcctcctctatagccacacacttgcttgattctaggtcattcaatacagtctcaaccaactcagataaatggtccgacaaatgcctgtggctcacgccctgcagattgtagtagttagggttcttggtcagccgcctgtacatgaaggtccaagtaaggtaatccacagcatcttgcttgttttctatgacaccaaccaccacctcagcgttcatatgatcatgcaagaagtggtgaagatggctctcaacagggaaggcctcaaaaaggaacttcttgtagtattccttgcgaggcgcatgacacaatataacacatttccctgagttatcttgaagaggcctgctagcatgacccatcatttggagtagatcagtgattggataatcagtatgagcattctcccggccatcataatactgggttcccatcacaaccaccagatgggcaggcaatgatcttccccagcacacagtgctactcgcaacacacacttggatcctcccaccgagaaacagctgcgttacaacttcctgttccagatcacttaaaccttcatgcaagtagcctacaccacatttcagagtatatttaagtgtttcatcactgataccaccagtgaaagcatccatctcatcttctgaaccaagaaggaaaggtgttccaccaccctcagcactcgagtatgcacacaagtccaatgcagtcaaccttgcatgcttccgtgtaggcacaaacaccagggcaggtttaccattctttgcatgttgggtaatagcagtgtatgtcggcttcgtcattgcctgcatccttgcctcaaaatttgctatatccacaccctgaatgtgtatttctaatggcaccggccggacagctggaggaaagttgaaaaggccatgagaggtagcaccaatccattctccgagatctttagcatttgcaagtgaagctgaaagagccacaatccggatgttactgccgatatgacttgcaatacgcctcatcctagagacgatgacttccagaacatgtcccttttcagatccaatcagatgaagctcatcaacaatgaataggctgacctgttggacttgtttccgctgtttccaccggcgagagagtgcatcccacttctcaggagtactaatcataatctcccctttatccagaagcttcaagtcagctg

SEQ ID NO: 88273 - DNA, 686 bp, Oryza sativa
attcctgcagcccaggccgggaacccacacgaacctgccttaacccaaggcctacgatgattcagaccgaactggcaacccgaccctgggtcccagctcgtcccaagccaacccaggccaaccattccacattttagttgtttagcaggttttaagaatttaaaacactaacttgggtacattgctcggcttgcccataaccgagggcgcggctattcgaataggttgtactctgatcagaggtgtacatctttacccacaagacacatcttcctcacgtgtaaccacgtgccacataccaccacgatatacagacggaagacgtgacatagtttccaacccatcctagccatagacaagagtaccgacccaatcccacctacggccggaacccccgggacaggcaggtaggactgagcccctagcagcaggacaccggccctgtgccatgacatctcgactaccgggccacagctcgtgtagccttcatttgccctggagaatgtccatcgacccccgacttcatccatctccatccgtgtacttttgtttataaccagactgagccacaaactaagccttacccactagacatgtggaagtacggtagtgctttgcaacagaggcccgaagaccggttcttatatggccgaggtgctactatcaaaaccatgcaccccgagccc

SEQ ID NO: 88274 - DNA, 2070 bp, Oryza sativa
ttccaaaaataaaccaacctaaacaataatgtgacatatccacttcgagatttgtttattttgaggcgaaggaagtatgaggtagctagtcaatgcaaaagggaacaacataatcagcatgtactcccagcatgctcactgtatttcatggattttttacatatacttatttatgtatgtactctctctgtccctaaataactcaaaccctaactttccaataagcttttaaggagggaaacaaaagaccacaatgcccttaattaatgtggatgttgtattgaatgatgggtaggtgaggggtattgaagtaataaaatttctcgttttgcggataggtagtaggtaagaaggtagaaattgatttattttgggacaaatttaaactctagaagaagttgatttattttgggatcatctgcaaagacaagtctcttttgttactttctcggttccaaaatataagaagttcaatttataggttcaaattttgtatcgcaatttaaggatttccacactgattttataacttccatcatttaatgattacacagacagtcatatggttttaaagggattatctataagctgtttaaaaattgacagcttaagtgaatgaaagagaatcttttgacctaatattattatttgttaaacaactataaaatctttatattttggaacggaataagtactttaatttgttttttttacaaagacaatcggacttctacttctagttcacttactccctttaaactaataacagagttcatctattatttgtgttgggatgttaaaactaattaataacacggaagttaaactgtgtgtcgttttaattatggttgagggtttgcagacattgctaacaagtaaccgcacgccatatatatacggttgacacgccgatgtacgtatagttctacgtataatactcctacattaattggaacaaaatcgcacagtacattttcttaaaaaaatcgtcgtacatgcactaagtgagattggagagactttgagggtagaggatttaaagataaacaaattcaggggaggggatgtgtgctagttaattgcatgtatatatatatatatatgtgtgtgtttatattatgaaatatctaagaaaaatatttgtgatatgtttgatctatatattaggatcaatggagctaaggagtatcaatgagtggatttaaaccaaaatggaaagctaacagaagggaccattatatacataaacttcaattcatctctttaattagttattatatatgtgatggtaatttcgaccatgacttagcctttagttcattagtctgcatatacatagatatatatatgtccactcctactagtactagttaaaattaagaagtcgtaatacatctacgtacatgtacgtatagataagtacaatcgataagaagtacatatgtactgttttcctcctttttcaatatagatagaagagctcaagaaaagaaaatatatttaggcagcgagggggcggccattatcgtctacacagtacacgaagaagtacacgtatgtgtttgctatatgaacatatgtacggatcaataaaatcgaaaatactccgaatatatttcatgctcgcatgcatgcatgtatagtactggagtattaattaggagtagtaataacaaattaattaagtggagtaaataaagtaagtaagtaagtagatggatgtgaaagaaagaaaaggttaattactcggaggaggcagaagcgaactggtagaggcggccgcgaggggagaagacgatgagagcaacctcggcgtcgcagagcaccgacagctcgaacgccttcttcagcagcccactccggcgcttcgagaacgtcacctgcctgctcgtcgcgtcctcgatccgccgcatctcccgccgcccgcgccgccctgcagatctcacctccaccttcttccgactcgcctccgccgctacctgcaccactgtcgtcgtcgtctcctgatgctgcacccctcctccgccgcccatgcctgcagccgccgccgccatgagctacgagctcttg

SEQ ID NO: 88275 - DNA, 758 bp, Oryza sativa
tgtaaatctgggtaccctttattataacagtgtgtgcaggcaaattgacaccccatgcaagggtggctgttgagacaaggacctgtatatgcttatcggcaaaaagctcctctacaagctcacggtctacccttgccaacccagcatgatgaatagcaaacccataaggcaaaaggtctttaaggtcactgctttttactagttctgcctgactcccaagaatctcttggcttgcactatcatccttcaagaagcggtttaacgtgtcattagccaatgcagtatctctgatggcacgggcagttttcgctgtctccttcctcgagtgcacgaatataagcacttgatgctttccagcagatgccataaccttctcgtagcaaatctcattcatcagctgaaacctctgtagtggcttcctcacagtgatcccaatgtattgctgagcaagggggcaaggtctgtagctgttatcgaaatggaagaggccatcagagcgaacacgcaggaaaaccgcgacatcttcatagttcggaagagttgctgagagaccaactagacggatatgttctttggtcgtctcaatctgccggacagttctagaaacaatgctctccagaacaggccctctgttgtcatgaagtagatggatctcatcaatgattagaagctttaccatttgagtataggttctgtcacctgattttcttgtgacaatgtcccatttctcaggtgtggtgacaattatctgtgtttca

SEQ ID NO: 88276 - DNA, 559 bp, Oryza sativa
agaaataaatttaccataatcaccttcttgtcaacataattctaatcccaggatacatgctccatgacaacttactggcggataaaatcactcatccacgagctattacactgagggacctttcgaagagccagagctgcagcctgcacatcaaattaagatcaattcagatctggaggtcaggagaaaattaacagtctgtgaactgatatacatcatacacccaatctgcgacaactcaatggttggtagacataagaaacaagaaaacggcaattacctttataacaagatcgttaatagatatcttcttaccgccagatgactcttgcaacggattcagttcccctcgcaacctggattagattgaaataaagaactattttaaaaagctacaaaaccagcagtatggaattgaatcattacataggtttcctatgtaatataggattgctttaaattacaaagctaggcttcaacatacttgataagattatcaacacgggcgtcaactgtcaagtaataatgaggaatagtttgtttagagcttagcaggcgg

SEQ ID NO: 88277 - DNA, 1913 bp, Oryza sativa
acacttcatgaccatacaaccaaggctaaataaggaggaataccctccccaggaaattaacttaggactatatatacgcacggaggaatacccgtactgagctgtcaccatcagcggcccacctctcatccgcagcatataaccccaaataatgatatcccgtagtctagacaccatgcctaaactaccagatactactctaatatcagcgtcatgacatagagtaattgcataagcaaacactatacacgtaccaaagtatctcccagataagctagcagtataattagcataagatgaacatattgtaaagttggcattcatatagtcgggaagtattccaataccataaatgtataaagaagaatattctaaataaagtacaaagcttacaaaagaggaaaggaaagctcctagagccatacccgaactcttccaaaggcttccagactgcgatttctactctattcctattccactagcttaagactactaaactaacttgagaaaatatgagagagttcttgcttgagatgcgtgagtgaagtgtggatgagagctccttttatagcctcccaatgacggttgtggcagttggaaaggtcggtaatacccaccaaccgtcattggggagccatcttagccgtccaagagaaacctggatcgaacggcgctgcgggggttcggccgaaccatgtgtcgggccggcctggcccaaaatcggcaggtggcctcctccgttgctctcctatgcagacttgtgaactttggcccaattggtcatgtgaattctgagttctttgcccattcatacataagtctgattctcgacatcgtccaattgatttattgtctgatttgatgtcgattctccttcactttatggttattctctacaaaaggttagtgaaccaaatactagtggaattttattattctaatatggatatgcattgcaagcatgactagttctcctctattttggtaatattaacagacgaaactgatcgctaacgaccgtcaacactgggcttgccagcgtggcggtgacgctagtggtggtggcggcgcggcacagcggcggctatggcggcggtggtgcgcggccggaggacaccagtgagcggcggcgatgcgtgcggtgtagaaaggacgggagagctagcaaggacccaaaacaaggtattttgcaagtagatgatggtgctagtgttgccacttggaagtttgatcctgaattgcttaagactgccttttgtataatggtcatagaagatgagcttccttttatggctgttgagaagtctggttttaggaagtttatggctgttgcttgcccacagttcaacttaccatctagaagaacatgaactagggaggttgtcaaaatatattatgagcagaaagcaaaattgaaaatatttctcaaacataattgccaaagagttagcctcacaactgattgctggacatcacagcagcaagaaagttacatgattgtcacagcccatttcattgataatgattggaacttacataagaagataattgccgttttcaaggtcaaaagtcataagggggaagaaattgggaaacacttgcaaaaggtgttgttggattgggagttagacaaagtaatgacagtcactgttgacaatgctagtgcaaatgatgttgctgttagttatttgagaaaacaaatgaacaatttgaatactagcattgcacaaggaaagtacctacacatgagatgtgctgcacatattgtgaatttgattgtttctgatggtttgaaagtggtggacatttctatcaagcgtgttcgtgctgctgttaaattcataaaaaatggtacggcaaggttgggtgaaattcaaggagtgcaaaaattggaaaaggtggacagcaaggct

SEQ ID NO: 88278 - DNA, 10635 bp, Oryza sativa
cacctctgatcagagtaaaactattcgaatagccgtgcccgcggttatgggcggtcaaccagattcaccgtgattagtctcaccctagcttatttgaatggaattgattagttcaagtggatggttggcctgttgcaacgtggtgtagcgttcaacagtggatggttaatattgattaattacttattactacaactgttttactgctttcaactactgtttataaatgctcgctttatgcaaatgaaccgctctagctatcctttggttatatcctgcatcataccccctgttccggtatgacttgctgagtacagtgggtagtactcagtcttgctctattttccccaaaaccccagagtttgagtatgcatcagatggtggcttttgcgaggagtaggcttcgtccgtgccgtcgaggatgcctgtggagtggtgttcccgttgcagtccaagtcaatgcttagcttcagttatctttttttttccgctgcatttatgtaagacttttataatgtttgtaagacatggatttgtatgtcaactttgtcgtttgtgtaccccggccggtcctggacgggggttttaatgcacattctgcttggaattctattcgggaatttctgggcgtgacacaagatcatctcctagggagcgatttggtcattcaccaagacggctgggatcgcctacctataatcatcctcaagccatgtcatggggatcttatccaatgccgccatcgggttatctttttccttactacatgccgtggggggcagcaccgccaatgttcaatcatatgcctccaatgcaatttaatcaaggatggggaggaccaaggaggccaacacgtgagtgtttgtcttcaccaaacaatggccggttttatgctaaaaatcgggtcaatgaaggaaggagggaaggaaagcgcatcaaggtggagactaggacttcggaggtgattactatcaaagtggggtctcatgatgagccaataccctctagagatgaagttggagagtcttcaagcaacaaatccgaagccaggactagctcgtcgcagtcggccggtctgaccaaccctcctggccggtctgaccgcggccctacggccggtctgaccaggccaacaggccggtctgaccaccggtctcaggccggtcggaccggggcctccgtccggtctgaccgttggtctccgtccagtctaaccgggctccagtgccggtttgatagttgatttgcaaagggtagctcgggggcttcgtcgtcttcaaataaaatcaacaggggacattatttacctcctggaatagagccaaaacaaagatggatgcctaaggattagacggctacccaaaagaggaggttgcaatgtctgcgggcccaagaattaaaagagaaaggggctgaagaacggagagataggagattcaatgagttgcgaccgccacctacaaagatgtggaggcgtaagtccatagaagttgaagaatcggttgttgtgcaaagggaaaaggaagaacaatcggttgctaaagatgaaacatctccaaaagaagacatggatatcaacatggtatgtatgttgcctatggagctttgtgctatggatgaagccgaggttgctcaactttcattaggtcctaaagatgcggtttttgaaaagcccgatcaatcaaaccgtcatatgaagcctctttatctcaaaggtcatattgatgggaagccagtctctaggatgttggtggatggaggtgccaccgtgaatttgatgtcatactcgttgttcaagaacttggggcgtggagatgatgagttgaagaagactaacatgattcttaatggcttcaatggtgaaccaacggaagcgaagggtatcttttcggtggagcttaccatgggaaacaagacgttgccaaccgctttcttcatcgtcaatgtgcaaggtaattataatgttattttgggtcgttgttggatccatgccaattgttgtgtgccttctaccttgcatcaatgtttaattcaatgggacggcaatgatattgaaattgtttaagcggatacatcggccgaggttgcaatggccgatgcaacatttgagtggcgtcatgggaatattcagtgcttatcggggatggatctttctagttatgatttcattagtatttccaatggaaaatttgtacctatctctgtaaagccggctagcttagcacggctaggccatatcactttgtacaatgagtaaagaagctaatttggagtggtcgcaaaagagggtgcaagaatatcggtctacaaagaacgatattggtgaaactattgaagattttgatgaagtagaaaagcttggtcaagggttgtcacgcccggaaattcactagtaatttccgaactaatttgtgcattaaatcctcgtccaggaatcagccgaggtacacaaactgacaatttaatatacatattcatcaatataataacgttacatacttacaaaagaaaaggaaactgcagcggaattacggtctagcgaagcaccggctccactcccacaggcagctcaactggggtataagccaaacgtcttctccttcgcaacttgtcttcaactgaggtttgattgattattgcaaggtgagcatatgatatattcagcaagccacacagcaaatatacaagtgcacaaggatatcaaagaatggtataatatagggctcatttgcaaaagcagcatttagcaaacaattgaggattgtaaaactgtaaagcaattaatcatcaatattaatcaacactgaacagcacacccatgctgcacaggcccaaccatcctgaataaccatacccagctgcacagatctatctccaaactagaaatataccattccaaaccaggagctaaattaattaccatcaattaccacattattattaatgagtagtgtgggactaatcacgaaagacattgttcgacccgcctatgaccgcgggcacggctattcgaatagttttactctggccaaaggtgtaccactgtacccacaagacacaacccaccagcatgttaccgtgcccggccagacatgtcaccatgttgagtgattgtgacaagacccctcgcatgactcaacccaaagcagtgcaccgttcctggatcgtagtcaccccctcaaaaaccaaaggcatggactccccagcgacccccgtgggcttatctccgccacttctcagtctggtgctccgcaatgagccttgttatgcaaactgtccagccgttgcccattctggcttgtggttggcacggttaatgtttcacaaccgaaactcgtgaaccagtccttaattgtcatgagcactaccatcaaaaccatgtgctcacaacccaccattatcaagttttagttggcacattaattaataaaccaatcacgattgaccatcgtgagctatcattaaatatccataattaagtaatagtgaaacattagttatcccaattgtgtgctaatgtttctaagcatggctaagcaattatgtctaacctctagctgaaccaatatataaagctcaactagtcaaattataataacccaaggtatcaaggaatagagtaatcaatgcaaactggctctaacaaaggaataagttcacaccacccggtgacattcgaaaataaatgcacaattgaaataaatagagaatttaaatataggatcaacatgttcaaaggaattgtgtttgggatctgtgtgacttgccttgtaataacgggtcttcaattaatcttcttaaacacttccagcacactcgcgaaccttcgaaacgacggaaacgacaagctaacacgcaaaacgaggaaaaagactaataaaacccaaataaacagtacataaaagtaaacaaacatgtagatcatgattttagatgaatttagagacttaaacggcctcattccgatttcatatgaattaattatgatttttacaagatgtaattccaattaaacctattaaagaaaagactattccaaattaattaaaccaattacagatgatttataactgagataaaagattaaagcaacctccgaaaaagattagatcatatttggtagatgatatatattaaaaaggaataatatgccattgaaaagaggaggggatttatatcgattttgggcggctgagattaatctcgactgagtcgaccaagatcggatggcttgaattgatctggcaagcgagccttacaagataccaactcaacgagtcaattcgaaaccagcgaacgaaaccggcggctctgaacggctctaaactaaaggacgactccacacggacgaacgaacgaagcacggggaacacctcgttcgaacgaacgagcgaacgactcaacaaaggttgcggctaaaccggtgggctaaacacgattcacggtaaagccccggtacggcaaacgataggccggtaggaacctagggttgcacctacggctagacaactcgactactgagcaacgggctaaagcggcggctaggtttaagtggcacacagctgcgacacggcggcactaaggcgacttggctcggctaggtggcggctcggcggaggcacgcggctagggttaggatgacggcacagcgatgactactcgacgacaaaaacgagagattaaaaactaaaccgagggaacacggatagaagtttcaccgaaccaaagcgatcggagaggaagggtcgacgatgacggtccggcggcaacacacaaagacgacgacgatgctagacaaacaacggattagattgaatttgatctagggtttaggtagacgtggcaatgataagacatccaagcgagatcaccggataacggacaggggaacgacgatcaccggcgaactacggagcgacgataaaagggaggataccgggagaaagagcgcaaggcgacggtccttaccaacacttatgcaacgacagaccgcgacggaagatggccagcgacaagcttcgaaaggcgacgaggtactgtccacggcggcgacgactttccggcgatgagtggcaacaacggaagggtggctgggcttcacttcgcagctgcgaacccaatggagtcaacggcgaccgaaagcggcggctaaggcgggtgcttgctgcggctggaggcacagcgacgacggcggcgctccggttcacgatgacgggctaccttcggtgggatttggcgcaaaagaaccaatggccggggtagagctcgactttgcggagccgagggaggcgacggcgcaggtcggggacgaccgaggagacggcgcgacgtggctggagcggcggccggcataggagagagaaagcgagctcggggaggggcggctagggcacttcgaaggacgggacttgaggggataggtagaggacgacgagggggtcctttatataggcacgcgagctcgggtccgggcccaaatcgacgggaaaaaactcgggaaagtctagggttctcgccggagtaaggaaagattgaaccgcgaaattggaaaggatttccatagaaacttttggggatttcttgggaaaattgtagaggagattgagaggattccattctcgcaactaatttggaaagaggagcaacgaggaggttggatttgggaaggagatcggcgcggctgcacaggctcggctctgtctcgaggtgtctggaggaggaagatgatactgtagcgacaggaaattagacttttggctgggctattacacaacccgacagaaggagagagaaggggagggaatgggctgaattcggcccaatactaggaaggatgattttattgcttttccaaataaattaaccaatgagatgatctttcaattgttaaaaatacttccaatgctcaaataattccaataaaaatattgaacatacttggacactcaaagtatttaatataataatatccaaataatttaatgattaatttattatttaaataattactgaaatgttctttgtattattaaaattaataattgagctctgaaaaattcgagaacattccagagagtataattaatcatggagaatttaataaaaattaaatccaaccatgctttaaatttaggaaattttatttcccacatttaacttcacttgtaaattaatgaacatttaatataaattctattaataatttattaaataatttataaatcctaaaatgaaaatcaggctgtgacaagggtttacatcggccgatccattggaggaagtagacataggtgatggaactaagccaaaggcaacttttgtaaacaaaaatattaaagccgattataagattaaaataatcgagctacttaaggagtatgttgattgctttgcatgggagtatcatgagatgtcgggtcttagccgtgatcttgttgagcattggcttccaatcaaaccgggttttaggccttataaacaaccacctcgtcgtttcaatcctttgttatatgaccgggtcaaggaggaaattgatcggttattgaaagcggggtttattaggccatatcattatacggagtggatatctagtatagtcccagtggagaagaaggggagtggtaagattagagtttgcatagattttagagatttaaataaagctacttcaaaagttgaatatcctatgcctatagccgacatgatgattaatgatgcctcgagtcataaggtgattagcttcttggatggtgttaacagtgaaatttggtaagcccggagtagtcatcggcttagagtcagcatcggcttcgaagtcctgagattagccgatgagagttgtcaaatcgtcagttgtcggattcttgctatattcggttaaggaaattgatctactaaaggaagcttatccaaaagagaccgagttcaaagagaatgcggcatggcaagttatctattaattaggaatagtttgttagtttccttttatctttaggaaagtgtgttatcttttccttttatctttaggaaggtttctttcttgtccgacaaggacttgtatcaacccatgggtataattatgtacacccggggtctatgtaatctatcttcacgatcaatacaattcggcgcatcgccaccttttaccctttctactttatttttatcgtccggcgggacttggcacctgacgcggggctgcatcggtgtttgatctccggctaaggggtaagtccaatgttccgccggcccgggcaattgtatcgtttacgtcggagtcgttcaaggctacatcagtacattcgacctcttggattgctctggtttggatgatatatttgcctacctatttatcatatgtctctattaatctagtcttagcatatcaatttagctctatcggctgcttctcgttttagggtttctgccggtatcggctaaatcgtgttgctagattagattagcttagacatctaccaccctgaaaactcaatcaacagcttgattgtctagatattatgtttcttttcatacttagtgctgcatcagttaagtttgatctactaagtcgtgcttagaaccataatctctagcctgcttcttgattgccaataagggtttcatcggggtttcagtcggtgagttatctggacgttgcatcggctcataaggattgcatatacatataagttggatttagccgatgacaacaaaggtttcactgtttaatctaatattgtggatttcatgacatcggacctccagccaatgtgtgctgtaaccttcggatagatgcttaattatcatatcattagccgattggtttatactggattatattgttattttattacatcatcatcagccaattgcctttatatcatcatctacattggacatatagccgattgcttaaaccatattgctatcggctggtatcggcatcggctattatcggctatcggctggaactagtccatcggcttgtcagccgatcgactgtttaatctactatttgcatatcttgtcagttgcaggatcaaactgattggcacgcctacatctcatcaagatttggacctgcacaggagctaagcagatctcccaggccgatgtgttcaattttttcgtcaacagatggtaatgccggctacaatcaaatctttatggcagaggaggatatgtacaagacggcttttaggtgcccaggatttgtttgtttatttgagtgggtggttatgactttcggattgaagaacgccggtgcaacatatcaaagggcaatgaatttgatcttccatgatttgctaggtattatcttagaaatctatattgataatattgttgtcaaatcggatgacatagagggacatatagccaatttgaggttagcttttgagaggatgcgtccgtatgtattgaagatgaacccactcaagtgtgcttttggtgtatcggcggcgaagtttttaggattcatagtgcatgagagaggagttgagattgatcctaagaagatagaaaagattcgtgatttcaaagcaccgacatgcaagaaagaagttcaaaagttgctaggtaaggtgaattatttgagcagatttatatctaacctagtgggtaaaatcgatgcttttgtccctataattcgtttgaaaagagaagccgattttacttggggggcaaaacaacaagaggcgtttgaaggattgaagaagtatttatctactccacccttgatgcgagcgcctaaagccggaatgccgtttcggttatatattgccgccgaagacaaagtcattggtgccgttttgacgcaagagaaagatggcaaggaatatatcattacatatttgagccgccatctttcggatgccgaaacgaggtatgtctttatagagagactttgtttatgtctatactatccttgtaccaaattgcggcattatttgttatctagtgcatgcatagttgcttgtcaagccgatgttattaaacacattgttgcaaaggccaattttaagtgggagaattggcaagtaggcatatgctttgattgaatatgatttggcttatgaaccattgaatctatgaaaggccaaattgtagttgattttatagtagaccatcatgtagatattgcttatgaggaagaggtttgcttgattgaagttataccatggaagatttattttgatggtttttcttgtaaagaaggtcaaggtataggtgtagttttgttttcatctagtggcatgtgttatgaggcatcggttcgtttggaatattattgtacaaataatcaagccgaatacaatgctttattattcggcttacaagtgatggagatgattggagctaaacacgtggaagcatttggtgattcggaattggtggtgcaacaagttatcggagcttacaaatgtttggacgggtcactaaatacgtatcttgatcaatgcttgaatattattgctaattttgataattttgctattagacaaatgacttagcacaacaagcatctggctataatgttaagaggggagtatttctgatattagaacagccagtgcttgattttaaacctttgagtgaaattagcaaaatcgtagaccaggggtggtcggaccgacgttgcacggccagtctgaccggtgactaggggcggtctgactggccgtataccgtcggtctgaccggccaccccgagcggtctgactggccttgcatggccggtctgaccggttttgggcagagagctggggggcacgttataattgattcaaaggccaaattaattgtaaattcggacatttgtgtccaggagacagaagaagattggagaattcctttgattagatatttgaaagatcctacgcttaaggttgattgaaagattcggcggcaagcgttcaaatgtacattgcttgatggggatttatatcgccgaaacatagatgaagtgttattgaagtgcttagatgatgatcaatctaaagttgctatgggaaaggtacatgaaggaatttgtggaactcatcaatcggcccataagatgaattggttgcttaggagagaagggttctattggccgaggatgatcgaagattgtttcaaatattatagaagatgtgaagcttgtcaacggcttggcaatgttcaattggcgcctgccgccatactgaatcctatcatcaaaccatggccgttccgaggttgggctttgaatttcattggtcaaatttatccttcgtcatcaaaggggcataggttcatgctagttgctacggattacttcaccaagtgggccgaagccgtgccgctcaagaatatgactcatacggaggtaattgactttattttgaagcatattgtccatagattcggtatcccgcaaacattgactacgaatcaaggagcttcttttatgtctaaggaagtgaagagttttgttgaatcttatggtattaaattgttgagttcttctccttacaacgctcaggctaatggacaagcagagtcgagtaataagacgttgttgaagctagtcaaaaagaagattgaggaacacccaaagaagtggcatgaagtgctttctgaagcattgtgggcgcataggatatccaaacatgg

SEQ ID NO: 88279 - DNA, 7569 bp, Oryza sativa
ccccactgttggccttttcgatggcaattttcgacagaacttggaagaaactggaatgggctacaggtgtgattaatcatgtttggattagtaaaatatattatcatcctggcttgaagttctgatataattcattgtttagttaattttctaggaaagatccaaattagctgcccatgagatcattaatccttgttctttagcatacacagcaattttctcaatggcttagcactgaattttccctcccacatctggggagaatttgcgttggattgtgtttaacctttttcatcatatgacagcttggaagtggagatgatctcaagagctcacagcatgggttttttgacgactccatatgctttcaatcctgaagaagctgctgccatggccaaggctggagctcatataatagtggcacatatgggtctaacaacagctgggtctattggggcaaagactgctgtcactttagatgacagtgtcaaacgtgttcaagccattgctgatgcagcacttgggattaatcctgacattattgttctgtgtcatggaggtacactttctatttttgataagtcgatggtcacttctcttttgcaatataggattggtctcattctagtacttgaatatggatatacccctatccacattcgtagtatccccacactaggttgttatattttatgacggaggtagtagctatcaacttatcattggatattttcatcaggtcccatatcagggccgcaggaggcagagtttatcctaaagcgcactaacagggtccatggattctatggtgcatcaagcatggagcggctaccagttgagcaagctatcacaaacaccatgagggagtataaacggatttccataaaataagaatgatagttcagacttcaaatatgtcctttgctctacatggtactgatcttcatactgattcaaagaacaataatggaagaggaagccaggtgtttgtgcattgttgtaccatatgcggcacatgtactcgtgtatttcagtcggaataaagaatgataagcgaatgatttcgtgcttacttaataactatccatactaagacgataagttactgtaaccatgacaaaatctgtgataaagaccgaaattttacggaccaaatggaagttcggacttagacgataagcgaatctgtgatttagattttggccaaaatttaataggctcgactttttgacgtgatcttgtcttcttgcggccccatcatttggcttcttccctaataaatgaataaaaataaatttgtaggtaaaattcttatatatgtgtccttgatgaattaaaagtcaatgctgaaaaaaaaactacgttgaaaatatctcaaaatcaatcttaaaattaattttaaaaatttaaattttggttttttttagggctgattaggccatcggatgggagccttagttttagcatttgagttagatgtgggtgggcactgaagtaggagtaggcagcaaacatttggggaactgctattctgcaccgagctgatgaggcacgaacatcggaagctaggccgacggcccgtaggtcggcctcggagtccacacggtcccttccgactgcgatgggtagcgctgcagtggctactgatggtggcccgtgcgaggaggagcctgcccaggtcgccctcacccgaaaaaggagcgggttagggccttaggggggacgaacaaggtcgacgtcttgggtttctcctgcggcaaccgcactgtccttgtcgatcgcccctccttgcataccctagtgacattccaccgcatccacacctgcttcgacgcgtcagtaccatcgcacttgatacctccatgcgcttgcggtgcccaacacacattgttcggctgtgggtggcgtggataggccaagccgccgtcctcctcatcgcccaccgccgaccttatcctcactgctcgccaccctggtgagataggaactgaggggagagagataggtgaggatagataagggtcactaacacgtgagactcacgctaactcaacgttgttaactatagtcaactaaccacgtcggataaaaccagccgctatactacccaaggatctaattcggttttgtgagttgagatgggctatacctggtattgcggttcaggaacgaatttcaaactccacagcaaattgaggtagctaaagtgaccttattccttagggttaattggatccataccactgcaactttgcgaaattaaaaaaaaatgccactgattcactgtgtttcttcgaatggatcgatgggttgcttcattggaccaaagcaagcacatataggtagaaaacagtaaacgggctattgagcccatacccaacccaataaggagaagcagatctgcagatgtgcacgctcgcgaggctggtgagagagatgtcgacaagtgtgacgtccacagtcagaaatttgagtgaaataaaaaaaaaatcagttgagtgacacattgatccccagtctacatgtacctgctgaaatcaatgttgtagcttgtcactagaacattttggtaccgaaatttagtacatggattttttacatgaaaattcgatacatgttacatttccgtcattccgtggctagaataaaaatgcactctctccgtccacaaatatatgaacatctatttagatgtatggaagagtttgtctgatgttcggtcaatgatctatgcgtgctgcgtatatatactatttatatctttaaagttataatccacaacattctaaaacttaacaagtaaagatgcacatcatcatccattagtaattattatatcttaatcctcattcaaacatactatgtcatctatattttattatattctaaatcttaaaaatacgagcatgttaaatcatcattgcatataattccaataatattttaacatatatcttcatcattttctacaatatcctatatacttcatccccacttagttaatgttttctatctctcattaaatcacatcacctcaattgtttctagccgttagttgattaatatatagttcaaattatttccctcattttttttctcatgaagtcacatcaccttacttttttacttttggattatcaatctatatactatttaaattatcacaaaccacatcaacttaagtggtttatagtttttttctccaatgatcattaaaaaaatacaacttttataatcttaatgttagctacataacaagatttcaccgaagtatcaagaacaacgcaagaacatgagaagttccaccaatccgacaggattggggtcgccgtcgccttcgccaccttaatcattgatattgaatattcaaagtttacagtatacctcaacgcacttctctctctctcacgcaataccagtctgacctagaacggtgctcattcggcccattccggcccatacatcatgggattagcaacctggttcgagcaggctagcccgttcctccagacgaggcttctgctttactttgtagttcatccggcactgtcaggttgctgataactgttgatattgcttaatgtcatcactagaaacataattcccagcaataaagccgaaatattctcgttacatctcacggtcacagatataatccacaagcgcacggatataccattgtagcatttcactcggacgtatgccaaggtgtcgtatttataaaatcccaagggaagatatgataagagagtactatactaataatttacatcacttgtatagatcaaaatctatgcaggggttaacaatattcaagggtagaataagttgacacacataaggaattaaccacaatactctcattaaaatataatctagattaagtggagaaaaaaaataagaaaagaatcattttttgtacttctaatatatagtcattttaatatacacttgctagtatacaatcatgcagccaatacccattaactacaccctctggtgtatcgcgagaccacccctggttgtcgagttccttacgacaacccgtcatgaccatccaaccggtaatgaatacggaggagtacccacaccaagaaattgtcttagtattatatacgcaagtggaggaatacccatactgagctgtcaccatcagcggcccacctttacaaacccgcggcatataacatcatttaatggtacctaataatctaagcaccgcgcttacattactaaatactactccacatcgctgcagctgacatagagcaatcatggtaatgaacattaaacccacaccattgcatatctctggtaagctagctacataattatatcgagacaagtacaaactaaagtcggccctcgaataattatataaatgaagtaaaggaccgaaactaaataaagaagaatatttcattaatgaattaagtcttaaaaaagaagaaaaagctactagagccatacccgaaatatcctgaagacttaaaaaactaaagaaaatattctattcctactccactagtgctagaacaatataagtaaactagagtgcactttggaatggagggagtgaggtccttaaatatgttgccaatgacggttatggcggttggaaatgtcaaaaatgccccacaaccgtcattggggagtgatcaggagcgtctacgtgaaaggccaggatgagagaccgcagagagggtttggccgaaccaacctgggttggcccttctggcctgttgcttcctcctgtgcatcctctcacgacttcttagccagtggttgggcccttttacagtggtttaattgagtttataggcccatccaaccataagtctgccacttgacggacgttgagtgattgttcggttattttccatcgattctcctccatttatgcgaagatctctatattcaaataaaattccaagtacaagtggagatagattatttctaataaaatatgcattgcaagtattgctagttctcctttattttggatatattgactgtcgaaattggtctataacgaccttcaacaacagcccccactccttgagctttggcttgcccccaagccaaatgcatttggaaaacattgacgcaaatccacatcatcctcccatgtctcctgcccagcaatgtctctggaccaaagtacaaaacttgattaactagagatgtacctttcctgacttgacgggtatccaagatagccattggaattttcagatgaggtgagatggaagctgaggctgtattgcttggttgaatccagtgatatatttgagttgagaaacatgaatactggatgtatggcactgtcagctagaagttgcaagcgataagctgccttgctcaccttagccacaatctggaatggcccaaaataacaaaaagacaacttgtgattaatgaacatagggctgcaacttcaaataaacccaatcaccttcaacaaattctcttaaacttcccttcttgtcagcataggccttcatctgctgttgagctctattgaggtgctggtgcagtaagctaaccataagttttctctcctttaaccactcatcaagattagggatggaacaagcatcctctccgatgccaaagtggctgagtgggtaaccatacaaacacttcaaaaggagtcttcactcaggcataatgataagaatgttaaaccaaaactcagccaaatacatccaataaccccacttggcaagcatgggatcaacattacatcacacatgatttgtacacactgattcactctttcagtttgacctagaaaacaattggtccctgagttggcttgtaaaattttatccctattagatatgatgcaagcaggaaggccatgtaacttataaacattgcacatgaaagagttggcaacatcaccagtagagaatggatgagatagaggaataataaaatgggaatacatggaaaaagttatcaaccaccaccaaaatgcaattgaacttgccatatttgggtaaccttcaataaaatccatagtattcccttgccatgcactatcaggaacatgcaggtgttgtaacaagccaggatacttgagtctatcaggtttggcctgcaaacagatggagcaagctttgaggatagagtgtatagtttgtttcatttttgggccaaacaaacaaagccttgattctgctataagtaacatgtatgccagaatgacctcccattggactgctatgcaaagcatgaattactttgagttgtaagtcagtgttgtttcccaaccaaactcttcctttatacttaagaacaccattgcacgaggtaaaattgggtctagaatcaggtttgatgatcaatttagacaagagctttttagagaaaccatcatattgatagccatcacagacttcctagagccaaacaggagtatagcttgagatcaggttaaactctcccgaatccacattatgcttcctggacaaagcatcagcagcaacattactgaggcccttcctgtaacagattttgaactgaagacccaacaacttagtgaaagctttatgctgccaagggatatgcagcctctgctcattcaggagcattaaactgtggtggtcaatgataatgataaattccccatggggggagtaggatctccactgatcaactgctaacagaatagctaaatactccttttcatatgaaaacaatcctctggttttaatacccaaagctttgctgacataagcaatagggcgaccttcctaagaaagaacatctcctatcccaccatcactggcattagtctcaatagtgaattatttagacatatcaggtaaggctaacacagatgttttgactaaagcttgtttgagggtaacaaaagcttgattagcttcatatctacgcacaaaaggcacattcttcctcaacaattgagttaatggtttgctaatcaatccaaaaattttaacaaacttcctgtagtacccagctaacccaagaaaaccctttaacttcttgattgtcatgggaatctgccaattaaccacttcttccaccttagaaggattggtagtaaccccttgagcactaatgatgtggcccagataagatagtttgttttgggcaaaagaacatttactgagcttcaccttcatcgatgcaacgtcaataatgtcaacacttggtgaagatggttgagatgggattgaaaatcagagctataaatgagaatatcatcaaaatacacaagagcaaactttctaagaactgggacaagagtgtcattgatggcactttgaaaaatagcaggagctccagtcaaaccaaatgacataactctatattcataatgactagagtatgtttggaaagcagttttatgttcttcctcttctaccaaacaaatctggtgatatcctgccctcaaatcaagctcggaaaagaatttagctcctgataattcatccaagagctaatcgaatactggcattggaaaattttcccctttacagtaatagcattcaattgtttgttatctataccaatgtgtttagtgcaatccttctt

SEQ ID NO: 88280 - DNA, 658 bp, Oryza sativa
atatacgcaggcttcgcagtcaattgagacagataaatgtgtataccattgctatggtggggtgagggagttattttgtacttgtatgttgatgacatactaatttttgggacaaatcttgaggtgataaatgagattaaatcattcttgtctcaaagtttcgatatgaagaatttgggagtagctgatattatcctaaacattaagctaattagaggtgagaatgggattactctcttgcagtcccattatgtggagaagatgatgaggacacaactagctcggatataaccatgactaccttatgtattaataaaccaaatgtgcatatgttctatattaggtttacttgttatatatttgaacaaatgttgctacacagtgagtttcgtgtgttttcgtttgtagaagtacttgcttgggcgaaagaaccgagcgtaaggaatgcatagatgagtaacgaagttgattggggaccaaaccaagaccttctccatgtacacttccatctcacgacgtcacttttggtccatagaagataagagataaagttctacacgtttcggattcagattcgggcctcctgacagcatcaacttcaaatggacctagccgctgatctagaaggaattttggggctcatgaaaacttggtggaa

SEQ ID NO: 88281 - DNA, 726 bp, Oryza sativa
agcgaaaagaacaattgaagacaagtgatggaaaaaatatttcagcagtctaatattgtctttctattttaacctgaagtagaaatgtaagccttgaatctctgtagggaacatgccggtttttcccattcgcaacatccaccagtgtcattataacaagcctgaaatggtacagcaactcatgcttcttacactacaatattttcattatacaaaagcattcattcctagcactcaaatatatgtacatcctggtatagtaaagaacattacagtacaggctagtagacataataaacttccatgaagccaattgcacttcactttgaataaggaaaccaatagaacacatattcatggtttttttttcacttagccataaatgtagcaggcttcataaaatggaaaacataacaaaagttatccactttaacatggacaaagtgagctatttggtggtctcattttaaacaccatcttcatgggtgttctagtatgagactctagtcagacttgctaaatgatagtgttttgaaaactgacatgggtgttctagtatgagaatctagttagacttgctaaatgatagcattttgaaaactgattggtatgcaaacacggttaatttccttcaatatgtataaaaaaggattgctccaaaacgtccagcaaatggaatgttgtgtcttgcgttttcgagaaaaaaaatggagtgctgtttgagag

SEQ ID NO: 88282 - DNA, 2238 bp, Oryza sativa
  unsure (1)..(2238): unsure at all n locations
gtacggcaaaaagctggccaccacggtgtacgagaaggtcgccggcgtcgggacggccgtggccggcaaggtgcggcaggtgacgcagtcggccggcaccgccacaccaggcgtcgccggcggcgccgccggctcacagtcgcaggacgacgtngacgcctccaccaccctcgcctccggcgagccggcgaccggggggcagcagcagcaggacaagggggtaacagtcaccggctacatcgccgacaagctccgcccgggcgacgaggaccgcgcgctcagcgaggccatctccggcgcggtgcagcggcgcaaggacgacgtggcgcagcgcgttccggccgtggcgccggcggcgccgggcgacacgatcgccaaggtgcgggaggcgcccgcgcaggtgctcgccaaggcgcgcgacgccgtcacgtcgctcaccggcggcacccatgtctccgacaccgtgcagcccaccaccaccacaggtacataaacacaaacatctcaaatttcacttgccattttcgcagccggatcatgagctgatgatcgagttcgttttttttttctctttttcgtgtgatttttttttgcagaggcggatggcgcggaggtggaatcggcgccggtgattcgcggggaggagatcggcgagacccaacgtcagccgaacgtaagcatgacatgaagcgttgtagaaatggatcctctcgtgtgtgtctgtatgttgccacgtatacacgtgtaagtgtaagaaaagtgtcagtgtgcttggaataataagccgttatgtacggcttttgtgtcgatgtgcagtttttgttttttgatgtcttctgtgtgtatgtaagcaagcccgttttgaaaatggccaagttcagttgaaacttgtaatggtttgtggacttgtgatacacactgtttgtttcaactaattgctagtacaaaagtgttcaccgttttcttcctgatcactgatgaaagttcttcagaaaacacactgggaaatttccaatctttgcagctagctatttttcacctgctgagtggcgcccagaagttcattgacgttaatgtccccttttgcttctcttccgagcgattcagaccggtcatctccatgcattgtgtgtgaaagaaactgtgaacagctaatcaaaatcaaggtgcacgccgaaattgccaaatgtaacagatgactacttactccctccgtttcatgagataaatcattctagcactttccacattcatcaagttattatagcccttcttatatttatcacccctccgtttcaccgtgtaaattattttagcacttttcatatttatattgatgaatgtagaaaatgatagaatgacttacattgtgaaacgcaggaagtagcttacaagtgccatgaatatttcgaggtgcgagtgcgacaacgatatcgtgttagatcaccggacgattgagtaattgactaccaacatctccggttcttcctgctgatgcatggcctgaatatgaagcaggaatgatttggatttggacgtttggtccaaagtggcaggacgaagctagagccgtgtgcctgtatgggagtcgagacacttgggtggttgactgtctgaccccatgattttggaaacaaccttctttactgcgtctctttacaataaataatcctacaagtgaattttaacatccgatacataattccagatcgatattgaagtcctataattagtttcataaaaccatattgttaactatcttgcgagacccaatttttcctcttcttttttgggactttgagttactactatagcaaatagcacagataataaatgaaatgcttaccttgttactgtggccaaaataataataaaatgattatcttaagtggctaaggcttacaatgaattgaaagaattcataaatttaatttaactttagagcttatggtggatgaaaaaaagaattagtcgatgacgtggttttatgaaactttagaatcataataatactatgtttattgttacgtgtcaacttttatttatgtaaagagttatagtactaggctaatttatttcctcaccattttcaacttctacctttcgtttttccacgcgcatatgctttttgaactgctaaactgtgtcttttttttctttgcaaagttttaggtattccaatataggtactttaaggaggttcgctagtactcagaaacccaggaggccaggcagtga

SEQ ID NO: 88283 - DNA, 3142 bp, Oryza sativa
ccgggaacgtggtgaccgagggttatgggtgacccgattgtgggtttttgccgattccccccccggagttcaccacgcctcgggggcggctcggttctgggccccgtttggcgattttagccgacccgagcccccgagggcaggattgagcacgagtgacctatttcaagtcaagattcttcaaaaggaaaaaacagcacagatacagcctttaggaaattgaaactgcttttatagaaattcagatataagagaaataagaatatgcatatgttgtagcccccggccaaccctgcacgcccgaggggggtgcggggttggcccgagcccgaaacctgacacccgacccccgcctcaggggtagaagcgacgaaggtgttcgatgttccacgggttaggcagctcagtgccgtcgcccgtggccagccgtatggagcccggccgggggacgccgaccactcgatacggaccctcccacattggtgaaagcttgctcaatccagcacgcgtttggacgcggcgtaggacgaggtcgtcgatgcagagtgatcgggcccggacgtggcgctgatggtagcgccgcaggctctgctggtagcgcgcggctcggagggccgcgcgccgccttcgctcttccaagtagtcgaggtcatctctgcgaagctgattttgatcagcctcgcaatacatggtagcccgaggagacctcagggtgagctcggatgggagaaccgcttccgcgccgtagatgaggaagaaaggcgtttccccggttgctcggcttggtgtagttcggtttgcccagagcaccgctggcaactcctcgatccatgaatcgccgtgcttcttgagtatgttgaaggtcttggttttaaggcctttgaggatttccgcattggcgcgctccacttggccattgcttctgcggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacctgtcgatcgcgacatacagatactcaaacccgcccggggcccgcctaaacggtcccaggatatcgagtccccagacagcaaatggccacgaaagtggtatggtctgcagggcctgggccggctgatggatttgcttggcgtggaattgacacgctctacatcgccggaccaggtcgaccgcatcattaagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagttgggagcactcccctcgggtcccgaggcctggactccgacaggcctcgggggccggtcaggcgcatccgtctcccctaaggggtcgggtcgcgccgacggctgggcaagcctttcttcaaaggcgcccggtgggatctgggctcgcgaggacgcgagccgtgagagttcgtcggcaatcatgttatcccgtctaggcacatgccgaagctcaatcccgtcaaaatggcgctccatacgccgtacttggcgcacgtaggcgtccatctgcgggtcagagcaccggtactccttacagacttggttaacgaccagctgggagtcgcctaacaccaggaggcggcggatccccagtccagctgccactcttagtccggcaaggagtccctcgtattctgccatattattggtcgctcgaaagtcgaggcggaccaagtatctgaggacgtctccgctcggagaggtcaacgtgacccccgcaccggcgccctgaagagacagggagccgtcgaactgcatcacccagtgggcggtgtgaggcagctgcgaggggtccgtgctggcctcggggatcgagacgggctcgggagctggggtccactctgccacaaaatcggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaactacagtgacccgatgcgcctggaaataatggcgcagtttcctcgaggccatcagaatagcgtaaagcatcttctgggcctgagggtatcgggttttggcgtcccggagggcctcattaacaaagtagacgggccgctgcacctttcggtggggccgatcctctttgctaggggccgcatccctggggcactcttcgtccaagcagcctcgcggggcgcacttgtcttctgtgctgatgacctctgggtcggaggataacagggacggccttcccacagtggcttcggggccgtcctgggggtcgggggctcctggcgtcgtcggaaaagcgggcaaagggccaactccggtcgtcaggggccttaggcctccgttcggctcgggggcctcttctccctgctctttcccgggtcgggtcagcacagggttagcctcggggtcgaagggcgataggtgcggccttcccacagtggcctcagggccttcctggggtcgggggctcctagcaccgtctgacaagcgggcagagggccaactccggtcgtcgggggccttgggccaccgttcggctcgggagcctctcctccctgctctctcccgggccaagtcggcacagggtggggaagcgtgaaatgagagttgttctcatcgcgctccacaaccaatgccgcactaactacttgcggggtcgccgctaagtagagtaacaagggctcgtctggctccggggcgaccagaactggggagagcttagatacgccttcaactgggtgagggcattttc

SEQ ID NO: 88284 - DNA, 2777 bp, Oryza sativa
gtgctccattcacaaacttgatagatggtctcagccgtgctggcaacctacaagcttgcaagtatttcttctatgagatggtcaagaaagggtgtcaaccagatgttgtttgctacacagttatgatcacaggttatgtggcagctggggaattcgatgaagcccagaagttcttcgatgatatgttgctgagagggcagcttccgaatgtgtacacatacaattccatgatatgcggactttgcatagtaggagaatttgataaagcatgctctctgctgaaggacatggagtcgcgaggatgcactccaaactttacagtgtatagtactctagtgagtaggttgcgaaatgctgggaaggattctgaagctaacaatatcattcagtacatgacaaataagggtcattatcttcatttattgtcaaggttcaggagatatagaagatgctgatatgtgaggccccatagtcagttacattgtaattttgttgtattgtttccaacttggaaagatggatcataagggagtactttgtgaggtaaccattcgcactctaactgttactctagcacatagggttccttatctatttattcagtacagaaatgcaacactgtatacttaaactgttttacgcactaatggaatgggataggatggggtggcctggcgtgtcctaaatcctaaccgactcatgatggaggagttcaaccctgatttactagtcctaaatagtaaacccaacattagttctgttgcaatgtagtacacaatatttgatttacttccacttctggtctcctgaaccagattacatccaatcttttgttttcaatatactttttacagtgccaagaacttatgctcaacaaaatatggggcatatcattttgctaaattacaacagaacttaggcttttgattcggttggatgcaaagcacaccgtatttctctcaattctcatttctgtcaaccctagcataggtttagcttagtggattatatgtcatagatcagataagatccatataaacattgtgcattatcttgcagcactaagagatgaaaagcctatgcaatcttgtcccttaatgatgctctttaggtcattagcatctctcgtcacagattgcttttatcattatgcatttatgtaatgtatgattaaaaattctcagtgtcttaaaaagatagcaacaaattaacacaccgttaagactgcctccagtcacaaataagtgacatttttggcagcgacaaagtctccaaacacagccacaacttctaatatctattgtgatatattatacacacggtaaaatgctatataaaatagaaatatttaagcaaaatatacacacaccattttcgcatgtccagtttaagtatttatagagatagcgattgttaagctcttaatgtttggttgcatctaccctggctgaatcaccactgtcttttactggaggggatattaaatattgttaagtcagtttcaaccttggtatctctgactctggtcatccattattttttgttggaaaaaaatatttgaattaatcaatacgataggtacaggcctgcaaagattcatcaaattagcaatgttctctaagttcttttagttgccaaattgactttggcatcataaacataaagcattaaagttgatgatattgtcatatgtgaagacaaattgctgagttacatcgtgttgatgttatagagcaattgacaggttgtaattttttttttgtaactgtaagcaatattacttacgtgtaccaatatgttctttacagtattatggtacagagtaatttcacataaaacatcgatcaaaagtccaaggtattggctgtttcacttgcagatgggagagacactatgcaatggtgttatatatttcataattttatcatttcttctcttctttcttttcctctttcttctcctccttcttctcttccttcttctcttctttcttctcctctttcttttcttccttcttctcttcttttgcaggtccaacagacacaatgtcaatcttcccaatcttctttaacttctttgcaattgccactgtgtccatttcaccgatgatggtcatcttattgtccttcaaatctgcagctatggaatcgatacctgtacatgaaatgaggtgtgtaatgcattagattttcttgttgacacagtaatagtttatcttacaaaatacttctttgaagatccaatcttgcatcattacatgttcagctgataatacatgatgtggagcatccagttcttttgtctaacctttagaaactaatgtacagttgttcaccgcaaacagcacatattaataatcccatacataggggggaaatcattccgtatgcctaactatatcatcgatcgtcatcttcattgtgttatgtgatgtaacaaacaatttccaccttacatgatatctcttatcaaacctctgcctaaaaccatgctaatgcttccaaatgtgatttgcagatgttttttgaatcagagatcaaaacatatttttcaagtttcagcagccaaagaagaaaggggatggtacagaatgttaccgtagatgtctgcaacggcttcaatggctttctgcttaatcttgtcgtcggtcatggttggaaccctcagcaccaccttctgctgagaattatcatccgacgacacgaaggcgtgaaccgccgaaggaatcagggaattgaaccataaacaagagttgcacttgcttacctgagccatct

SEQ ID NO: 88285 - DNA, 1973 bp, Oryza sativa
tctacccctacaatcttcaataaaacatgcttgtagtgtttgtaagtagtatttgtaactaaacaaacacatggggagaatacaaacttcaactgtatagtttccttggacaaagatgaccgggggactcccattggaatggcacaacacttgaaattgcagaagcaaaataaagttaatcttcagctcgctaaataactatcatttgctgctctaaacaataaagttaatcagcatgcaattcactaagatgttgaatgctaaacttggtagtttacacacgaggaaagattcacaaaagtcatgcatatctgatacatacgcaaaatcaaaccttgacagtcaatgcagcacatataaaccccctcaagtatcataactgattcagggtggaaccaaggatcaagagaaatcaatacattcttttttgcagggacattgtgatacattcaatgattcttacctctttcataaatagtcacagggatatccttctgggaaaagttgattgcaggatttaatagaagataaaggctgttccattagcatccatcaactacataaaaatagtacaagggaaaggttatgcagggagtaaaattagatcaaacaaacatccattttgacaaatattctctcaaccatatattctcagccaaaatcaatttccaccattccatccatccaacaaaacaagctagagctctacataaagtttaagaacagtgtacatcccaacataacaattattgctggctatttcatcagccgtaatcattccgcatacttgttaaactcagactctccaagaacttaaactaatgctaaaactatatcccaatgccatgttacctcatcaaaaatttcagttttcattctcacaggagtgaacattgtatcctcaaatgttaaactttgaatacaaccttattagaagcaaaatgtgtttacattgattaggttatggcaagtggttaccgaccatcaataataagagtaaactacataccggtccctaaacttgtgtcattgtgccatctgggtccccgaactcaaaaaatacagattcaagtcccaaaacttgctaaagtatgtcattttggtccaacatagccaccaccattccggcatcctacatggcgctaacgtggcatgccacacggacgctgatgtggcctcatcaatacctatacattgactgacaaataggacccacttaaaaactctcttttcctcctttttctctttctcctttcacttttttttcctttctcttctctatttctctctcttttttttgttgtacaagcggcgggggcatgcgaagtagcggcgctccggcgagcttccgactgggcacggctggctgcctaggagcatcagggcgtcaacttggagctggagcctggaggtgttctcggcttgggcggggacgcctagcggcggcgcatcgtgctgacacaatggcggccgaacaggtaggcggcaccgcggcacacgggtaccttgccggtgagctccaacagcaggacggcacggggaggagaggggaaggagggagtttggcatggagaagatgagagagacctcaatttcggataaggatcgacgatggcgacgaattccgaagtcaaagccagcggcaataaccctaagcttcggccagaacggctccgccgacggcaagcgcaacggcaaaccaacctcgccaccctcgcggcgacgacaacgccactgccgccgttcttgagcaggccgtgtaccatgcgcaacaccagtaccgacggcggtggcaggcggcgacgtggcctcttcggggtctggttgcttcgggatcaccatcttgtcgaacaggtgatgggagatggaggtgaaggcgcacttgttttttttttgaacgactcgcacgagacggtgtgaagttctattgatagagcagggaaaaaaaatacaagattacgaccctggagggt

SEQ ID NO: 88286 - DNA, 529 bp, Oryza sativa
caggagcaaatgtctcatcatagtctcgaccatgagcttgctggaaacctcgcgcaacaaggcgagccttgtatctctcaacttgaccatctgatttggtcttaactttataaacccacttacaggtgattggaacagcatgagatggcaacgggacaacatcccacgtgttggtacgctctagtgcagcaagctcctctgacatagccaatttccaatgaggtaaaacaattgcctcctgataagtagatggctcaaacacaaccccaacaacaaaatcatctctattaggtgcacgaagagcatcacgagcacgcaagttgtacctcggagcaggagatgaatcatcaacggaacatgttggatcctcaagggtaggttgggagggttgtgattcgttaggaattttgggtctacgactgtagtggaaaggaaaagtgtctaatgttatagtggaaggaacatgtggaggtgatgaggaagctgggatgtgtcatggtggaggcgatacaggtgagggtgaagggga

SEQ ID NO: 88287 - DNA, 760 bp, Oryza sativa
tcctgcagcccagacatatagaaaaggtgttgaagaaattcaacatgtacagatgcagtgctacacctgctcctataatgaaaggcgaaaagtatggggcatcgcaatgtcccagaaatcagtatgagctcaatgaaatgaaaacaaagccatatgcatcagctgtaggaagcctacagtacgcgcaagtgtgcacacgacctgacttggcattcgttaccgggttacttggcagatttcagagtaatccaggcctagagcactggaaattggtaaagaaagtcttgcgttatttgcaaggaacaaaaggcctcatgctatcttacagaagatcagaatcactccaaatagtggggtactcagattctgactttgcaaaagataatacaaagtcaacatcgggatacgtgtttaccctggcaggaggagctattttatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacgctcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcct

SEQ ID NO: 88288 - DNA, 1707 bp, Oryza sativa
ctcccccatctcctccccaagggggcggggcggcgcgtgccagcagtaggcgcccggagggggccgcgccaacatcgcagcccgagggggagcgcaagaagaagcggccccgcaagatgggggagacagaaccatctcggggaaacctcatttcccctccaaagtggtcgtttaaccgaccccctcgcaggttcgtctctcacccatcgtgactgtattctcttaacgcgagttttcactcacccatcttgttcgtcttctggttttttcttttgtttcagcgagatcccgtcgcgtccctcccgccattccaagtccggccagtctgaggccgaggatccggcggccgcagaggccctcaggtgggaatctgaccggcgagaggccgcgggtcgcctacgggaagccgaggaggccgcccaggaggccgcccgggcccaccaggccgaggaaaccgctcgggaggaggccgcccgggcccgccaggccggggaagccgctcgggaggaggccgcccgggcccgccaggccggggaagccgctcgggaggaggtcggatttcgccaggacgaggcgatggcgacttccgaggcagctcgcgacgaggccgcgggcgcgtcgcttgggcccactccctcaggcgacactcaggcgacaacttccggggcagctggcgtcgaggccgcgggcgcgtcgcttgggcctactccctcgggcgacgctcaggaccaaccgggtccgggggacatccccgagtccggcacttccatcggcggcccgagccgcgtggcatcctctccaaggcggctcttccccacgccttctatcgccctactgaacgcagagccccttctgcaggccttggccgccgcaaacaccacggtgttggatgggttaagtgcccaggtggaggtcctgcaggcagagcgggcggagctcgacgccgcgtgggcgcgtgtcgaagaggggcgacgctcgatggaggccatggtggaggtgggccgtaaggctcaccgccggcacgtctcggagcttgaaacccgtaagaaggtgctggcggagattgccaaggaagtggaggaggagcggggggctgcccttattgccaccaccgtgatgaacgaggcgcaggacaccctccgccttcaatacgggagctgggaggcggagctagggaagaagctcgacgccgcccagggggtgcttgacgctgccgctgcccgagaacagcgggcggcggagaccgaagcggcgtcccggcggcgcgaagaggcccttgaggcgcgcgccatggcgctggaagagcgcgcctgcgtcgtggagagggatctggcggaccgcgaggccgccgtcaccatccgggaagcaacgctggtggcgcacgaggctgcctgcgccgaagaagagttcacgctccgcctccgcgaggacgcgctcaccaaacgggagcgagctctcgagggggccgaggccacggcgcaacagctggcggtcaacctgtccctccgcgaggcagcgcaggaggagcaggcgcgctgcaatctggaaggtgcccgcgccgagagggccgtactgaaccaacgggccgctgagctcgaggcgcgggcgaaggagctggacgcgagggcgcgcagcggcagggcggccacgggcgaaagcgacttagccgcccgcctcgcagctgccgaacgcaccatcgccgatctg

SEQ ID NO: 88289 - DNA, 567 bp, Oryza sativa
ctgcagcccagacgagccaacggctcggattcgccggagggagcttgacggcggcgaatcgcggcggcggcaactggcggggagggaagagggaaacggcgacgaggtcacgaggggtcgattcccggcggtgagagcatccacgcggccatgggaatccgatgctagcgtcggattgggcggagctacgccgagcgaggctggcgacgagcgggtgctacggagctcgagcggcgacggcggcgagcacacggcgagcgacggcaacggtcggggcggcgccggctagctacggggaggctactcatgctaccaccgaaaactaaggggggaagatggagcgaggagggagaacggagagaggcactaccgagatgaggaggggcgcagtgacgagaggccgacggcgcgggagtgatctctccggcctcgggccgaggaagaggaagaagagggtgcgcccagagtccccttccgcgtccttgctcgtgccggctcttccgacacgcgcaacgacgaacggcgacggcgaacagagcacgggaggcggcggcaatggcgcggagg

SEQ ID NO: 88290 - DNA, 585 bp, Oryza sativa
cttcctcctcctctacctctcctctgctcgctatctgttcgtccggttgctcaccgagaaagaattgaattcgcctcagatttcggacttcggcctcgcccggtggctgccgtcggagtggacgcaccacgccatcgcgcccatcgagggcaccttcgggtgagcacacatacgttctccatggaccatggccatggcagtaaaaacagggagacgagacgacgctgagccgacgacattgatgtgcaggtgcttggcgccggagtacttcacgcacggcatcgtggacgagaagacggacgtgttcgccttcggcgtcttcctcctcgagctcatctccgggaggaagccggtggacggctcccacaagagcctcctcgcctgggtacgtacgtagcacattcatacgccatcgccgccgtcgcgtcgcgcatcgcacaacacgcgcacggcggcgcgcttgtggcggccaggtgttcggccagggacattgacattggtgccgtggcgcgtgcatatgcaggcgaagccgtacctgaacgactgcgtggcgcaggggctcgtggacccgcgcctcggcgacgg

SEQ ID NO: 88291 - DNA, 523 bp, Oryza sativa
acgtcgtgatgttgctacaaaaactgaaatgggaagaatagctcagcagcgtatgcagcaggctatgctggcaaacaatgctgccaataacttatctgaagggaacgcgaggacatctaatcttgggggtgggaacatgacttctgacaaccaagttcatcaagctacccagtcaggtggtgcggcagtttctcatgatgggggtaatctccaaggacaagagtcagacagatctaatgttgagggtggtacaagcgctggccatgatcaaggtcaaccgagttcaactggtgcagatggttcgcaaatgccagcaagacgcaataatggacttggctgggtaacttctgcagcaagtgcatttgatgctgcaaaggatataatggaagctcttaggagcaagcataccaatctagccaatgagcttgaggtaagaagtaataacaaagtggtttataaacctttaggaaattggagatgactacgaccattacttttttattaaattagagtcttaccatac

SEQ ID NO: 88292 - DNA, 504 bp, Oryza sativa
tattgcttagatataaatggtgctctcctctggctgtctacaaccttaggggaaatcaaaacaaattatacctcgcgtgaccaatcaagtgaggctccaagtgtacgtaattgtttcaatatggtaccaccatgctgatctttccattggaggacctgccaagaagattgaagaatgaaaaaaataaataaaaatgaaactaactgtgaagttaatacaatatgcaataggtaagaaaaaaatgattacctccaatagaaatttatcacgccccagatcatgtcttgacaggtttctgtcacgcataagccttttttccacaaccacctgatatgaagagaaattttgttacataaagcctgctacccttaaaaactaaaacagaatgttggttaacaatcaatgtgatgtttcagcaaaagtcaatttgtattcaagttaacaataaatgctgtagaggttatatgtaagaaacagataccatatatatgttatatgcatgac

SEQ ID NO: 88293 - DNA, 622 bp, Oryza sativa
ttcctgcagcccacaaagggacacagatgagattgccccaaggggatgccaaaacgacgtcttcaagaagagaagcgacggaagaccgccacagccgtccatcaggactccaaggagccaagactgggctttcacccggcaaacacccttgaggggtgagacagcacgacaacgccctcaggagggggaatgaaccatcgttgtcggtccggccaaggccggactaggttttcacccaccgctcaccacctgcgaatccacgactgacgcaccaatgctccaccacaacactagctctgccgacatgtgggacccctgcaccagcaccccccggcggccagccttcgtgcgccaaagactgctccacacccaccggcagctcctcctcacacctaggtcgcctcctccaccgccggccgtacctatctgcgccaggccagcctcctctgccggacgcgtctctcgcgccaatccggcctccctccatcggccgcgcctctcgcgccaagccggcctccatctccgccgcccgcgcctctcgtgccgagccggcctccgctgccatcggctgcgcttctctgcgccaagccggtctccgacccctccaccaaacgatgccgcg

SEQ ID NO: 88294 - DNA, 615 bp, Oryza sativa
atagtctggattgcagtttcatgtaaagcaaaaggattctacgaagcaaacgccatatatatgacagcagctatttacattagtggccataatgcagaggttctaaacaaatggcgttgcttctaagggtgggtgtgcatactggtgacatcctggacatataaccaaaagggacagtaatgtgctgcatgttgtttccttcttcatccgctagataaagagcaaagaaaagtatggattagcaaatatgtattgagctatgtgtcctatgatatatagaattgagatgattgtttatgtactgaccttttcttatgtttctgctgactgtcatctttaaatagtttcttagcagctgaggctgaggctgaggctgcaggcctgtttttgttcaggatacagttagattatatttttgctagaatagaaagttgttgtaactgaggaatgatggaaaaatatacctttttgggggaatgtttttggtaggcggtgatggggatgctgatggagtatcttctgctgctattgctagtgcctttgccttgtaggatagtttatgttgtcagtgtttatagtttttgctgaaagcagggataagtattaattaccttg

SEQ ID NO: 88295 - DNA, 554 bp, Oryza sativa
taattgaaattacttgacttgatgaactctccaccagcctccgcctcaatccagcccgccccgatgtgcataccaagaggtggaacgtccgggaagacacaggcagccccttatctgtcatatcctcaagcagccgccacatcgccttgagctccccacactccgcaaagatcttcaagatgaggttgtacatgctcgtgccgtgccggtacccctcctgttcctccgcccacaggaagaacttgtaagccagcctcgggtacctagcgcggttcacgccatcgatcgagacaacaaatttgagcagcacttccctcacaagggcattggacaccctcgggcgcatttcgtcgagcgcctggcgggtgttgaaccccgggccatcctgaagcaggatcttgacaatcctatccgccttcaacctcagctcctcaaagaacctcctcctggaaccggaccccgcgccaggggacaagttttcgccatcatcgtcgtcggtctcagcccggccgggcggcgtcagcagccggagcagcacttactgcgggacgcgt

SEQ ID NO: 88296 - DNA, 1114 bp, Oryza sativa
tttttagctatagttacatcttttttcaccatatgtgcaccccctcagtgcaaacttaagcacctacatcagcttaatttggtctaaaacagagtaaagcaagcatgtgacacccctctccatttcgctctaactcctccctgcctactccacctctcctagcacctctcttcttgctccacccctctcccactccctcctgctccacccgtcactctcctctgccggctattttttgcacccgatgcggcagctgggatgtggtggctgaggtagaggcttgcaaggaggcaaatctgatgaaggcgatggtgtcgtcggatggatgcagcgctcagctgatgtgatgcaggagaaggtggaggcgacgggtggatgctacaccgttggctgatctgatgcagatttctctttttctctactcttggtacttgctagttcatgttggtgaattcaaagcatttgtttttttcttgcccatctttactatgagaaaaattgataatgcttcccttcgtcatccatatttttcatccatggtccgcataatgccacaagatgcttctccataaccgatcttctccagtttaagcatatctcatattagtcctatatttcggaaggaaaaagtacgaattaccccctgaactatcgcggtcgtccgaattacccccaaccacaaaaccgggtattcttcacccccaactatgcaaactggacaaattaccctcctcgatctaatctgtggtgattttggtccacgtggtgttcgcgtggtagtccagtcagcactctaattattaaaaaattgtgggacccacctgtcatctcctcatcctctcttcctctctctcactcttcctctctctctcaaaccggtcggcgacggcgtgcgggggaggacgcggcggcggcgggcggcgccggacaggcccacttcgccgcccaacccacctggatcgccaccggcttgtccaccgccccctgcgaccccgccaggcaggcctacaccttcggcctccgcaccatggtctgcctccccctcgccaccggtgtcctcgagctcggttccaccgacgtcatcttccagaccggggatagcatccccaggatc

SEQ ID NO: 88297 - DNA, 2455 bp, Oryza sativa
cgcaatagttcgggggggggggtaattcgtactttttccatttcggaataggttttaactttgtaccatgtgacatgaccgcttagaagtccacccaaaaccaatagttttaaaatgtaaaaatactgggtcgttgcccatgctagattgaaaccagggggatccacatgaaattgctacgacacttccaatgatagtgatttaactagtgggccaaaataaaaataccagtccaaatctgaggcaagatgaaatgttcgtgattgctaccattaacaacgacccaaacaaaggccctaaatgactagtacatcatgaatattattggtagcgactctagacaactaaatatatagttggctaccattgacaacaccccaaacgagatgcgtgatccttaaatttaatttaaagtgttttggtacgggaaacaaaccaaataaactttaggtgctgtttggttggagattgcaaagtaaacggtaaggacatcagatagcactgtgatagtaatcagattacggcaaacttagattttgtttggttctcacacgtgggtcgaggggagcggcggaggcgacgcttgattctttctcgtgttgcctctccgtatcgttaacgcttatcgctcctgatcgagcggtatcgcctctgaactgggcccgtaatgggttccaaggtatccaattacggagcatctcaaacaaacaacgggaaccggatctgtttgcgctggaatcgggtgcgggctgaattttaccgaaccaaacagcaccttagtgccataacattacccacctccactacttttaaaaatttgacaacacttccattagctatccaaaaatttcctcaagcgttcgcacaatgcccaagtcttttgggaatatgcaaggagtgcatctttggaaggaataaaagttatttacatggaaattaagaaaacaatgaaggggacaaggtacatgaaaataaaaagactaggagctaatctcgcaactgatggtgcgaccaaatgtctccgtccgacaaacgcagctccggcactgccaatcttgcaagtcgctaaagttcagcttctgccgccattgcactggccacatgtaggatctttgctgctgattgaagactctattgtttcgctctttccagatggtccaagcaaccagagccacaatggtgtcaaatccccgtctatgttccttgcattgcttcatcgtgctgtcacatagccaaagatggaaagacgaatctgaaagtggcaagcatcctgcatgtccaatcgcattgagggccatccaccaaagctggcaagattctggacatacgatcagcaggtgatcaatgctctcctcgcattgatcacaaaggacacacttggcaggatgtggaagtcctcgctttcgaagtctatctgctgtctagtatctgttaagggcaacaagccagatgaagtaccgatattttggtgaagctaaagatttctagattgggctggactggaagcgaatgcgacccaggaattgtgcttgataggccgaccgagaggagtattcacctgacgtctcccatctccagtgcagcgaatcctcctggtccgagagctgtatagacttcatcactggccagaggctaagatactcgagaatagcctgcattcccagggcaccagttatgtcttgaatccatcttttgttgagaagtgcttctgcaactgtcctgtgattgcgaaatctcgcaggaaccgcatcatagatggaaggcgccaactaacaaatcgatgacccatttatccagatatcctcccagaacagtaccaagtttcctcttccaaccgaacaatgcccgagtcttgatgcttctccacaacctctcttcacctacatgagtgtgtccgtcatctgtgcgacctgacatcccacatcggtcccatattttggtatcgaccggtaacaacacggtgcccgtgtgagacgatcggttaggccaccaaaacccccacagttcttggcttcttgcacatgtaatacatccatccaagcccccaaaatttacagggagtaaaaaaaaaacaaaaaaaaaacaacaaggtaacgacctatactagatccaaaccagggtccacatgaaaaacacttcatcgttaccactgatagcgattcaactggtagcccaaatgaaaaatactggttgaaatctagaggccatatgaaacattcatgatcgctactaccaaacaagggcccaaatgaaaaatacatgatcgatattaattaattgttggtaacgaccacccaaacaaatagtactacctccgtttcaggttataatactttttagcattgtccacattcatatatatgttaatgaatctaaatatatatatatgaatatacacaatactagaaagtattataacctgaaacgaggaagttgcctgcattcgtagcaacgg

SEQ ID NO: 88298 - DNA, 593 bp, Oryza sativa
gatcagcttcagtgccctcgaggcaacagagcgaagggactcttcgtactccaggacagagacgcctccagatgaaagcttgaaattctcttgccatgcccttctggctgtctgctgcgccatcaccagatcgtcccgcatttagcagtcgatgaaatggtcgatgcagtgaggttcaggcttcagttgcgccatccatatgacctgctcaattgcggatcttctgattccagggtgtacgcttgcttcagttctatgtgaatttgcttgcttcaggattaatttcagcttctgtacaaaattccttaagccgattccatttccgttgacagcctcgatgaaatcggtctcacagagaagtttgctgaactgcaaaacaaggccaagaaaggcctccatgtcctcccctataagattgtctgtctgatacatagttctaagtgcctacaaattaaccagcataaacattagtcccttgtatgcatcaaacaacacaactatcaaatcttaatctgtttagctaaattattaggtacaaaactgtgttcttaccatcgagatgttgtctacagaaaatttctgcatggagtatt

SEQ ID NO: 88299 - DNA, 557 bp, Oryza sativa
agtgtgaccccgggctgctgtcgccatgcgcggccccgatcttcttcgggacggcgccgtcggcgtcgtgctgctctagcctgaaagcacagcaggggtgcttctgccagtacgcgaaagacccgacgtacgcgtcctacatcaacagcaccaacgcacgcaagatgatcgccgcctgcggcatcccctttcccaactgcagctaggctccgtcgccgccgttcaccggtgcgggccatgatgtgtggcaacatatataaatatatggtgtactgcgtgcttgaataaaataaaggacaatgtgtggaaacatatataaatatatggtgtactgtgtatttgaataatataaaggatgtgtgtttgaatacataaattatcgatcgattaatgcacccgtgtttgatcgatcgatcaggtatcttctgggatttaagtttgagttttgaatttctaatcttgtgggagcgtgaaatgctactttaagagttaagtattctaagatgatttgtgttttcaagtttgtctatcgacctctcaactcaaatttctcataa

SEQ ID NO: 88300 - DNA, 532 bp, Oryza sativa
aaattttataaccatttagatgacatgcaaacgattaggagatatcctctcgagtgttcataatcctttccctaatagctaatactaagtatgtatgtttaactttgggcattaattaattggtgttatgaacttatgatgatgttaattgcagggtttcaggaagatagtagctgacaggtgggagttcgccaacgagttcttcaggaagggagccaagcacctcctcgccgagattcaccggcggaagtcgtcgcagccgccgccgccgccgatgccgcaccaaccctaccaccaccaccaccacctcaatcccttctcgctgccgccgccgccgccggcgtaccaccaccaccatctaatccaagaagagcccgccacgacggcgcactgtactgtcgccggagacggcggcgaaggcggggacttcctggcggcgctgtcggaggacaaccggcagctgcggcggcgcaactcgctgctgctgtcggagctggcgcacatgaagaagctctacaacgacatcatctac

SEQ ID NO: 88301 - DNA, 1136 bp, Oryza sativa
  unsure (1)..(1136): unsure at all n locations
catagagcaaaccttatttcgcaaaacatttgtaccgataaccgcatacaagtaacaaaaaaataattggtatctgtgttggtcgatgttcaaatggcaatgcaaaaataaattacaatggaaaaccataaaatcagtttcaaaattaaaatttttgcagcgacttgtaagctgaaaggtatacaatgggatttacgcacctacccatgcgtcttgtgtagatgacagttatttgaagtagtacggcgttcagtcaagtgttttacagggaaagcatacagggttcctctacattgacaagatcaggttcacaatcccaatagaaaaccgatgaaatccagttaaattttgttaaaataaaataaaattcggttgatttttttaacttggcaaaaaagagagagtgaattgtgctttctacctattctggaaagtccagcaggatggaattgtaaaccctggacaagattcctacagggatgtgttccaagcagtaggaatcttctccagacttaaatccaaaaactaaagatcagatatcttgtagactaatcgagtgatgtccaataagaaatacgattagtacattaagtacagggcgttgcacagaaaacatatcacaaccccatgctgtgaacacacgctaaaacacatacgcgttaaacccacacacacagcttcaaatcttcatcgaggaaatctgaagcttgagcatacacgttgtcacgtaactacacaggcgcagctgggatcggaaacaacaggtagagtagtacggctactgcttttttcttgttttgccataacaacagtgatgaaaaagaatcaggtctctcctcgaattgaggagagtggaagagattgttctagcctctgtacacgccggagggatcagcgttttgaactatccaagggtgctcgaggagcttgtggaggggcagacgatgcgccgaattcttcacgagcatctgcagatcaaaatgctntcttgaggttcacactctggtggatgttctacttgtgtccaaatgacgatttacttgtcacagttttacagttatgtaaatcatcaggacaggagcatgcttcttacctgtgaaattaggtctttcgcagccggggacacgaatggtttc

SEQ ID NO: 88302 - DNA, 605 bp, Oryza sativa
aaactaaatctctttataaatatcaaatagagtactaatacgagtaaagctaaaagccgatatttcttatctacatgatgagactacgactagttcacggttgttgccaaataaggttaatatttacatcacctacgagcaatctcggttaggctacaaaaggctatggtaaatatttggccaggcgacaataggctgagtttgttttcacttttcagaaccacgggtgccatgtcggatccatcatgcacaggttcctcgaagataatgccgcttccacgagatccgtgacgcctctttggaccgactgaggtggctcagatgaattctcctcctgaaatagggagagaaaatgctcccagatgtgaatataagagcaggtaaaatagcaggctataagctagctataaacatattttaaagagataaaggaagagagactcccaagaagtaatgtgtatatgacagataggatcaggtattaatagtatagtaagcaactaatgtatgaattgggtattacattggctatagatgatttggagctagcaattggctatactattaaacttgatctaacttgaatgacttgataatgaatttgg

SEQ ID NO: 88303 - DNA, 561 bp, Oryza sativa
gcaacccttgtaagtatcgagccgactgaatcaaagctgcttcgcggacttcttccagtcggtgcaagtcatccactcggtcctcctcgtagcgttcttcgcggaaattacgaaagcgcaaagactcgaattcgacttcactcggcaacattgcttctgccccatagacaaggaaaaaaggtgactggcctgtggcccgactgggtgtagtacgcaaagaccaaagtactgatcgtagctgttccacccatttgccggcatagggttttagccggtcaaaaactcgcgctttaatcccttgaagtattatgccattggctcgctccacctgtccattgctcatgggatgtgccactgaggcatagcaaatcttaattccaaagtcttcacaaaagtctttaaaaactccgccagtgaattgtctgccattatcagtgatgatccgattgggcactccaaatctatgcacaatgttgatgaagaagtctcgagcgttatctgctgtgattgtgacaaccggtttagcttcaatccacttggagaatttgtcaatggccacaa

SEQ ID NO: 88304 - DNA, 1090 bp, Oryza sativa
attgctaccagattaggcatcactgcatgagaggatcatatcatatgtatgcatgtgcagatgggtaaaaagatgaagatgatattgttcactgttgacaaggaaatgttatgctaacctgcagatgggctgaggtaacaaacaatatcctggtatccaagagaaaagtacatattctaatgtaggagtatataattccaccattaagtaggatgtacaagcacagaaaccaaccaaaagttagttatcttggcacatttgcgcacagttgctatgggcaaacaaagccctatgagcaaattgagcatccatctgctcaccaacattaatcagtactactagcaatagcaagcctaacagaataacagcttgcaatactttagaaaaggctactatgttaacaaaaggtgcgagatgtagtgttagtcctgtcacatgtgatcctttatcttcatgttgatgcacatatgcagggattagttccaggtaccccactgccatctgatccccggataccttagcgtccaaactgatgtcgcggcttggcggatatcatcgctggagtcggcatggaaaagaatggtcacctcgcaagatggagcacagttattaaacaagggtgcaagatgaggaacatccttcaatggcggtagatgaaacaggagtctcctcaaacagcttctaaactggttgctggtgcataacatcaggcaatgcgtcatttcacatgaaaaccgaggggccaacttgacttcgctgatgcccgcaaacagctgaagaagatactcgggcttcactgcttcaaaaagttcatatttgtttgtagaagtgggcagctcaagctctaatgtagtgatatcatgattctcggcaaatacttgcaagaagggactttagatccaatgactctatccgcaaatttttcaaactcacaaggccatcggcttggacatttggtccaagtttatcaactgttaacttcagagtaaacatggatggggtatccaaaatgagcatatctggtcgaacacatttcagctcaagaccaaccaagttaggcgcacggattgttaatgaccgtggaacattt

SEQ ID NO: 88305 - DNA, 630 bp, Oryza sativa
tataggcgaattcgagctcgtacccgttgatccgtatagttgactagttttcactgtgctgattattattaaccgggtggtctgtcttggtatctataggtaagttaggttcttatgtgaagttatcattttgaactgtttactatttttaagatgaaaaatccacagatacatctaggatgttttttttgttagtgtttaactatgtgatttgatcatcaacaccatgagtaaatgttttggcaagattccatttggcatgatggtccatttaccttggcattgacctggcataatctcagggacagaggcctgaacaggattcatcagttaattcacgccccacagtagaccctatggtcatatctaacatgaagaccgtcttaaaactcataagtgagagggtgatggcctcttctgagttcaggcgatctatgggccaaacacttcaagcactcctttcagaaaaaggcacagatcctagcgttcttctatgcatactggacatgataaaagcttggattgaggatgactacagacttgcttcatctactggctctgtcagttcacttaatccaaaggagataatagcttatcttcagaagttatcagttagtttgaccaggaaaa

SEQ ID NO: 88306 - DNA, 644 bp, Oryza sativa
gaagatattgtgacagagacagctgttctcaatgtaagtcccatgacctacatgcttcaactgggttatgcacttatgtttcagtattgtctttttgttgaggtttgaaatacagatcaagagataattgtgatttggttgaccgtctggaggtgtagataacattcataatgaatactacttcctttgtgctcgaatgtccttccaatgcacggaattgtacttgacatcttgtgtttattctgtttctatgcagtcctttgatctggcaactatgaaggaaaatgaaatggattttacttcaagctttgagctgaggctcagtgaaagtggtgtatcacaatctggagtaacctggtgctatggcattatattatggtttgacactggctttacgaaccgattctgcaaggagaagccagtcaacctctccacctctcctttctccacaccgactcactggtctcaaactatcttcacctttgaagagcccatcgcaatggcaaaggaggaatcagccgttgtctcatctgcgtcagttggcacagatgagtgcccagctgtgatgatcagatcccgcatcagcatcctgagggcctctgagcaccgcaccatatacatatcgactgaaactacaggaatca

SEQ ID NO: 88307 - DNA, 2411 bp, Oryza sativa
caccaccaccaatcggagccaccggagagcggcggcgcagcagacggcggcggctgcggggggcgagaggccgattcgccggaggagagaaggagagagagagagagatggcgttcacgatgcgcgcggtgaaggtgccgccgaactcggcgtcgctggaggaggcgcggcaccgcgtgttcgacttcttcaggcaggcgtgccgcgccatcccctccatcatggagatctacaacctcgacgacgtcgtcaccccgtcccagctccgctccaccatcgccaaggagatccgcaagaaccagggcgtcactaaccccaaggtcccaacctcgcacccacccccatcgatttcatccgtcttcccgatttcgtcgatctgcgcctcgtgaatgagaattctctagtggcttaaccaactgctcgcctgctctctccgatctggtctcttctggtccttgggagttgatgatttatcggtgttaggtgctggatcggtaggttttgattaacctaggatttgatagcctcttgtttgcagcaggggatttagactaaccttctgcctcaaggacagtagtattccggcaggtttgatgctatgtgggcagtaaattgttttcaccgatggttggtcaatttctatatctagacatctggatatcatttagtgatctactttctgtgacatagcacatgattatctgaacttcattgctgcttccatgttatatttatactaccagtatcaacaatgcgattcacatttgtcgatggtggtagtagtagctagggatatcatctgtacaatgcgggctctcacagttaagacagtctaatgaggtttttggtctttgcacaatcttctgataggtatcttctggcattttagtttagactagagagagcggttttgtcggctggcctcctttgcttgtaaaaattgagaaaatttgtcagtttaattgagcaagagtgcttatgaatacgattcaatgcacataatattagatccataccacctctccatgtacatgtttctagatcccctgaagaaacattttcttttgttatgatttgcatctttgtaggctaactatgtttgctggcttcaatttgaattacactcatttgattaggcccttaggaagacttcacctgaagcatgcacttaaactaaaaaatgttaatgtcagtaaaagggatctatatttttatcttggataatccaaagctgcatcagcttgagttgcaaggatcagagattgcacgcgttgatttgatccaatatttgaagaaacctcaactttgtaacaaaacgcagcaaattcatgttttgtttttggataccttttgtcgtttgttagattagagttgttacgatcacatgaatactattgggaatgcttctgttccatacctcaggtttggtccagtccttgctcgtattgcccagttctccattgtatctgagtgcagtaaattcagatgaatgcttcttttgatcaaacgccaatttgaattcattgatcatcacaatctaaaatgataaatttctccctcataccccctgttttggtgattgtgttgcatttgggatccctgtattatgttgcccctctttatgttaagtacattttctaccagtgcagaattatcttgttgtttgtagcttctcatgacgcatcacgaatgacctgaaaatttggtcgttcacattttctttttgtctcacttaccttaatccttactgtatcaatgcctcatctaagctatttttgtttgcaaacaggtcattgatatgctcctgtttaaggggatggaggagctgggcaacatcaccgaacacgcgaagcagcgccatcacgtcatcgggcaatatgtggtcggccaaaagggactggtgcaggatatggagaaagaccaagggtcctcagacttcctgaagaaattctacactagcaattactcctaatctgtgctgcaaactcctcctccttcagtaatacccgagaagtgatctgaataagacgctgagaacccacagctttaattgttttatcactggaatctttttgttattctgcttgatccttcaatcatctgcgcagtgtggcgctgttgctagtgaattgtttgtaacttgtagactgtactctgcaaagttgatgttcatgagttcataccgtgtgtcaatgggttcgaactcatgtacccagcacatgaccatcactcgtttgtcgtgaagtcattgattcgattaatctgtagcataaaaggtcatggccatggaaacaaataataagtgttgccgttctctaatatactcttgagtagttgtgacttgtgaggtatattaagaattcagatggcatcagatgatcagtattcaggtgtccctgtctgcttagcaa

SEQ ID NO: 88308 - DNA, 838 bp, Oryza sativa
cttctcaatacattattgaaactctccgccatattactagtcatgatgctatgacgacacccgttggtatcaaatgctcttgcccatttgaccttaagtggcatatggtcttctacccacttctttggcctctctccgaccacacccatgaggcgttttatctcatctaggaacaatgctttctcatttatttgacatatgcgctcaagatctttcatctgatcagtcgtagctccagctgtgtagaagttagcacagaagtgcctcatgcaccacctgtggtgaatggttaggtgatgaggcatgatgtggatgatggagttcaaaatgccagggtgtctatcagaaattatacacacttctctattaggaccgatcaacttgtttctcaacatgttgatgaaccactcccagttggatgtattctccttctctatcagagcaaacgccaagggaacaagatgtaacccggcgtcgacccctattgccgtgagcaatgtaccttggtatttaccggttaagaaagtgccatcaattgctagcaccggcctcaagtgcttgaatgcttctatggactggccaaatatccaatatgcacgtccaaatactcgcctctgtactccatccaccatcctggacttctcgggatgagcctcaacacggaaatgcatggtagggttctttgctttgatggcacgcatcagtgtaggcaagcaaacatacgcctcgtcccaatctccctaaataaccttcatagcaacttgcttagcacgccatgctttgccatacgtaggccgatagtgccatatttgctcaactgcctcgacaatcgctgctg

SEQ ID NO: 88309 - DNA, 590 bp, Oryza sativa
actatagggcgaattcgagctcggtaccctccttttctaatttattttgttttgctttaaaaattcaaattctagattgcgcttgcagcatctagcatgttctcattgatgatttgcattttacaggtcgttcagcagcaaaggatgccaaaagatcttctgcaaagcagtttaaggcccatcttagttaacttagcacatacaaggagtcttaccatgccgttgctccagggattggctcgtctgcttgaattactatcaaactggtttaatgtcactttaggtgctaagttattggatcacttgaaaaaatggctggagccagaaaagcttgcccagagtcaaaaatcttggaaagctggagatgagccaaaaatagctgcaggtctgtcataattttattgcattttcctctctaactatcaatattttgtttgaaagaggacacatcacacgagatttagaaaccagatcttcattcttttcatatattattgtactaatttgatacacagaacttaaacctttttttcgcaaatgtgtaccaaatgatgcttgtgctctcggtatcttccaattttactgtagaa

SEQ ID NO: 88310 - DNA, 2105 bp, Oryza sativa
ccttgctcgccgttcgcgccaggctcgcctgcgccttcaggatgcccttgggtcgccgcccgccgccggcggcgggggtggtgacacgccgcgcggtctcggtagctgtctctgcggacgacgccgccgccacggccggcgccatggagaacatcgcggcgttgaacgtcgccacgcggatggtcaccgcctcccccgtcgcgccatcgccgcgattatcccgacgcgctcccgctgccgccgccgccgcctccttcctcccgttcgaccccaaccgccgcacggtcaccctcgccttgccctccgcgccgccgtggcggcgccggcgcggccgcgggtgcagcgcccggaacccggcgagcacgcgtcgcagcatgagcgtcgtcgcttgcgtgtgcgtgtgcgtgtgcgtgcgcggggggcgcccagtgcggggctccgcggcgagggggatagcgtaataatataccgctgcgtgagcgagagagtgtcgccgtcgcgcgcgcgcgcccgcgtcgtgacacgcgtggcgacgacggcgacgcgacggatcgcgtccactctactttgcttgggcgctggatatgacaagcagagttagtgacacggcgaaattttggttgtttattttgggtatattcgtatgcgtgtacgcagcaattgtaaactacctaggagtacgtggctatacgtatgtctgcatctgtcacaagtgagatttgttgcttcctgtacctatgcgtacaccgacctctacctcacggtatcttggcatcttgtcttctccatgtccaaactgccgttgtattgccgtttttttgacaaattgacccttttcaaaaacttatttcgaaactaacccctaccaaaaacttcaaccaaaactaggccgtcggctcagcgccaagcgcattggcgctgaggttggccgtgtcagcgccaacgggactggcgctgacattgtgccaccgtggcggccgggccgatcccctagctgacgtggcagctacctcagcgccaaccgcttcggcgctgaggtgcacaacctcagcgccaagtaagttggcgctgaccttggctacttagagcccggccgaggccgccccagccagttcttcctccgttttttccccagccgcccgcctagggttcggtcgccaccgcgttctcctcgcccaatctcccccaaaaacctctctaatcgaaggtgatttgtgcggcattgagtttgggatcggaagagaaggtaaacccctctataaaccctaagttccccaaagttttattggatattttgcattgttttggttgtagacgtggtttgataatagttggctaaggatggattattagatggataatatgggtggggatgaagtgtggaggtggcatatctttatccatttggttgttattgatacatttgacaaaatatatttgggatggatgtttggtgatgcactagggtttgatgggagatggatgtgtggtgatggcctaggatgtgggatggatttgtggtgattgagagggtttgaaaggggttgatgtgtggtgaagggtaggtaatttgtaggagtagagttttttttatcaataatgtgtagtatttgagtaatgtacttatttattggaaaaattagacatgttgttagcttttgaagtattggtattgcaatggtaattacatattattttcaagtaattaatgtttatgcatgggttaaaaattgtagatggatagattggtccggcttcattatggtggttgtgtggtagatgaaagtacacatggaagccaatttgagggaatgacagttagacaattagtgttttttgcgaagcctacctttgaggagttaatgtctcgcatcaagcatgaattggattggaatgatgagtcggttggtatgcaagggagatacgatgtgggcggcgtgtcatgtcacataaatttatgttagacttgaatggagagatcgaatggcaaacatatatagatatagtattggagtcacatttcaaatctcttgaggtgtttgcatggaagaaagatggtaggatagggaagaaagaagttatagaccttaatgaaagtccactca

SEQ ID NO: 88311 - DNA, 990 bp, Oryza sativa
gtggtaaaagtcttgaacacgtcacgatgtgaaaagatttcacaaataattgcgtagccatgaaatgctcggcacttccttctgctgccccacactccactaccaagtccatcacttccttaatagagttgtacctaaattcaccttgcatcaccttgttggcaatactacaattggtgtccaaagtggactgaatattcttcatcaccttaaccatggggttcttaaccttcttcagtggactattttcagtggtaatacaccctcgtttcactgatttgttattcgttgtgtatctatgcaatgagatgtccactggtgtgtcatcaaggctttgtacaccagcccctccaacatcctctccaggtgcacaagcagaagaaccatcaacagcaacctcagcaaacatttgactcaataaatcttcacaatccgggggaccatgttgtagcttcttccattcagaatgaccctagaaataaaggaacaggccgtgagtactaattattgaaaacactaaaaacaatttcatgaaaaggattattaccttagtgacttgcttccagtatttatcacttgctgaaactgttccttgtgtactatcccatccaagccctgtatctttgaggaggccaagccaaaagctatacaaggcttttagtatatcccatcggttcttcaattgcatcttgctgtgtcgtagccctgttttctgcaagtacttgacagcaatgttctggtaccccctagtagtcattatcccgataggcctattgccggcttcgatttgttctacgcatagttcacaaaatatcctagtgtttgtggtagaccattctgctttgtcaaactccttctatttgatagaacaaacacattgagattcagttttcaatgttgtcgtacatctatagctctaactataaaaaaacatgactatttagagctccagagcacatgaatagtattttattatagcttttagatatg

SEQ ID NO: 88312 - DNA, 1095 bp, Oryza sativa
acgctcggaggttgaggactcctagacggctaggtgtcactcccgagccaccgatctacatgtggttggccggtagaagtttgtgaaggccggatctcgcctccacaaggaaagagatctccctttagtggaaggaggagtgcttagtgcaacctcttgagaaaagggttagcaaagacccggctcttagtgagctcctcaacggagagtagaatcccctcaaggatttgaactccgggaacaactcagtgaacttcatttttggtgatatctcttctcccattatttagctttgttttttgtgccgctataaatctagtcgctgtttgcgccatactcttgtttgtgcacttgatctacttgtagtgttcttttagtggatcagacaatctgatccaacatcagactatctgatattttcggatagtctgactgtgaatcagactttccgaccctaactcagttttagcttccgcataaagttttaaattagtctattcacccccctctaggcctaattgaccctttcactcaccttgaaatccctaagaaccatcaccttgagctctttgagaaccatcaccttgaactccttgagaaccatctgcagcacctttatcacctgattgagtcgtactatctgagacctgttgtatttctccatccttggaagaacttgtcccagcaacatcagcaactagtttcatcttgtacctctgaacgattgttccttggcgagtctccataaatgggttaaagaatttcatcattacctctgtgtctgctgcatcattacctcaagatccttcttctgttcgggtgtcaacttgtccaaagtgatgggcacgatattgctctcattaacttcagacccaccaagcttagggatcctagatttgggaggaccctctttgctactgaggacggcgatgctggtagtttctcagccatgagagaacgctgttgtgattctaacttctaatcggtcccaccgggcgtgccaaaagcgtgttgatgtaaaaacacaaggcctgggagatctgcttaactccagtgcaggtccagaagcttgagtactctatgatgggctactgt

SEQ ID NO: 88313 - DNA, 1435 bp, Oryza sativa
ggatcaacttacactagagcaaaaggtagagtatgagcagatgatgaacaacttgcagaatcggtttttacattcatttgtgcaaactcgttcaggtacggttatccaaaggtataaattgaaagtgccatccaatgatgacttagaatcaagcacttccaaagatggcaagcccaaagatgacaaacccaaggatgagaaaccagaagaagaagaacctcaagagttcaggaacctgcaggaccagattgactatgttgttcatcatgcactgatcaaccaatcgggagtgcttgtcaatactctaactaacatgatcaattctgtggttgatggtacatttgctgaacatcaaagctaagggtctaactttttttcctgatggcgtgtttccaccgtatacgaatttagtgaccggcaaacaacagcccgtttctggtgtaattccagagcagccgatggcatcaacttcggctttgggagacagcgcatgtcaacatcagcacagggacaaccagggtttaatcctcatgtactgattagacctcagtctcagcatatggggcaaaacatacctcaagttactctagaacagatcgtgctatgtttaaggggaagccataggttgttgagccgattcagcaaataccggtggggcagcagacacctattgttcagcaacatcaacctgttggtgctcagtttgtctctaatcaacaagttcataatgtgcatcaatctcctcaacattatactggtggcaatatgaactttcagtaccaacctcattcacctcaaatgcataatcggccagggggatcacctcagcctcagatcttgcctcaatataatcagtttgatcaaatttaggtatctcaacagaagccttgggctgatatgattgcaaatgtgatgagggaagaatttggtcttaagcccaaagatattggtaacttatattgacacccatacccagaatattttgagagggttccactaccaaaccgatacaaggttccagacttttcaaaattctcggggcaagataatgtatcaacttatgagcatctcagccaatttttggctcaatgtggtgaggcatcggctactgacgccctgagggttagattgtttcctttatctttatctggatcggcattcacgtggttctcctcattgccttataattctatttcaaagttgggccgatctggaaaagcagtttcataaatacttctatagtgggattcatgagatgaaactttctgatttgacaacaattagacagagacatgatgaatctgttcaagattatattcagaggttcagagatatgaggaataggtgttatagcttggctttgacagattctaagttagccgatcttgctttccagcaattgttaactccgtttaaggaaagatttttggctcaa

SEQ ID NO: 88314 - DNA, 5630 bp, Oryza sativa
tttttggtaacacttggttgactacagccgctgcatatataagaaacagtaggaaatgtgtttttccggcacaaacataagaagactttgggaaacagtgtgcagcgaatagatatagcaccaattataagagtataagttctggcgatatttgattagaacgtgcatatcgtacagacaccacatactatttatacgaattcatttatcgttctgctagccactagggctcgcaagcctgtaagacgtagaagtaatgtcatttggtctaatggcttgcacaaaagaacacatcccctatttatattcccactgcaaaatacattgggcaaaatatgtgagcattagtcttgcttgatcagggacaggagtatacgccttggcatgccaggtgcaaaagaccgctttggtggggtgatattatatggagccctcaagtcctaaagggcaaaatgtaatgtacagtcagtttttctataacaaatgagcacacaggtaatatatagttggctaacaacgtttacttacattttgggggctgcgggggcagtttgtctacgaacagcgcacgcacaactgatgctttctgacaatcatgttcacgaggagatgaactacagatgcaatttgtttgagccatgagaaaactcaaagaaaaaaaataaggaacgtaaatatgaaactgtgcattgtcacttacccttcctgagcaagatcctcatcaattacagaagatttatgttttttgtctggttgtgccatagccaggacctgataaagcattagtggtcagttaggtttgataagggacagacatacatatttgctctaagtacagaatatagtgctagcctctgaagtaggcggtgttgtcccatgctgatcatcacggttatcagttgtggcctatgcataagcaatatttatataagaatttccaattgtttatatgcaagagagtacacattgctggagaatgaagctattagattatacctttggttctgaaagcaccagtggtgtagaaggtgttcatagattgaagagaagagccaattatcgtgtgcggttcaaattgcatcaagttggtgatgagcccatgttgagaagattgccccagaagcatcatggctgggcagagtacttgtgtgggctgcatctagtgaggcaagcataagagaatccacttggtaagatatccaatttctttgcaatgagccacgtgacacactagttctaatgacatattgttttccaaaaactgctttgatttctgatggaactatatctcgtgctccttggacagatgcaaccaggttaagaaaagggatgccaatcaactggtagccaatttctccaaagaaggtaaactcagctgttttggcgtcatggttcgtctaatgggtcgacacctatgatagccactctgtacctattatagaaggtagcagaagtaggtcttatgttctatagctcaaattgtagcatactgaatggtttattatgtaaaataattgagaagagctgaacgtgtgtaggtggtaagagtaccttgtttcaattgcattagtgatgcacctcgagcatttatatgtgttcccttctctacctgctcctctcttactggtgttgcatgctatgtaccaccaggcttcagcagggactaaatccttgatggctatcttgacaatatagctgttgccctagttcacatgcgagaaacagaagaagtaaaggatggcactgataacacatggatggaaattatgcaatgtaatcattaaatgtggggaggtacactatattaccaaggcttcgtggggattaaggtcacaaatatcaaaaacttttacatgcacagcttctttctgaccaaagttcggctctattgcccttaccacctgtgggttaccatggaggcttcaaatatgaaacaaattaatgttttggtttgtaggctagggaaatatggttgatccatataacagataaactaaggaagatataagttgaacaaagaagaagcatgtttatgtgaatggaaagagtgcagaaacagatacctgcttatgagagaaattgtttcctagattggtgcattgggataccacctacaaacagtgctaccttgtagggctagctggtctggcaagcatgaaagagtacattatttaagcaagaacaggcaaatatgtaaatgggagaggtgataatagggtaagaatttatttcttaccgtctcggaatttaacagttaatccaacaaacaatataacaacaggtccatggtctggttgctgctgtaagttttcagcgtggaactgtgtagcatgggcaccccacaatgcaacgacagcagtttcgctgtaggcacatagaagaatgaagaggtggaaaataatgtgcatgaattaagctagtattcacatttgcaaataagagagttgtgaaacaatgttgatattataaacaaaaaagaaggattgtacatgtgtaaaaagaaactgacaatgcatgtgcggacaattaagtcattttgtatctaatacaaaagcagctggaacaattagcggattaacgcatacataccttccattggttatgtggacattaagcaccgctttcataacacctccacaagaaacagtttgcactggtccaatggctgtcattatacctatagcatctacaggagtagtataagggataaaatttgcacatgagtaagtgagagcagtaagcagggaatggacaaagctaataaggaatgagatagattgatctggaccaaacagagtcacctgaaagaatatctttcctgtaagcacgacctctgagttcatcaaaagaaagaaccttgtaagcatgagatgggaatgtggatggtgcctcagtgtcttctctaacggttgtgtgggcagtgaattttgccatgaccatccgatcaataggcctgtactgggggcgcgcctcagcaacttcgaagtacttgatgtaatacacagcatcctccttcagcaaaggcttgaattgagaaacatgacgtcctgggatctgcgcatccatcatgtacccttgttgatgtttggatgtgtaagagacaaatagcatggaggtaaaataaggcatgaccatgtgcttattgctatacctgctcatcaagcaggactaaatcaagtcgcagaatcttgtcaggttcatttgctgtagtgaactgcgagaagcgcgtgacccgcactcggacttgccaatggtgtgattcctgtgtcacattccttagcatagtgtaatccatctgcaacacataaagaaggcattacataggttagagggaaactataataataataatactttgcatgatatgaagatataaagtcctaattgttgaaggaactgtggtgcaggatatatctttttctttttcgaggtgggaaatgtttcccaactgacagtgtttcaagcaggcatgtttaaaagcaactgattgcatccaagagaagaatttgcaaaaataagaaagaacaattaataagcagatatggaagacactgcaacaatcaactggtcaaataggaagaacacaagtatgaacaacaactcattgaagggtaaaaagaaagcagtaacaaatagcgaaaaccaaaaatatggatagtcattgtggatagaacactgtatgaccatgagttcttgcttaagttacacaagcaaacagtaacacggagaaatgggatcatagaagaaacaggtgaacaaaaggagcaaagtttcctagccgcagtcacagtgacaaactgacaataagattaatctatagcaacgataatatttcagtgtagacgatgttcctggtagtggaacaaggcttgccatcatcatcctctatcaacaacttgaggccttgcttcgatgtagcgcgcgaaacagcgacatatagctgaccatgtgtgaagacagggtttctgaggtatacaccaacattccccaaagtttgcccttggcatttgtttattgtcattgcataacatagcctaattgggaactgccttcgctggagcgtgaaaggccactttggactgttcccacttaggacaatccatggaatacagaccagctggccaatatttgtgccagtcatgattttggactcgaaaacataatcactgagtcggatgaccatcaatcttgtctcattgcaaaggccgagtgattggttaatgttgcgaagcaggactacagctgaaccaattttgagggatatgcgatgttcctggaaattgtttatggatattgagtttagaaattctatggggtacaatagatcaaaatctacaggcttttcaagtgtatttgaaatagtgtcgctgctaagatagtcctttgcatccccaggcactttagcaagcatattatcattaatctcatcaacaactgtattgacaggacagacaattgcacgctgagaaaggtaaggaatgcagtcatagttcgattcaaaatctgggtacacagcatcaattatagctgtaatctgtcaccgcagggagtaagcagcaactccttaggtatctctatccatgtcctctcaacctcaccttgtcttttgttcatgggagcacgaccctcaccaatgtcaagaacccatttagcaaactctgccaattcacccctggcttgctgcgacagggatggattatgtagcctcatgttagtggtaaggtgtaagacttcaacatgcttccatagtgcagacctaaccagcgaagcatctaccacatcagctcttgtacctttctcaatcaccggtaagacttgcctaaaatcaccaccaagtaaaatgggtttacctccaaaaggcttatattcattagctggttcatcagcggattgaatatctcgtagagttctatccaatgcctcaaagcacagcttgtgtgtcataggcgcctcatcccatataatcaatgatgctttcctaataagatctcctaggattgtccctctacgaatagcacacatcgaccgatcatgtatatctataggtatccgaaaccatgaatgagcaatccttccaccaggcatgagtagagctgcaaccccagaagaggcaactgcaagaacaatttcacctcttgatctcaggtttgccataatagcattccacaagaatgtcttccccgttccaccatgtccagatataaaaaaaaatacacttttcgtgatggtctatcctgtcaaaaatcttgtcatatatcatcttctggtcattgttcaagctggcatacatggacaaagattcttgatggaggctatgttggttaaagctaagatcttctaagataagcctgtttgctgcactggatcctgaacaatcaactggtgttggcaaattgtatgatgagattgataagccattatttgagaacatggcatccaactctttgagcaaggtatcctgcaacataacttctggaatagctgtgcgctgtactccaagagctttggttaacttgtaagcaaaatcatctaccatgtatctccagtacttatcaaacaaaaccctaacatcacctacatcacagtgtgctagtacagtcatgaaaaggttcctgagctggtatgaagta

SEQ ID NO: 88315 - DNA, 1696 bp, Oryza sativa
aaacaaaaccagggctcgcatcattgctctggaccagcctgatcggctaacgcaccatcggcttgtcgcacatcaaaaccttcctgctagcatacgggccttctgcggtgtcacgcatgatggatcgccatcccatggcggttgttatctctttgacatcctgtacaacttgttttaggtcacgaatgtaagccctaccgcctggtctgagtattcgatccatctccagcaagatacttgagatgttacatctggtaacaacagagatactacagttagacgcactgtttatccagaactcagtggtatctttagcagcatagtcaagaacgtagaaaggaatgagcatgaatactatttttgtatcttgcaatgtatcgataaagcatgagatcacctgttcagctatttttatagtcacattgttggggcacataagtgtggatatttctttaggcacacaggtgtttgggagaaaaataaacaggaacataactcgaatttaattatcaaaagaactgctaccttttctgttccttcgagaataggctaaacgcatggagcagatcatatgtccttggatatgtatcaaatggttcacacctgtcgataaggaaggcacaaaaatggcagcatgagcaatatttaaaggtaaaattttgtagatttagtttaataacaccaaatatctaatcaccactgcttagaaacaaacattgatatctaaataaacaagaaacacgtcaatgagaagcattataatcaaactgttgaccactggagttcaagttcgacaagaacacggggcaaggagaaagaagatgcaagtgaccactattcactagtatgctctattaagaacattacgggttgcagtacaatataattcaggaggaacatttataaattataaatagaaccaaaaccctaataagagagccacagaatataaaaatgcataccagtcatgagccactccaagaagtccccggtcatagattacaggcagtgtgtttggctcactaacaggaacaacattcatcacccagcaatcaagtttacgattaatcaatgcagctgcaaacctgcataaaaaattagcaagcaaaatgagatattgcgcaaaacagaatatatcacgcaccaaacagaaaataagtccaatttattttgtctttgtgagaacctctgtaacctagtatagtagtgtcagagcagaaggttactacggttgaaataactaagtggcatagaatctatgtacaataagtgtccaaagaaaacagatgacatattactaatatcaacttatcaacgacataagcagatttgtgatccactagacctccaagtcattgtatatattttatcaacatctgtacttaaaggcatggaaatcggatactaatcaatgtctgaggtaatttgaaatggaaagagaatggacagagtgaagaaaaggccttaaagaaagataaaataccctccaaatccagccctcatgtccaatacattccggagtttgaactttctccacttaaaaacacgaatataaccttcaacaatgtcatcccaaaatttggtttctgctttgaaaagctccttctttgatgagtgtgcatccatttcaacaccttcaagcctttttgagtggctccattaaacgtgcaggccatggaaagggagtcagcccatc

SEQ ID NO: 88316 - DNA, 5901 bp, Oryza sativa
tactccgatggcgtattctgaaagtagcacgaattgggtggcatatcctgaaagtagtgcgaattcgatcgcatattctgaaaattctcccgagcaggaggcccaaacacatacatccagcagataaaagacgaatggatgtttggcaaatttacttcccgaagttcgaattgctcgcgataacaagcaaagtcgtatatgagacaacccggtttccctcgcgtccttctcccgtcttggggtcttggcgttcgtgcgacagtgagtgaatgagtgtctgtatgcgcacgctgcgcctgcgcgcttggtcatcgagatttaaggcaatctatcgaacacctgacgtgccgtgatcgcgcaatcccagtatcccactacggcatcatcatagatactacaggtcgttcatgctcaaggtccccgccttctcccagcgctaggcttctgcgtcaccgtgctcgagaatcatggcgattcctcctcctccggcgaaacgaataacgagtgaccggtgacgctgatctgtagttgcgctctgcttcctactttcctagtcaggattgaatccagtcaaggaatgatcttcggcttaaggaaaatacggtcaagctctttcgttttcagtaaccaacctctttgtctagttactttgtacccggctatggtcaatgagaattcagtgccaaactgccaatcagaaaccaagctgttgggctgaaggattatgtttctcttttaaacatagcacaagaacgtatagataactgaaaacacaaccgaagcgcagaacattgcagtgctaagactgaagtatatagacagtcagacagagcagtaagacggatgtcaacatgtttaactctaggaagacaagtatacaaggcaaaattttgttgacaactgtacaatgagatcaaaacagtttattgttttccaagatcagttcttaatcttagatttatatgctttccatgcttgtccacatgcctgaatatttgctgacgcttgatttaagaacttggcaatgttttcttcatatttatccaccaatgcagggatggtgagagcaagaacaaggcctgggagatagaaagttcagcaaagtcagcattgatcagtaagatgatactaaagatcaatacatcacatttgttattgtgcctcctttaaaaatatatgatattctatactgattggaatggctccaccacaaatttcagaagagttccttgacttctcccaaatttttgtactaaattggctgcacataatgctactgttaactaggcagataacagagatcccctttgccaagtcaatgtccctatctttgagaccaacttttggaaatgaataattttcacctattaagtaatagctcacaaataatttcggactgttattaaatgtaattactcagggtggttttaactagacatgaatatgacacagaccaataaatttcaacataacatttatttctatatgttctgcatgatatttctacaggagtctttttgctgtaagtttcaagttttgacacaattctcagaaaactaatgaaagtgcatatcatcactgcattgcacattacatcctactataaagttcttaacaacaataggtgagtagtgataattagttagaattgagaaacagtaaaagaacttacatgcatataccaaagtaatgagatcagtcacacggccaactatggagatcagcagtaatactgaaaccatcttgtaaaagagactggagtcctttccgtgtgcaatgttttcaaaaccctgtagtgccttatgtaggatgttacccactgctgctgctgctttgctcattgagtcttcagatattttgatcagtggaacaggtggaggtggcctgcatcgaatttttgtatgcctttagagtcagcattcagcaactagaagtcatggattagatcctcctgcacttaaacgtggaattttcatatcgcttgtttccattgttcagttttgagcatcaatcaaagcatcagtcggagcagctgtagtttataattggatgggccgctttcgttctgatgcaatggcattagctatgatgaacatatcagggcattgatcgagcaagataatttgctgcattgctgctcactctcttccaatttatatcatccacattagtttttacaccatgatcatttatccaccgactaccagtacattcacactcacaagtattaaatgtcaaagcttaatcaatccaagggccaaggccaaacaaatgatatccactccttgtatcaatagcaagtgtaacaactaacaacaaaagcaagtcatctaagggctaagtcgaattcagcaatttgtacaataataatctgaactaaatcacactagtgcatcaacaatttggaggcaaataaatcacattactgcaaataaactgcaaacaaaaaaaatccacctgttgagcagccgcgcggccttggcccagacgaagaggacgacgagcacgatcatgagcacgctggacacgaaggagagcagcgtgtagccaggcaagcaatagaagaggacccaggacgccgccaccgccgccagcgaccagccggccacctccttcctcctccacagcaccacatccgccactgcggcgcccacaaaacccaccacatcacaaaacgcaaaatgcaaacgaagccgcgcaaccacagcccgcaggggaggcgatctacggcgggcgaactgaagaagataactgagcttagctcactggcgccgccgccgaggaggccgtgcagcgatctctgggcgccgagcagccggcaaccttggtcagaggcatccattgccttgctgggtggatgaatggatctctctgatcgggggagaccgatcgggagttcagctggtggaaaggggagaaaagcgcacggcaagaacagcggcgtgatgcagaagtggtatctgctgaatcccccgcatactccaactcctcgagctttagtttggaaattgctgggtgacgaagaaaaagaaaaagaaaagtatgaaaaaggccaaggagaaaaaggcgcaagcgtggggcaccgccacgccacgtcatcagcaccgtgtcctattgaactttggggggtctttccgttccctacttcccttggctgtggcgctacagcagcctagactgttggtgtagctgcagcaacaacacaccatcttataccataatctctgcgtttcaaaataaaccagttttaagatttaaaatttatctcaaaataaatcaacttctacctaactaccattggtccgcaaattaaaaatttttatctcttcaaaaccccttacttaactattcagtaatataactttcctatttattaggggcattttgatcctttatctctttccttgtatctaccttgtgaagctagagttggacattttgtgggacagagggagtagttgctataagtacgattgttcacatacaatactatgactaacgttttccagcgaaagcccatagcctttttcaactgatttgtagcgatacaatatatgacgttcaccatcagtgatcagttaagaattgtactagtatttacatagaagtagcatgcatagtattttcgtatatcaatctcaagttctcaccgaacaccgctaggatgacggaaattcctgcacagcagtattgttccttaaaagaaatgctgtttttatcgttatataattttttatcagcgtcagactgaagtaaccattagatagttaaattgataaatttagaaaagatcctaatcgtattacctagaaataacaattgctaaccttcatgaaactgaaatttggagcggatttctgttaaaagtgggaccttgaatttgtgcgaagatttatgtcggcctccttgtcttctatcttcagcgagccgcaactcagacgggacacagcggccttgatcagttagggtatagggtgtgaggtcgataggagagggggaaaagagggtttctcttccccgaggtatagagggatgaccatggatgatttaggactgacgatatatggtggacacgggtggaggggcgacgctaccggcaaagtcatggggatggaaaagggtggtgggcggctaaaaccgttcatgcctttaggtgcccacaggcgaggggggcccgctagcgagctcacccctttgctatgccggagagaagaggaacaggagagaggataaggtcactgtttatgcacgaatcttgatgcaatccttggctgaaatctattcggtcacatatcaaatagactattcctagaaattatgtggtatccgaccgtttgatgagacttcgattagaagaggcacaatcgaagtgtgctaaatacagtgaaaacttcctagtagatgaaaacattggaaagcaatctataaaatgtgcataggttttcaagaaattttctaagaaaaaatacacgtttgaaaattgaaataatgccacatcatttcccaagcggaacaccaacaccaggttaaacaaaacaaacctgattttgcttgtgaaggatgacattggccgataatgtctgtcttctccgttgatccttgtcatatctcacaaacgaggccatgttttgatccacaactacatatttctcaaacaaaaatgcattcatacttgcatgaaacatactaaacatgcctgagttttgagctgctactataccatactgcagacgataacagaaaagatacaacagattcaagatcatagttgctgcagctgtaaaaggaaaaggtgtatatgcgaaagttgagatggaaaagaacgagacaaagcctccattctagtctctatgcagtttaaacataatgctacaaaagtcaagtttttaagcagggcagttcagacgatttgtatacggcattcacagatcagaaagaagttcacaatagcatcactcccccagtcaaatggagagcagttgaaatgcatcccctctttttcttttttctttttgttgtctgtatattctaatacagttccatcccgaatcatgccgtcctaatcttcttttatagattcttttccctctaaagaggtagtgttctgcttcgggttactgcctgaagcagactcaatattatcgctgttaggctcgcttgtttcagacttgttagccccttgctcctccagattgccgtctttgctcatttcacctgatgttgattcaattgcaaaagcatcctgagacctgctttcttcgtgagctgcataattagcaaatggacccccagtgtccatcaggctagcagctatagcagcatttaagtcagcttcttcctgctgtgcagcaatcatatccatttcactcatttcctctgattgatcagcaactagagagacgcctgcctgctgagtaggtgtttggacctggttacaagaggaggttatcctccgggcatcatcaggagtcagccactgcccgaaaccattagagccttccgttgccatgggacactccttaggaaaattgcccctcactgcaaagatactccagcctgaccccttcagggtgtcgatgaaagctgataggtaaaactttgatagatgctcaggagcagggtacagactattgaagttgtaccactctccatttaccttcctaatgcagaaccagtggtcctgcagatggcaaatgaaagcagtttccagctcagggtcaaataggcatgaccccacatctggggagtcaagggggataacttgcagatcccaaacttcaagtgccttctgcagaacctatagagtaagatgaaaagcatagttgagtgtatgaacttgcagcgtagtcactggaaatgagttgtaacaatatattagcttgagtaactatgcgtaaaaga

SEQ ID NO: 88317 - DNA, 621 bp, Oryza sativa
gcccgtgctccgtagcacccgttcgtcgccggcctcgctcggcgtagctccgccatatccgacgctagcaacagactcccggagtcgcgtagatgctctagctcgcccgaatcggtctcccgtcgcgccgtcgccgtttcccccttctctcgccgccggttgccgttaccacaatccgccgccgtcgagcatcccccggcaaatccgagccgttggctcgtctcccctcatcccgtgcaaccttccggtgtgctcgctttcgcctgtatcgccgtggttcgccccgccgttcgcagccaccgtccgccgtccgttcaagccagcgtcttcttcaacctcccgccggtccgcgtggcaaccacataggcaagccaccctttgaacatcttgagcctatatttgaacttaagtatgttgcttgaaaaatattatgcattgataggattgcacttaatctacatgtcccgtctgcaaggcagattggcggacctacctaacttgttgcagttgacccctccatggtaattattataccatgttcccttgtaaccacctagttacgcctcggtaatcgtgcactctgcacgaatatcgacggtcgccttcaaacttaaaatctga

SEQ ID NO: 88318 - DNA, 847 bp, Oryza sativa
  unsure (1)..(847): unsure at all n locations
ttgcgctgncgganggaattcgacagtcgcttgcancgnccgnntaanggttgagattactccaagatctgtgctaccctttataattctaatccttactttttttcacttcttccgaccaaccacatgggtgtcgttgccttctacatctttcgccccctaacttattccttctttttccctagctagatacatagtagctcgtctacttccactaccccctccatccaaaaaaaaccatcctaagtactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgact

SEQ ID NO: 88319 - DNA, 786 bp, Oryza sativa
tacatttggcggtaattaagtaaatgaagcggtatactgtatgtagcttctactccctccgtcccaaaatataagggattttggacggttgggacactttctagtacaatgaatctggacatgagtgtccagattcattgtactagaaagtggattttgggatgaggccacccttatgtggggatcctctccccctatttcttctataacattcttctttttttaaagagtctcagaagaacgggctaacaacattgctgatatttgcagacctgtcattcgtggccgaccaagctcaaaaagatcaattcatatttgcggccggcctcgatgggtttttgttgtattatttcctgccgggtaagataaagcgctggcctccatacatactattctagaccatagttttttttttataaaaaaaacaactaaataaataatgaactcaacatataatttattttatttttgcagtaagctgcttcctctggatgacctcatgtattcaccttacggctctgcgggcactaatggttggtctgcttggtgaggccaaacttgaggtttaaaattttcaaattgtgcatgtgtgcctaatatataagtttgtgccttgcaacaacctttgtttacgccagttttaaaacacctaatctgaaaacaccccctgacacatttagggagggaatttgaacatcatcgctgaattattgcgaggtttaaaacccccttttttgcctaccccatgtgagttgcctgcaaactttatcggaatttttggatata

SEQ ID NO: 88320 - DNA, 659 bp, Oryza sativa
ctgcaaattacaagtacaaggaaaattactttttctcatctggagttgacaaaaatttaaataaatgtaattcagtgctggagaaaaaaaaaatcatatgatcatctaaacagatgcagaaaaagcatttgacacaagtcaacattcttataaaaactttcaacaaattaggtatagcaggaatacttctcaatataataaaggttatatatgacaagaccacagcttacatcatacccaatgatgaaaagctgaaggctctttcctctaagaccagaaacaagacagggatgctcactctcaccactgctattcatcttagtgctggaggtcccagccggagcaattagacaagaaaaagaaaatgcattcaaattggaaaggaagttatgaaactgtctctgttttcacatgacatatatcttatatacagaaaattctaaagactctaaaaagactgttaaaactaacaaatgaattccgtaaagttgcaggatacaaaatcaacatgcaaaaatcagttgtttttctacacactaacaaggaactatccaaaaaagaaatttagaaaaccatactatttacaatagcatcaaaaataataaaatacttcggaatagatttaacaaaagaagtgaaacatttgtacactgagaact

SEQ ID NO: 88321 - DNA, 584 bp, Oryza sativa
cataatttcttgaatgtttcagaaatacaggctcagtaagaatctccaaggtcaagctaatgttgggacaacaaagaatggtaaaaacaagtttaatttccattgttaccactacaatagccacatagcaactcatggatgatgacaatttgcagcccttggatgtacaggtgttgctgataggattcctggaacaagtgcattagcgatggccagtgcaagcgccattccacaggcagagaagtaagaaatttcccatgtactttataattgtaatccatctgaatagtgaagtaatagtcccttttattgggtgcaagaactattcaaatcggtgaagcactacagatgcaaattgaggtgcagaggcagctaaatgaacaacttgaggtgaggtactgaccctgtttgcataataagatcttaacccacgataggcccataaaacataaaaagtgacagataaaaagaataagaataattctccattatctcattaaataacgtgcttgtagtgatggtaagtccatgaggctatcaaccagggcttaagccttggatgaaaaaacaataataataatttg

SEQ ID NO: 88322 - DNA, 503 bp, Oryza sativa
ttgttttcccatctgttaagaagttgagacaagcaattactgagtacagtgtaaggaatagggttgagatcaagatgcctagaaatgataggaggaggataagagctcattgtgaagaaggttgcccatggaatctttatacttcagaagacagtagagctaaagcttttgtggtgaagacttatgatgagagacatacctgtcaaaaagagtggattctcaaaaggtgcacatccaaatggttggctggaaagtatatagaagcatttagggctgatgagaaaatgagcctaactagttttgcaaagacagtgcagctgcagtggaacttgacaccatctaggagcaaattagctagagctagaaggattgcaatgaagaccatacatggagatgaggttgagcagtacaagcttttgtgggattatggcaaagaattgaggagaagcaatcctgggacttctttcttcctgaagcttgatggtagccttttcagccaatgt

SEQ ID NO: 88323 - DNA, 544 bp, Oryza sativa
atattcctcgtctttatacctcggagacgcgtgcactcgtgttttactcaggaacgatggagaggatccaaagggaagaggattcgcgcggggtggattcggactgcagggcagcgccaacttctgacggccgccacgacttcatgcgaactccgatttgggcgtgcaagtacttcatggaaagcttatcaagtctattttcaaatggatccagccacatgtccatatcttagccaagattctccaggtgttcagccatggctttgttcatgggaggaggtccgcatctcaatatctgaaaggagcaaccatacattgtcacacagatgtcctgcttggtagatggaatacacttcaactattctcttagcaattgtcggttccaagttccagaaggcacgctaccacagaagacatcacaatgtgacacctacctgaatgtcagcagcaggtgccgggcaatgggtttggatcatttccattgacacaaacccaacaccaccattccagatttctggaggctgctcatgaaaacaaagctgat

SEQ ID NO: 88324 - DNA, 528 bp, Oryza sativa
  unsure (1)..(528): unsure at all n locations
acgtcttgtttgcgaactcatnactatgggcgaattcgagctcggtacccggcccgtccaagaccacacgaatcggtggtcttctggacgacaaataggaagacgcgctcgtctccttcctgcgggcaaacgccgacgtcttcgcctggagaccggcggacatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgtgagaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagagtcgcat

SEQ ID NO: 88325 - DNA, 525 bp, Oryza sativa
  unsure (1)..(525): unsure at all n locations
gcggctttgatttgcctgctatanaaacncaagccgcacgccggcaggtcgactctagaggatcccccaattttctgttttttaggatatccatgctgaagctgtcaagaagaggcgccgcaccaccaagaagccatactctaggtcaattgttggtgcttcgttggaagtcatccaaaagaagagagctgaaaagcctgaagttcgtgatgctgctagagaagctgctcttcggtatgctctttccctgaatgattgccatttagactggttactggttccaacaaagtatccacccatggaatagaacattgccactctatatgggttacattttgccttcattttcactgcattagcccttacctcatgcggtgcctcttaacttctcaagcagtgttttcgtttgctgcctttgttctgcacagctcactgtatcattgcaacatgatgtttgctacccattcttattggatgtctgctcctagtgaactctctgttcatattcatgcataatcccctatt

SEQ ID NO: 88326 - DNA, 3509 bp, Oryza sativa
aatgcttctcttttaaccattatgcatatcagagcatcaataagcatataccttggtaaagtgtcttaacatcagctgtgattctgtaccgacagatctccgtgtcttgaacaattatggacagatcgaatcattctctgctttcagcagtatttacaacaattctggcctttttggaatacatgcaaccactgtaagtctcttttggagcataaccaatgatatgttttcccttctatattcaagcaatgaacagaatcaaatctgcttgtgaattctttcccttttttttttgaatatcattctcaaactactgtaaatataataccctttctattctaagtaatgtctgtccctcttaccacaccattacatttgtcctacctgaattctggattaatgccttatacaaacaactgtaattttatcttactgtttaaaataaggagttggtggcttatgctagtaagtagtagtaactaaaaccgaagttatattgtacctcagtaagaaatgcagaaagcactcactgaaactgagtatttagtttcttcctatgtacatcaatgctcatttcatctcgtgtacaattttgtggtttcaaatgtttcaagagggtagtaactaataaatgcacatttcaggccagtaattatgccctggtctttaattataaccatccgaacagtcagattgaaatacaagtcaaaggctcaatgatttactcaagcttctatagaagtttctgcatttatcatggattttcatacattccactttgcttttgactgtcatgttaatttaacagaacccagattttgtatcaagtgctgtggatttggcagcaagggaactccatgaagttgcaactcctggaaaaggtttctttaattttttacctcaaagttacaatctattttcagattagactggtcattatgtgttgtcctttccctgtcttttactttgttcagttacacaagaacaacttgatcgtgctaaagaggctaccaagtcttcagttctgatggacttggaatcaagagtatgttgttcttactcctgatcaagttccaatcgcatgaatttcatgcttcttccctgaaatgtttttttaattgtacttcctccttatcgcagatcgtggcctctgaagatattggaagacaggtactgacttatggtgaaaggtatgcttataagtaatcgctagtacattaatggagtcaatttcctattaatccctatgttcctaattaaatagcatatttccatgtcatgtttatatgcatggaatgcaaatctttttactaatgtgcgtaaaataatgagtcatcaccatgaactatcacaatctatgtacgcttgcgtaaattattatgtttccaagctggttgggcaatatatgttgaccatattacataggcaactaaagttgtcttgtggttttttcctgcaatcatgtcccaaagtttgacaagtcacctataatactgtgttctggacacacttactgtggttgtggtgttccttttccaaagtgatgctgtggttatggtgtggtacatgcttttttatggtatcacccaaagtattttgggtgtcagactgccagcacgtccaagcatatattcaggatttatttctatagtttcttctgcgtgcccattggtgctataaacttattgtcatcaccatgccgttgcatctagaaaaggtgcacatacatggtagaagtgagccataagttttagtaccatgagcagaggttcatacatttgacgcatgcagcagtgctaaatctgttaagctagcattttttctaagtaatccaccaattgcatagggtattaatttagatagtcacttccatttgccagagaaccttgtttatcttggagtgctttgtgttgtgcaggaaacctattgagtacttcctgaaaactgttgaggagatcactttaaatgacatttcttcaactgcaaagaagattatttcttcgccgcttacattggcatcatggggtgatggtatgtcgaaacttggaagttaaagcatggccctatgcaagctctgagagtctgagcactgactaattgaaacgctcgtgttgcagttattcatgtgcctagctacgaatctgtcaggcgcaagttccattccaagtgagcattcagcacctggacctgcgtgggttgttctggaatttcaagccgcagctttgcagtggccaaatggccatcgactggaataaatagagcccatacacaatttttgctggacagatgaggggtgcatgatcaactaccctccctattcatgttctcaactaagcatgtgatcatgctgccacaattccgcggcccctaaatcattcggcggcatgctgcgttttgttcagtggcatgctgcgtttttgttcagacgcacgccaatatcgtccttcctgttttacattttaatatagaatcagatgttatggcctcatggttaagccatttgcctattcatcggtgtcaggtgttttttttattagcgtgtttgcccatttgtaccaacaagctgtaaacatatacgagtaaaaagagtatttctatttgtcagtctgtgtgttgcgtacttgcgtatggagcttagtcagccaacttcccggattaatagcggaacacaaatttgatttcccctcggaaatgaaaaactgtatgtatatttggtagtaacgttttggaatttgagaatgcaaacaagatgaaaacaaactctgagtttataatcccctcatccgccgcctattgtgctgtttcgtaagcaaaggtcaataaatgatctgtctacatgggatctgcagctttcgtttcctgcggcgcaagccagttacgcgacgccgggaattgactcggctttgcttctggacgtggacgacatggcgggcggcgatgcggtatggggccggccgaccgtgccctcttcctaaaaccagcatacgtatgcctgtcagcctgtgggcgacggcactgggatttgattttactgaatttatcctgcctgattccaggtggttgatccgtagagctaatttttcttttcctaagatatgcatacaccgggtgcaaattcgaagcacaccagaacgtgattcacaatcacagctaaaatatcattttcacgtatgacataccgataccgtattttttttcttttcctaagatactctctttaaatttaactcaattctcttgtagagggattaaatgaaggcctaaagaaacaggtaaatagatagacctaaaggccatctcgcacgggatggcactggcagcgcatgatgtgcatccatgcgaatcggatgctgctcgacggctactcgccgtgcccaccgccgtttgccaaaccgcagcgtaaaccaaaccaatgcccgtaatcccatcaggggggacaggtttccacggcgtcaaacttagcccaaactcggaaaaaccgccacgcgcggctcacaaaaccagcgccg

SEQ ID NO: 88327 - DNA, 618 bp, Oryza sativa
tcccgccgcggcggggccggggtcgtccgccgcggcggcggccagggggtccactccgcgcgccacgccgtgtcctccgcgtccagctccgggcacatctccatcaccgtcccgcgggtcatcttcgtcgcggacgactccgactccccgggctcctcgtcccgcggcggcgccgggggcggcgcggcgtcgtcgcccgtcgggctcgaccccgcggtgatcgcctcgtaccccaaggtgcccttctctagggcggcgacgggggcggacgccgaggccgcgtgctcgatctgcctctgcgagtacaaggaaggggagatgcagcgcatgatgcccgagtgcaggcacaggttccacctcatgtgcctggacgcgtggctgcggcggagcgcgtcgtgcccggtctgccggtcctcgcccatccccactccagtctccactccgctcgccaccccgctgtcggagctcgtcccgctatcacagtacgccgccgaccgccggcgccacaggtgacggaattgggtgcatcatgtcttctcttctatattcgttttctggcaccattttctactggttatcaacgatgggatggtgtatccattgttttattgttcagat

SEQ ID NO: 88328 - DNA, 621 bp, Oryza sativa
ttcctgcagccctccggcacgccgcgaccgccgcgtgctggacccactgcgggtggaactccctcctgtaggccaccaggcctgtgccttcatgctgtgcaagaaccccgacgcaaaccagaggttcaacaccgggttcggggatgacgactgctacttcggtgggctgatggacggcacaagaatgagcggccggagctatacaacccacgaactatctccaacatctgcacctactggaacgcgccctggctgccgaaacaaaggaacacgacgctccgccacagctgggcgtacacccacgcaaggcacgcgtgcctctcgccggcgatccttgatttcctgcctgagtcgaccagcggcccaatgcaatacaccctcgacgagggcttgtcaggaacgcagactccggcggcaagcgctttcatggccttgggctgcagacactcgaagctgttcaccagcacgcccttcgcttgcgtcatccgcttgaatggatacaacctaaccttggtcgcctcgctatccttgtcccgcaacatcgccggcatgtcgacagtgcagatcggcggcatcccgggaaagcggaggagcgcccgcccttgcccatctccataaatg

SEQ ID NO: 88329 - DNA, 538 bp, Oryza sativa
caaatgccacttcagaagacccagcctccttgatggcatctaacgccatgtccctcgtctccaccagcctctccctgagcttcctcccttcctcggcctccatcaccagcctcaccttagcctccacttcctcggccttcaccaaccctccttcctcgtacccgtcaagcgacacggcgatcttcatttcctccaccatgatcaccttgttcatcgcctgctccgcgtacagcggccagcatatcatcggcagcgccgacatgatcgcctccagcgtcgagttccacccgcagtgcgtcacgaacgcgcctaccgcctcgtgctgcaccacctccgcctgtggcacccagttcttgaccaccatgcctctgcccttcgtcctctccaagaaccccgccggaagcagccgctccaggtcgggctccggtgatgtggactgctcctccggtgggctcctaacgtccacaggaatcggcggccggagctctccagcccatgagctaactccttcagctgcgccgccgggaacgcgccctgg

SEQ ID NO: 88330 - DNA, 802 bp, Oryza sativa
tatgacttgctgagtacagtgggtagtactcagtcttgctctcttttcccccacaccagagttgaagtccttcccagttgaagatgtctcgaagaggttggtttcgtcgctgccgtcaaggattgcctgtggaatggagtcgcccgctgcaggagtcaagtcttcaggcttagctcgcttttatctttttccgctgcatttgtaatcttttatatttttgtaagacgtggatctgtatgtcaacaattgtcgtttgtgtaccctggctggtcctggacaggggtttaatgcacaatcagcttagaaattctggttcgtgaatttctgggcgtgacacgccgcctcccgccggccgcgctggcttggccgccctcgggcgcgtcgagtggctgccgtgtggggcccggccgtaagccgcccgcgccctcgggtgcggctgacgcgtgggacccacggcgccggccggtgtgagccgggtgcacccggtccaccgtggaccgtgaggctgccgcgtgggccccactcccgtggacccggtccgcgcgccctctcccctcggctgacgcaataattccgattttaaattaaaatttaaatgaagaaattcgcaaatattcaattaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttctgttggtcgtgtagacgctgca

SEQ ID NO: 88331 - DNA, 813 bp, Oryza sativa
aacttcttttccttcgtgcttattattcgcttgatattcgtggggtatccagatggtacctttatactctccaagcattcaaacatactttccttctctgccttgctaagagtgtagctggctggactcaagtaatggcttcctttctcctttggttccaggtgaaggtcgccgcgttgttccatatgcttcagatcattacgtgcttccagtgtatctttcgactttccgtgtacacctaggaagccaagaaggtttacgcaaaggttcttagtgaggtgcatcacgtcgattgcgtggcgtacgtccaagaattcccaatagggtaactcccaaaatatagagttctttttccacatcgccgcgtgaccatcttcgctctctatagactggcttccaggcccctttccgaacactacttttagatctttaaccatagcaaacactgttttcccgttgcgatgtttaggcttcgtacggtggtcagccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgattggtacgaacagcagtgctcgtatgttaaactactcctgtttgtcctcgtggcacacggggacaccttacttcttccacaacatcttaagatctttgaccagtggtcataagtatacatcgatgtcgttacca

SEQ ID NO: 88332 - DNA, 934 bp, Oryza sativa
cccccaccattttttattaatttgtgcgaaactgatgcccatacctaatttagtaccattctggaacttccttcgctataaaaagtatattggtagcaaactaaacataaatcctatcttactgtaaagttatcccttactaactccttaagcttgacatgtaaagatgccacatcattatccactaacaagatgccacatcatcatccactaacaatcatcacatttaaacatcatgtaaacatgctatatctttatagtttttataatttaaaagctttttaaatataaacatgttaaattatcattcaacataattcacataatgttttaatgtatatctttattatgttttaagatatcctatatacttatatagttcatcctcacttagttagtacttaaatgattaatctatggttcaaattatatttctcctttttgctctaattaagtcatatcacatcaattatttttggaaaaagtacgaattacccccccgaactatcacggtcgtccgaattacccccctgaacccgaaaaccggacattcttcacccccaactatgcaaaccggacgaattacccccctcgacccaatctgcggttgttttagtctacgtggcgtacacgtgtcagtccagtcagcattctatttattaaaaaattatgggaccacttgtcatactctcatccactcttcctctccctctctcactctctctctctctcttctctctctcactcttcctctctctctcacaaacggcaggccgcaggcgggggacagagcatcggcggcggcggccgcgacggcaagtgggggacagagcggcggcggcggcgcgtcgccaacgcggtacgtgatgaccaacttcggcaacttccagctcctggcctgggacaagagctcgttggagtggatcaccttcag

SEQ ID NO: 88333 - DNA, 566 bp, Oryza sativa
tcctgcagccctcgttgaatcgggtcaattgctaggatgaagaggtagggcgagaggggatcaccctgccaaaggcctcacctgtgtgtagttggttctcccactatcccattgagtaagattctagatgatgcagtcgataggagaagcacaatccaatttctccagcgctgactaaagcctctccactgcagcatttcgacaaggtattcccaagatatcgaatcaaatgcctttgttatatccaacttgaagaagagggatggtttccgttgcatgtgcaaggaccggatcatgttgcgcacatagaggaagtaaatcttgtatgcatctcttcttgatgaaagcactttgggcatgcgagaccaaatcaccaagccatgctgccagtctcattgccaaagttttggatataagcttcgccacagagtggatcagactaatgggtctgaaatcattcaccgagcgtggcgagtctttcttcggcaacagtgttatcatggccctgtttatgcttccaaagttcccccctgtgaggttgtgaaagcttgcaaaaacatccacaa

SEQ ID NO: 88334 - DNA, 1047 bp, Oryza sativa
tcactatatatgtagatcatccagagccactggagccaccagctgggcctgcaccaccaccgcctcagccacttaagctgactaagaaggagcagaagaaactcagaacacaaaggcgccttgctaaagagaaagacaggcaagaaatgatcaggcaaggcctcttggagccaccaaagcccaaggtcaagatgagcaatcttatgaaagtactaggagctgaagctacacaggatccaacacgtatggagttggaaatacggactgctgctgcagagcgtgagcaggctcatgtagatcgcaacattgctcgcaagctcactccatcagagcgccgtgaaaagaaagagaggaagctttttgaagatcctaacacattggagactatagtttgtgtgtacagaatcagagacctgtcacatccgcagacacgttttaaggtggatgtaaatgcacaagagaaccgtcttactggtgctgcagtcattgcggatgggatcagtgttgttgtcgttgaaggagggaagaagtcaatcaaaaggtacaataagctgatgctgaaccgtattgactgggctgctgcggttgatgatgatgatgatgctgatgaggaatcagacaagcctgtgaatagctgtgcattggtctggcaggggagtgtggcaaaaccctgctttaccaggttcagtgtacacaattgccgtagtgaggctgctgccaagaaggtgtttgcagatgcttcagttccacactactgggacctggctgtcaatttctcagaagattcatcttgagctgagcttctgttcagaacatggaggcgcctgctgttgaaacccctgcctagggattacgatgttcaattctcatgcagtaagtgatgagtagtagctaatttctcaccgtgggtaagtgtcctcttcaagttacgtacaagccttattacttgctctggaagcatttgtggactgagtaatacttcgtactgtcatgaacatacccttgtaagggactgctgatcttttcgatgcgggatttactcatgtg

SEQ ID NO: 88335 - DNA, 1473 bp, Oryza sativa
gggttaacagccaacccagtaagtaaagaaagagccaatgggtcctgatcataaccatgaaggatatcttgcaaccagactggagaacaagttgagattcctaaaaattcagaggtttcctcaggaacatgtcgagacaatgcatcagcagcagcattatgtttacccttcctgtaaacaatctgaaattgtaatcccgaaagcttggtaaatgctttctgctgccaaggggtgtggagccgctgttcagtgaggtgcatcaagctatgatggtctgtaatgatcaagaattcttgaaactgcaaatatggccgccaatgatcaactgccatcatgattgctaaacattctttctcataagtggaaagaccttgagttctaggaccaagagccttactaacaaaagcaacagggtgctgattttgagataaaacagcccctatgccaatgtcactagcatctgtttcaatggtgaaaccttgctggaagttagggagagccaatactggagttgaagtaagggcatgttttaaagcttgaaaagcttggttcacttcagctgaccaaacaaaaggggcatccttcttgagcaactgtgtcaagggtttgctgagagtaccaaaatctttaacaaatttcctataatatccggccaaccccaaaaaacccctgagtttcttgagtgtagtaggtactgcccaatcaacaatgctttgtatcttagaaggatcagttgagactccttgaccactgataatatgccccaaataagaaatctgagtttgagcaaagtcacacttactcagtttaaccttccactgatgagtgtctaacaactgcagaacttgtttgaggtggtctagatgagaattcatatcagggctatatatcaaaatatcatcaaaaaagaccagggcacatttccttaacaagggtctcaaggtatcattcatagcaccttgaaacgtagcaggggctccagtgagaccgaatgacatgactttatactcatagtgaccactgtgtgtttgaaaggcagttttaaattcttcaccctcagccattctaatttggtgatatccagctcgtaaatccaatttagaaaaaatcttagctccagctaattcatccagtaactcatcaattattggcattgggtaggttcccttcttagtaatggcattcaactgtctgtaatcgatacatactctccaagagccatccttctttttaaccaatagggcaggagaagagaagggactggaactatgttgtataatgccattctgcaacatttctttaacttgtctttcgatttcatccttttgagctggggtatgacgatatggacgaatgaacactgccttggatccaggaagtaaggaatcttgtgatcacacaacctcttaggtggtaattcagtaggttcctgaaagacagactgaaactcatccagtagtggctgcacatgtg

SEQ ID NO: 88336 - DNA, 1340 bp, Oryza sativa
ttccttgaacttaaagtggaagcaactggaggaccatttccatgggcttgagcagtcgctcaagaaaaagtttgatgatctgaaaaggcaggaagaggagttcgaggagacggttgcaaagtcagagcagatgctggagcaacaagaggctgttgtcgtggcaaaggaactgacttctcttgaaaaactgcagcagaaaagggatgccgcgttggctgtgatctttggcaagtccaagctgaacttgtctacgcctcttatcaacccaatcagcaaatccgtgaataacaatgctgtgtttaatggaaacatcggtggtagtctttctgttaagtggcccaaacctgcaactgcgcatggtgcatacctgcaagatgaaaacactgctgtgaagcctcgttctcaacttgttgtcctctgtgaagagatgaatgttaacgggcttcataagttcatatcagacaatcgcaaagacttaacatccatccgtgaggaaatccccgttgcacttaggggagcaactgatccatatggcttggtgttagcttctctagaagacttctattttggagacaatcttatattggatggcaaaaaggatggaaaccttctgggtgtacgcaggacgtgcctcatgttgatggaatcaaaagctcagctgcaaactgatgctactactggtttcatatcggaaggtcaagtgcttactgcaagtatcaagaagcgtgcaaaaaagattgctcttgagtggaaatccaagttggatagccttgactttgatgctagcaatgggaactgcctggaagcacatgcgtttcttcaactcctggctacctttggtatatttgctgaatttgcacaagatgagctgtgtaagctacttccctcagtcagtcgtcgtcgtcagacacctgagctttgtagaatacttggattgtcccagaacatgccaggtcagtgctatcatcgattaataatgcagcttgttccattgagcatcaataataaatggaattttctatttctctttgtcactcagatgtttagagaacacattctgaccacttcaataattgttcatatatctatatatctataccatgggatttattttctagttagtggctgcagcaagagatgcctacaagtaatcagaattgtagcattgctgtttagataatttgtatggaaaatctgcaggctgctacttataatttggcagccgcacaccgaacctcactatctagtatctgtattgtacttagtggcagcaaagtttccacagcttctaagctatgttatatgctcagttgaggtcttaatttaactgaatgtattta

SEQ ID NO: 88337 - DNA, 1460 bp, Oryza sativa
  unsure (1)..(1460): unsure at all n locations
ggttcggaagaaacattcgtcacaaggtacctcacctgtgacggtccgacgtttgcgagtccgtcacaggtgaggttacctgtgacgaatgtttcttccgaaccgtcactgatgagttaattccagaaaaaaaataaatgctaaatatggctagcccaggaattgcagccatgcgtttgnctttgaaaaaacaagaaacatcacaggtgccagtcacccccctccatatcacatattccccaactgcccaacatcacagatgcatcacatatcacagatccatcacaaagcaacaatttacaacatcacatatgcaacaatttaatttattatagcacacaattcataccccatgaaagtcctcaaatgattaccaaaatttcttgtattctgttcgttgtgaacctacacaacctgtcaataagggaaaaaaaaaaggagaaaacagatgaatagtacaacataaatcgtagttgatcaaatgtgatgacaatttagtaaagtaccataaatattgcacatatgaaagtaaattacattgcactctataaaaacataattttttacatcgccagaaattataaaaacatcttttttacatcacaataaattatctagccaagttcatgagtctatttggcatgaaaacgtcctttcttattcattatttctgcaagaataaaggcgcacacttcgcctctgatagcgggggggttgatgggtgagatcttgaagccagctctacctttctgtttaataaataagaggttaattagcacgttttgaatagcaatgtagatattgaaatgagcttattcgccattagcaacaacctcagggtcgaaatctttcacctctcttagaagtgttgacatgttgtggcacacgtggaaaccacattggtctccgatctgttgtgcgcatgcaaacttggtgtcatgataaagttcgttcttgccctccttgtgcctaccacccttttccacatatgggccccaagccatatttaaggccttggtgatttcactgaaatcataatcaaaggacttattggaattaaggtaggtaaccctactccacttaggtacgatgactaggagaatccaatgtcgcctgcgtagtggttatgtagcgttagtactaagaaccttaacttcaaaaacaatatacacgaagggtattgtcctcttactcttggttgtgtgcgcacatgatgtactccttgtcttgatgggcccataaacaccggttgacatagtcaaccacctcagtgaagctctgtcgtaaattaacctcattcaccatggatggatcaaggaacccaacctgattaccatggcgacgactctcgatccaacacaaccttaaaatatttacgtattagaactaatttaattaggagatatagtccagtcatatcacaagtataaaggtatgcacttacaaggagtagcatttta

SEQ ID NO: 88338 - DNA, 562 bp, Oryza sativa
gttaaaagctagtacatagttaggaaagagcacattacgctctctccatcagtggatatatggtacctggtactgaacctgatagccattaccataatatgttgtgtgggcaggtgagatgccatagggagctgagcttatcattgtgggatggtgatgggcctcagcaccatacacatactgcctctcgtaagggtaggaatgcctctgcggcggagcagcctggtagaagcttttgtcaggaaagctagtatgtggcgcatatacggatccattggcacgaggcctcttagactgtggctttgcagcttcaacagccctcctcttgtctgccttagctttctctagctggataactcttttctgaagcaggtcaatcggatatttctcatcaagtttgtgctcctcgatacacttaatagcagctttcaaggcagacagctctcgttcattcatttcattctgaataatatggtaattcatcagatatactacaatcacaattaattaggaatgcacgcagatatgcttaaaaatgtacagaccagcaagaagagaaaat

SEQ ID NO: 88339 - DNA, 2262 bp, Oryza sativa
  unsure (1)..(2262): unsure at all n locations
ggagcccagggatcgagcccacgacgacgggaaaaactcgggaaagtttaggatttcgccggaaaaaggaaagattgaaccacgaaattggaaaggatttccatagaaacttttggggatttcttggggaaaaggaagaggagattgagaggattccattcccgcaactaatttggaaaaaggagcaacgaggtggccggatttcggaaggggatcggcgacactgtgcacggcacgggagacagtcggctggaggaggaagatggagtactgtagcgccaggaaggtcaaacagacttttttgcgggctgagaggaagggagggaatgggctgaattcggcccaactgatgaggaggacttttattacttttccaaataaattaaccaatgagatgatctttcaattattaaaaatacttccaatgctcaaataattccaagaaaaatcttgaacatacttggacactcaaagtatttaatataataatatccagatcatttaatgattaatttattatttaaataattgctaaactgttctttgtattattaaaattaagaattgagctctgaaaaatccgagaaaattccaaagagtatagttaatcatggagaatttaataaaaattaaatccaaccatgctttatatttaggaaattttatttcccacatttaacttcacttgtaaattaatgaacttttaatataaattctattaataatttattaaataatttataaatcctgaaacggaaattcaggctatggcagtaattaagagttcccgaatttaccaagtttagtggtgaagatggtaggaccacatgggagcatgtaggtcaatttttagcgcaatgtggtgaggctaatagtgatacttttanattgcgcttgttttctttatctttgtccggtaccgcttttacatggtttacttctttactggcaaattctattcatacttgggctcaattagaggagagatttcatgattatttttatactggagaagccgatcttaggttatgtgatttatcatcggttaagcaaaaatataatgagcctgtcgttgattatattaacagatttagggatgttggaaaccgatgttatagcttaaatatagctgatagagatttggttggtcttgcttttaatggtttaattgctcctcttagagaaagagtagatggccaacaatttcttgatgttagtcaacttatgcaaagggctctggctcaagaaagccgggttaaggataataaatatattgttagaccatatgagaaaaagccttatgttaatgtgattgattaccctcaggctagtgatagtgtaagatcagggtgatcatgatatgtatgctgctgaatggtcatggactaccaaaaaaaagccttttgtttgttctaacttaatgccgactcctcgcaaagatcggcaaagtgaggttaaatatagttttgatgtggccaagtgtgataagatatttgattatcttttacaagaaaaaaaattagattacctaaaggccatatcgtaccatctcaagaagaattgaaacgtcgacgttttttttaattggtaaatggcatgattctcattctcattccactaataattgcaatgtgtttcaacgacaggttcaatcggccatagatgaaggacgattgaagttcaccgatggctccaagatgaagcttgatcatgatccttttccggtgaatacaattaatttcaatgcaagaaggtgttgatttggccggagcaagccgaatctactaaaggaaaaggagtaatcattggtgaaccaaggccaaagatgatagtaccaaagaagccgtaggttggtgtttggaaagagaataaaagtgaagcttcaacttctaaagctcctaggaagactaaagtgacccttgatatgcttttggagaaatatgaaaagcagggtggtgagagagctcacaacaaggggaaaagaccaagatcacctctttgggagcgatttgttcactcgctaagacggtcgcattcacctccatatcatcatccacaagacatgtcatggggttcttattcaatgccgccgccgagttatacttatccttattatatgccatggggggcaacatcgccaatgttcaaccatatgcctccaatgcaattcaaccaagggtggggaggaccaagaaggccaattcatgagcgtttttcttcaccaaacaatggccagttttatggtaggaaccgggccaatga

SEQ ID NO: 88340 - DNA, 1345 bp, Oryza sativa
agtacctgttcagtgtctctgctgatttactgataagaacatgctcaattgtttcagtattgtttgagatgtataagaagttaatatccttcctgtatattctcattggatgcaccttctgtgtttttcaggctggtgctcagcaaccgctcaatgctgcacctgttgtggtgccatcatctgttcctatgccttcaaaggtatcttcgattactaccaccaatgaaaatgagggagttagtattagatctgatgaggttactggaaaatctagtacagatggaagtacaagttcagccgctggcaaaagtagtaatctatctcttgatgctttagccaaagctaaaaaagcattgcaactgaagaaggaactatcagaaaaactcaagaagctacctgtggtaagaaatcacagttgttggtagtcccttgcttctatatttctattttacctttctaacttattgtgttttttggcacagcttaataataaacttggtgttactagtactgatacacaaattcctaagaaagaaacacagcctgtttctagctctggtgcatctgaaatggctgtgggtgcagctcttactgagaagatggcagctacagcaggtgcagttggtattccaggccttgctaacattcccaatttggatgctgtgaagcgagcacaggaacttgctgctaagatgggattcagacaggatccacaatttgcgcctctcatcaatttgtttcctggtacatcctctgaactaactgtgcctcaaaaacctgcgaaggcacctgttctccgtcttgatgctcagggtagggaaattgatgaacatgggaatgttatcaacatgaccaagccaaccaatttgagcactctaaaagtaaatctcttattttactagcatgaatactatgaaatgttatcagtaactcttctgtgcaatgactgtcacttttggttataccttgtaggttaacataaataagcaaaagaaggaagctttccaaataatcaaaccagacttggattcccttgcaaaatcaagtgcacactttgatgaaaggatgggcatcaaccaaaacaagctcctccgccctagaaggcctggatttcagtttattgaggagggaaaactttcaaggcaagctgagctgcagagaattaaggtctgtaaggatcaacttttaagattagttttcaaaatgtatttacttatcatatttccttttacttaccctaataatttgaccttctagaatcaatttggtgaagcacaagctaaagaacttaaagtaaaacaagctcaacttgcaaaggcaaaggcagaagtagtcatgaacccga

SEQ ID NO: 88341 - DNA, 532 bp, Oryza sativa
agaagttatcaatttacattcctcaacatcattagcaatgtgaacaacatgcttaaaatcagcacacaatgaaacactagaaatagcatgttcattcactagttgtggtagggatataagtgaagcattatcacacaactcttctttatcacaaggaacagcaagtaaatcaacttgtgacaaatgcaaatcagaagtagtttccacccaaatttgctctatattagcatggatagtggacaaatgtgactcatcagaagcacactcaccttgagtaatatcagcaccatttaatttaccttttatgccctctttagataatataggtgcatcagtcttctcttcttccttcgtgagtgatggagatgacatctcgagcatattgctcttctcctcatggtgaatgttctgaactccctacaaaatatcagtaatcggaggcacaagcataacctgtttctcccttgggttctttaaaatattgctctcaacactgcaagcaagtatgaaaacacaaaatttttcctcatca

SEQ ID NO: 88342 - DNA, 2031 bp, Oryza sativa
tgttcatgctttaaagatttggcggcactatctcatcggtaaccgttgtgaggtatatacagatcacaaaagtctaaagtacatcttcacccaacctgatctgaatctcagacagcgaagatggttggagctgatcaaggattatgatatgggaatacattatcatcccggcaaggctaatgtggttgcagatgccttgagcaggaagagctagtgcaatgttgcatgggtagagcaactatgttgtgaggttcaacgtgatttggaacatctgaaccttggtatagttgagcacggattcgtggctgccctagaggcacagcccacactggtggagcaggttcgcatagctcaagcaagtgatcctgaaatagcagagctcaaaaagaacatgagggttggaaaagcccgaggttttgttgaggacgaacaaggaacaatctggatgggataaagattgtgtgtacccgaaaacaaggaattaaaagacctgatactaaccgaggctcatcaaactcaatattccattcatcccggcagtaccaaaatgtaccaagacctcaaagaaaagttctggtgggtcagcatgagaagggaaatagctgaattcgtagcactctgtgacgtctgtcaacgagtaaaggcagaacaccaaaggccagcaggtttgctacagacacttcagattccagaatggaagtgggaagaaatcggaatggatttcatcaccggtttgcccaggacgtcatcggggcatgattctatttgggtagtcgttgaccgactcaccaaagtggctcacttcattccggtgcacactacctactcagggaagaaattagcagaactctatctggcaagaattatgtgtttacatggtgtacctaagaagatcgtgtctgatcgaggaagccaattcacttcaaagttctggcagaaattacaagaagaattgggaacccggttgaatttcagcactgcttaccatccacaaacagacggccagaccgagcgagtcaatcaaatcctagaggatatgttgagagcctgtgcgcttgactttggtggagcatgggacaaaagcttaccgtatgctgagttctcgtacaacaacagttaccaagctagtttgcagatggcaccatttgaagcactgtatggacgaaggtgtcgtactccgctcttctgggatcagacaggggaacgccagttgtttggtacagaagttttaaatgaggcagaagagaaagtcagagctgttagggaaagattgagaatcgcgcaatctcggcagaaaagctatgcagacaaccgccgaagggagctcgttttccaagcaggggattatgtgtatctccgtgtcactccgctcaggggagtacaccgcttccaaaccaaaggaaagttggcaccacgctttgtgggaccatatcgaattttggaacgcaggggtgaagttgcttaccagcttgagcttccctccaacatgcttggcatccataatgtgttccacgtctcccagttgaagaaatgtttgagagttcctgaggaacaggcaagtccggatcaaatcgaaatccaggaagacttgacgtatgtggagaagccgactcgtatccttgaaaccagcgagagaaggaccagaaacaaagcaatcagattctgcaaggttcagtggagccatcactcagaagaagaggccacttgggaaagagaagatgagttgaaggccacccacccgcacctcttcgccagctcttccgaatctcggggttgagattccgtttaaggggggtaggtttgtcacaccctgaagttttcccccttttgcttgctttaaaaattggttaaataaattgcccgaagaaattatcttaattaacctagagctaaatccctagttaataaatgcacttaataatcagaaatagtgtggtggaatttttcttgagttccccatgctccaatgcattaacaggatttttagtgaaattttcagagccttggaaataattttaaccaattaaaaat

SEQ ID NO: 88343 - DNA, 3352 bp, Oryza sativa
tgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatatctttgttattgttgcccggacattgtctggaaggataccccttattacaactggtagcagttgtatcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgagtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatggagttctttttccacatcgccgcgtgaccatcttcgctctctatatgctggcttccaggcccctttccgaacactactttaagatctttaaccatatcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacatggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttctagtcctaacgggcagactatcttcttagcctcgtacgttgtctcgggcaatttgtttccccccggaagaatgttcttgacgagtttcaataaatcgccaaatgccttgtcactaaccccattttttgccttccattgcaccaactccagagtggtatccaactttttgtgcccccgctcgcaacctgggtacaacgaagttctgtggtcctccaacatcctgaccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccactttatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgctggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacatacattttctctctcatcaacttacaactaaattttggagacaaaaaaagtgtgcaaaacataggtgcaaatgtagtatgacaaaaaaaaacattggaggatgaagttgcaaaccttttaggcacctcgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgagatcattagtcccggttggtattaccaaccgggactaaagttaagatctttagtcccggttggtgctaccaaccgggactaatgatcccggtgagccttagccccggctggcgctaccagccgggactatcgtcccacccctatgtatatgtcttcttcctctaccagctgcccgagcacgcttcaatatttcttcaaaacagaggggaggtcatgcc

SEQ ID NO: 88344 - DNA, 1120 bp, Oryza sativa
tggatgggctttagatttcatcggccggataaatccttgttcttccaaaggtcatcgatttgttttagtagctacagattattttacaaagtggacagaggctgttcctctaaaaaatatgacccataaagaagtgattgattttattttagagcatattattcatagattcggcataccacaaaccttgacaactgatcaaggatcatcatttatgtcacatcaagttcgtgaatttacggaatcttttaaaattaagttgctttgttcatcaccatactatgctcaggccaatggacagaccgagtcaagcaataaaactttaattaggctgataaaaaagaaaatagaggaacatcctaaaagatggcacgaggttttgtctgaggcactgtgggctcatcgtatatctaagcatggtgcaacaaaggtaacaccatttgaattagtatatgggcaagaggccattttgcatgttgaggtgaatctggacgcccttagattggccagacaaaataatttgtcggcagtagattatcacaacttaatgatggacggaatagatgaggttagtgatgaaagattgaaagctttgagagagattgagaaagataaattgagagtagctaaagcttacaataaaaaggtgaaggaaaaatcgtttcaaattggagatttagtgtggaaaacaattctgcctgttggttcaaaagataataaatttgggaaatggtctccaaattgggaagggccatatagaattgtagaaatagtccccgggaattcttattttgtgcaaagtctacgaggatataagttgcctagagcttttaatgggagatatttaaaaaggtactatccaagtgtttggcaagatgcttaaaaaatgataatactaccgatgcatggttttcatcgtgctgagaagtgtgtagtttgtttatcatcgtcccgaggaatatgtcgattatggctaattatagtatggccggtgtttaattatttaccatcgtcctgaggagtatgttaattatagctactgcaataattatgttggggcagcttagttttatttttcggacaataaattttacccaaaaattgacagccgatgatttta

SEQ ID NO: 88345 - DNA, 2033 bp, Oryza sativa
acagatcagtcgtgccatacaatcttgaattgcttaaaaaatacgaagcacacattaatgttgagtggtgtaacaagtcaaatctgattaaatatttattcaaatacattacaaaagggcatgatcatgcaaagatatactttgagactacttctaagacaggaaatatgtcactaaatcatgatctagctcctcggatgagatattagaatacatggatgctagatttctttccacgtgtgaggcacttcatcgcatatttgaatttgacatacattatagagtgccacctgttgagcgtctaacagtccatttagctggcaaaaattatgttagatatgagaaatgttcagatttgcgggcggtgctcgatagccctgctgcgaaacgatcaatgctgactgaatggttcgaagctaatagaaaatattctaaggcacggttgttaacatattgtgagtttccaaaggaatggtcatgggaatcatcatctagaacatggcgcgagcgaacaccaactgcaaaaataggtcgaatctattatgtgcacccaacctgtggcgaactctattacctcagaatgctcttgatgatagttaaaggcacacagaattatgctgatgtacgcacatacaatggcattgtttataacacattcagagaagcatgtgaggcgagaggtcttcttgaaggagataatgaatgataccttctatttgatgaggccatactatctgcatcttcgcgacaacttagacaactatttgtgaccgttattctttattgctctgttagtaatgtgcgatcattatttgataagtattggctttatatgactgatgacatccatagtagattaaagaatgcattagataatccacgatgcattattccacatgagcacttgcttagtctcctcctgcatgagcttacaattgtttttgcaaacaatggtggtaatataaaagattttgatttgccgattccaacatctgcttcacacattcctggtagtaatagattgattgacgaggagcttgcacctgatccccttatgatgtccttgcgcgcagattctttaatagcacagctaaatatcgaccagaaaaagatttttgacaccataacctcctcaatcagtgcaaacaaacctggatttttctttgtgagtggacatggtgggactaggaaaacatttctatggaacgctatgattgcaaaacttagatcacaaaataagattgtgctcgctgttgcctcatcaggtgtagcatctctcctactacctagaggtagaacagctcactcccgatttaaaattccaattgacattgatgaaactagcatttgcaatataaaacgaggaactatgttgcctgacctcctcattgaaagtgcacttattatatgggatgaggctccgatgacacgtaggcactgttttgaagcattggatcgcacattacgtaacattctttctgaaacttgtcctacaaattcaatcataccttttggaggaaaacctgttgttttgggtggtgactttagacaaatcttacctgttgttcctaaaggttcacgcctcgctgttattaatgcatcaattacaaatttagacctatggaaacatgtgacgttgttatccatgaatataaacatgagactgttaaatccaaccctaccagaaaacacaataattgaattgcatgaattcagtacatgggttctagctgttggtaacggaacattgcctatgattgcaaaagaaggtgaagctcaaccctcatggattataattcccgatgatcttcttgttgtaacagatggtgacaaaatcgttgctattgtcaacgaagtgtatccagactttcttgcatcatataaaaaccctacatatctatcttctcgtgccattgtttgccctgcgaatgcagtagttgatgaaataaacaattatactattgatttactcccaggagaatcaagaatatatcttagctgtgatacaatctcaaaatgctcagagcaaattc

SEQ ID NO: 88346 - DNA, 1538 bp, Oryza sativa
gctaatttgacacttaatggattcacgggagagccaacagaagctaaggacattatttccatggagctaactattgggagcaaaactctccctactgccttcttcgtcgccgaggtgcaaggtaattataatgttatgttgggtcgtgattggatacatgcaaaccattgtgttccttctaccttgcatcaaactttaatacagtgggtaggtgatgatgtagaggttgttcatgcagatacttcggcttgcgttgctttagccgatgcctcagttgattggcagtatggtaatattcagtgtttaacaggcttagatctttctgattatgattatgttattgtcactaaggatggttttgtacccgtgtctataaagccggcttctgcagctcggctcagtagtgtgatgttataaatgaataaagaaagcaatttagattggttacaaaaacgtgcagagcaatatcggtcaaataagaacgatatttgggaggctattgatgattttgatgaagtagaaaaattaggacaaggtttttcgtcggctgaccctttagagaaagttgatataggtgatggcaccattcctagaccgacatttataaatcaaaacatgacagccgattataaagttaaagtaattggtttacttagagagtatgtcgattgttttgcatgggaatatcatgaaatgcctggacttagccgagagctagtagagcatcggctacccattaaatctgggtttaggctttataagcaaccacctagaagatttaattctaatatgtacgactggatcaaagaagaaatagaccaattattaaaggcgggttttattaggccgtgtaggtatgcacaatggatttccaatattgtccctgttgaaaagaaaaatactgggaaattgagagtgtgtattgattttagagatttaaataaagccacccctaaagatgagtatcctatgcccatagctgacatgctaattaatgatgcatcgggacatagagtgattagctttttagatggtaatgctggttataatcaaatatttatggccgaagaagatatgtctaaaacggcctttcgttgtcctagttttgtcggtttatttgagtgggtcgttatgacatttggtttaaaaaatgccggtgccacttaccagagagctatgaatttaatctttcatgatttacttggtgttatattagagatatacattgatgacatagttgttaaatcggaatgtatggatcaccatttagccgatttatgtttagcgtttgagaggatgcgtcagtatggtttaaaaatgaatccacttaaatgcgcctttggtgtgtcgtctagcaaatttctaggatttatagtacatgagaggggcatagagatagaccctgccaagatagaggctattagaaaagtaacagcgccgcagtgtaagttagacatgcaaaaatttttagggaaggtaaattatttgaggaggtttatatctaatttgtccggcaaagttaatgcatttacacccat

SEQ ID NO: 88347 - DNA, 696 bp, Oryza sativa
ttcctgcagcccttattttgagtgatgtatgcaacaagttggctatgtttttttttgaataatgaggcatttactgatgtgttctcatcttcctgcagtaatgtgaagaaagagagctgcttcttccctatccctcaggcagcagaatgcattcttcgaatcgttgagaaagctaacgccccatcatatatctgtctactgatgctgccgagagtgagacaagtctcctgcaatccttggttgtgttcaatgacaggcaagtccctcttgtgaaaaggccagagcaccacaactctgagaaatgggatgccttgttatacagaaatcacatgggtggagacaatcaggtaaccgatacatttcagagttgctgtccagatttcttttggaccttttgttgttgtactaaacggcaaaccggttcggcttttttgcaggttgaggccatgctcgacaagacgatctgtgcgctgtcgaacgttttcataggtgcatcaggctcaaccttcacagaggacatcctgcgtctacggagaggctggggttctgcgtcccactgcgacgaatacctctgccagggtgagctacccaacttcatagcggagctagactgagaaaatgacatcctagaagaagaattgacagctacatccccctttttttccccactacgatctggtggcatgatacacattc

SEQ ID NO: 88348 - DNA, 2102 bp, Oryza sativa
gctaattaagctctcgttgattcgattctgcgtcgattaccacgagcttgatggagccgctcgtcttgaactcccagtccaagatgtagtcgtagttgccggcggacaccaccatcctcgccaccaagctcacgtcggggcgcacctccgtgatctgcatcaagaatcacacaccgaatcagccaaagattgagagtttgagacacgacgacggccacgaagacgaagggctttctgttcatgatcaaatatcaccagctggttggggaagccggcctcggtgtggcgccacgcgacgtcgccggagtagcgctcgaagacgcagatcatgttcctggcctcgacggggcggccgtcctggccggagtagtggccgtcgaggtaggcggcgttggcggggcagtcgccgccgggctggagcgggaaggcccagaggccgaggccgtactcgccggcgtcgaggaacgtgcggtagtaccactcctcgaccgggtccatgtacgggacgaagatctccgacacgaagccgcggtagagcacctgccgccgccgccgcgcgccgccggcgtcggcgtcggcgtcgtggacggaggccagcgagatgaccgtgccggcccgcatgtcgaagcccacgtggaactcccagttggcccacctgcagttgccgcagcacagccatatgcagcatccgtgcatgatgcatgtgcgcgtcagattgtcagctgatgaatgaattggtgaaatatggacctgttcttcagtcctctgcgtgaaaaaggttcaattctcgtatgggtttaacaaaactagcagtagatgagttgatcattagagagaggggcttagggcctgtttggagagctacgaaactgtctagctttttctcaaactatgataaagttgtagctacaaaataaagtgaaatactaaaaaacaatcagaaactaaaatttcagattctgattcacataaactgctttttagaatctaaagtttttccaattcaatcattggtaacttgatgagtagcaggaaaagaaaaagaaaaaatcttacaaattaggagcaaagactgaagaaactgcttccaccgaaaagcaggaataagtattcttcacaattcacatcgcaatctgactctcagaaaacctctcactctacttaatactatcctaaatccaagtaccaaactaagtactctagtcagctttaatttgcatgagaggctcaaacaggtggcaggaatgtaaatagagattttgtagtttaaacaacgattttgctatatttcactcgaaagatttttttttatctctcattcgattttctcactcaaatttacaatgtattttcttgtaagttacagtgtaatttttaaatcttcgcatgtaagttttaaaatttatattggatttggtctttttcttgaagatatggtcatttagtgtctattatggtgtttcttaattgcttttttgctttttactgtgtccattgaattttaattcaaagattaaaaatatatgtaatataatcataaaaatctttcgaaagatgtatatgtactccctttaaacaaaccaaacaaccatattttaccaaaattttgtcaagccaaataaaatcgcttaccaatgttttggtcacgttttcccaccgaaaccggttgaaaacaacacaaaattgtcaagccaatgtcttgacgtgggacgaaagcagttctcgatgaaatttcaagtggttttcaagaaattcaaattttaaatattaaattcaaccaaaattgattaaagaatgacgaaaatcactgtacagctagaagttgggatccgtcagtccattggaaaggtaaaccctctctttctctcatgagtcatcaatcaaaacacaccaaaatatctatgctggtgcgctgtacatatcaatatctatcctaatgcattgtacatgtcaatggaaaagtattttcatccctcaaatgaatattcctcgtttcttacatatcatctaaacaaccataaaaaagttgaaaaaaatataagatagattaatatgaaatatatcactacataaacatgtaatttcaaattctcgacttctac

SEQ ID NO: 88349 - DNA, 1046 bp, Oryza sativa
atcgccgtcccctgacggcgactatccttgggatttctcacgcgtggtgcacgagcttctaatagttcaaattgaaaatatcacaacgatacgtggatgcatcacacggcacaagtacaagcttgaacaagctgctagtaatggtcaaagcgattacctgacgacgtggccgtcgatgtggaagcccctgccctccggctgcaccaccacgccgggcgccggcgccggcccggcgtacggcggcccggccttgccggcgcggtagtccgtcccctccgccttgggcaccgggtacgccaccctgtccctgtacccgacgatggccatccggtcgaggtccaccaccagcgtcacgccctccagcggccgcgcgtagaagttggccgtcgcgccggcgacgaagcagagcaccttcgccaccctgctgcggcggggctcgccgtcgccgccgaaccaaccgacggggaacaccgcgcagagcacgtcgtccatgtccaccccgcgccgccgcaccgactccacgaacggcgggtgcttcggcggcagcgccaccgccgcgaactgctcctccagcgtcagcgtcgggaagccggcgccgcggtggacggcgtgcgagaggacggacggggaggaggcgttggcgacgtcgacgcggagctcgtgggactcgccgccggcgcgggcgatgacgaacgcgcggcgcgggagggcgtggcgcgaggcgccgccgccaccgccgtaggcgtaggagagcacatcgggtttgtcgggctcgtcgaggccgacgtagtggaaggtgagcgggcgggccgggacgagcggggaggcgagcaccgcggcgcggacggcggtaagctcggcggcggagagggggtcgagcgggtgggggcggggtgcgcccgcggcggcagcggcgacggcgagcgcggcgaggaggagagggagaggaagcatcgcgcggagtggcattcgggcgatcggattagcagcgacagtgacaacttatactggactaaattgaattaaataataatgggctgcaggaa

SEQ ID NO: 88350 - DNA, 2798 bp, Oryza sativa
  unsure (1)..(2798): unsure at all n locations
tgtagttagtgaagcccatgtaattagttgggccgtaacggtactgtaccacctatatatttatcgataaattttgtcctaaaaatttgacagatgtaattatagtacaatcgtaatgtaattatattgtaacttgcatataactacagtgtaacttgtattctctccatactcgtaaaagaagtcgtttaggacaatgtttaagtcaaatcttgagaatataaatcatgaataactctaaagttgttgagtttgaaaatgtaaaaattatatgaatagatttgtcttgaaaaatactttcataaaagtatacatatatcacttttcaatgaatatttttatagaaacaagaagtcaaagttgtattttggagaccgtgtcgatgtcctaaacgacttcctttgtgagtatggagggagtatgtaagtttcacgtaattctgaatcgtgagatctattacaagatttgttctggtgaggaagaaaaaaacacaacacacacatatgtcaaagaatttatttccatgacctccattttaccgaaataatatgttacggagaaatttttgaaagttacattatagttacagtgtaattacactacgattgtactgtaattacatctatcaaatttttgggagaaaatttatcaacaaatatatagcaaaattgttctagtaactagaggatgccccgcgtgttgctgctggatttggttaacatcgatttgttagataggaggtacaatctcaagaaaaaacaaatagatttcttggagaaattctttttagcagccctatctaaaatttgtagataatttaggtagcacatgttaactgaaggggcgtttagccataaagctcttttatacggattgacaggctaaatacatgtagatgtgtatggagatgggccaatgtgttcatgtgggctatatttggcactgaggaggcgaagagactcactcggtaactaatgagttgggctctatgctgcattccatccaacgtctgagaaacgatctaatgcattcatcaaacggttcacaatttgatgatgagtggaagcacgaggtttgagcttttggtcttcactttatagaaagaaggataagtctattttgcctccctcggctcttgtccttggttgaatcctatacctcaaccacaaataaacactggcggtctggcatcaaataaacactactgctacactagccgagagcccatatgttgcagcggaaagctaattgagtttctaacatattaagtcaatcacatgtaattattatttttatattgaacaagtaggtgattttgaaatttaggtgataaccaacactgaaacggaaaagaacttgttggaggatgatgtaaatatgtagtagtataaattgtgggatccaaatattgagatagggtgatatcgtagaacgaatacgatcactgctaacattttaagtagtactacgtagatatggatacttcaacatcatgagattagatgaactaccgatatccagaggtcaaaaggattgtttacattgaaacaaagcagtgccgggtgaaattaacagctcttttcttatccctccagggatagatacatacaagagtgctccataaaagtagaagcatatttctcttttagatagctattgctgtccaggttcacacaagagttgtatcaggcacattccttctgcaaattcatcagccatcttgaagccatagtctcacagtcctatcattgtcgaggccgcccgacgcaattttgttctccgttggatggcaggacaccgagatgacagtgtcagtatggccttcaagtttctgaagaatgttcttcccttggagatcccatatgtacacacagttgtcttctgatccactaacaatatacttcccatttgtaacggaaaacgcggactggaggcaatactttctgttaacatgtccactgtacatcttcaagaacttgccacttgcaaagttgcatagtttctgaaatttggtaaggacatacttatgaagcaaaggttgcaataaccatatattttccaaatgaaataaataactaatttataaaaacattccgtgaaaaatgaagtaaaatcactacatgaggaagcccatgatagaataacacaatgccaaaatttcttacaatgttgcttgatgtgaagcattattgacctaaatgcccataaagttttacagatgtaaacagtacaagggctgaaggagtgaaggtgtatgtatgcacaatgaataccatggatcaacctaatagtctaatactaatataaagcactgataacaacatttgcactgcaagtttcatatttctttcatatgcctccaattacttgaattatgcatgaaacagtgatctgttatcgtgtgaactgatgtgcccaaataaacttcagaagcagttttttaaaaccatttaacaacataactatctgaagataaacttttcacagtactaagaccacacagatcaagaacatgaggtttggtgtgaaactgggtaagtatagacatacttagttcaacatgtaacatattggttaccttaaatcttgggcaacggctttaacgaaatgatcctcagagtgaaggatctttgattgtattggtaactataatttcttttctgtgtgaaactganacaagatgtgctatatggccgccagtaatactagattaaataattagcagttggaggaacaatctgcctatgaaaaagaccacggcgaataccagaaataaagctacgataggcttctattca

SEQ ID NO: 88351 - DNA, 638 bp, Oryza sativa
agtggatccccccgcatagtatgctggaggaactgttcagataggagagtaacaaaattcagtaaaaaaaaaaaagaggaccacagaaagaaagataactggtaagaaaatcagctctgatagctgaataaatgaaaacccgacaagataacgcatacctatggagactgctcgggtgcatcgggcatagctgcaggcaagggatcatccaaggaaaaatgggttacatcatgtcaggatggtaaagagtggggatgatgcatgcactgttcaccgtaaggtaaaacggcagagcaaacttacgtgtagctaagattgtaggttagggtttgcagcgtatcagccttgaacccattttcatctaaaagaacatgataatgtgttggacggctcgtcccctgtccaaatacaaaagaagaaactattaacactggaggtaaaattatttcaatttcattgcaaagtgaaattgtgatttgttctaccaatcattaccttgataccagaatggctacagaggtaaaagtcaaactcactcggatggcagatcattgtgtcaacaacagttcctaagagaaaaaatgcacttgatgatttaatatttctttttttaaaaaaacttcatacttaatacaatg

SEQ ID NO: 88352 - DNA, 698 bp, Oryza sativa
ggatgtgtaacatccgctccaaacactatcgtaggacgatctgtcagaattggtattttcttgtgcaacgcatcttcaagtactgtatttcgccccccgacctaattgcaaaataaaaatgatattaatgtcttttgaactgcttgtagagtggttagtcataccatacaattaaacttcatcctaccttaacattcatttttagggccagattttcaagatactgtttcccacctttctgaagactcttgggtgcacagcattgagttatcacaccaacctctgtttcacaaattcgttttatccttcctacatatgtaatgagtatcagaaacttaaattcaaattgaatcacctgcatgagaatgcatcaagagcttaccataagaaccactaatttcagtcaatattacaattaataactgaagttgctgccctgtcaggtcttgctggtcaagcttttctgaagattgcctatggatatttctgattgcaccctcgatgttgcgttgctgtccttgtatgatatccacacatggtctcgtattcatttgctacaaacagaaatggataaagtcaaccagtgaatattttagtgacaaaagtatacttacaaaaataaatttacggatttctttaaggagtaatttaccatgccaatattattgcacatgccaaacaggtcttcacaaaacggc

SEQ ID NO: 88353 - DNA, 5207 bp, Oryza sativa
aaatccttgcacaaggttttgtcaggcttgcatattcttactgttaggattcattaatttacggtagaatggccgaagaaacttgtcatcatgtttctgcctattcggtcttccatgcattaagtatcaaagtgaagccaaaacgatgcgcttgaagctccttttcattctgagagcatgaccttgacagcaatttttccatggattggcctgactgaaacaagaacacggcacatttattcgatgaaccaaatagccagtcatgaacatcccataggacctctactggaagtccatcaacatagactgtctggtttcctctgaacttccatgcaagtctcttcacctgcatgactctcttcttgccaatcctgatttctaggcttggatccttcaaccccgatgtgtcacactctatggtgatatggtggagctgaccaatgtccaaaaaccgggccttcgctgaatacaccttcttcccataaacatgttccttcctggctatcatgacagcattggaggccaatacatctgacgaaaccctgtgatccccatccttgcgcatgtcgccgagcacaagaacagcttcaagatcacagaccagggcaacatagaagccttcgacgggttctggcccggccgcaaacttcgcagaggacaggtcccagacgatatccagtgctccaccatcgacctccatggccttggaacctttcctcttggagaacagccatggctttatctctgccttgcaaaggcaacgattcgaggagtcgtcgactgcgacggacagagcctgccccatggtcatcttgctccaggtgacggtcacgctgcaagatttgccacggaggcgggctaggtaggtgcactgcaccatgttctggccacctggagaagaggaatgggcgacctggacgccgctttgacttaagcaagatgcaaagtctctcatcgtgacgatggcgacggttgcaagttgcacgcccaccttctcctttgcggctttctgacgaacacctcgtgcgcaaccgccctacttatcactcacaccgtcacacgcacactccgagcaggctgttcccctcggttggaatctggattcaaaacatctgcttgctccgactgacggctgaaaagaagtgaggaaaaaacgatgcatcaaatccgcatctttgcgctcgatatcccaagatttccccccaatcaaatccacgcctgttaacctggaatctgaaacaacagcagcaccgcaaacaaatcaagaacccgaagaacggaacatcatttaggaactcccagagatcaaccagagaaggagcagccatacctttccccccgacgaaatcaagaacaccaccggcgaagaacggagcagcgggagcctcagcaatcagcagcggacactacagagcaaagccggtgggcggccgttttcacctggccggctgcgccaagaagaatcaccacccacccaaccgctccacaagcgaacgtgctccttcccctccctccctacccctcaggagcagtaaaccagcgccatcagcaacaacagcaccatcatctctctcgctctcgctctcgcttggtccgttaagcttcgcacttcacagcagtacaggagtaggagtacttctgtttgtagcgtaggaggctcaaccaaaagcagaagagggcgggaggaagaagacaaggggaggggtgcgactgcgagggcgaccgccaccagcagcagcgtggcgttggggaatgtgggcagcagaaaagacgcggaggcagacaggcaggcagcaagcggccgaggcagacagggcaggctcttgggtgtcgggaggtggagggcgcggctgcactgtccagtcgcagcgagaggtcgccttcctcgcggacatgtgagctccacctgttcgcacttcgcaggcacggcctaaaaccccgtattatacgggaaactttggtcttctcgtatggaaaatgtgttgtgtagagagggagatgagaggtgccgatcacaatacagtgtcacgttgtatacagtgtatgccaggaacttcgatcgacataggtagtcctcgttcttttcttagcatatcatgtcggtttggaactttggataggaactctatgccgtaagagcaagtttaatagtatagccaactactagctctaattttactgagcaaggttaacggtgattttactgagcagatcatgccaaccagaggattgcgtcaaggggatccgatttcgccgtacctgtttttgatatgtgcagaaggattttcgtccctgttgaatgctgctgaagaacgaggcgacctggaggcgacctgacgggggtgagagtatgtcaaaatgcgccaagtattaatcatctcttgtttgcggatgactcattgctgctcctaaaggctgatgaacggagcgcggggtatctgcagaatgtgttgtctctgtatgaaaaatgctctggccagactatcaacaaggagaaaagttaagttatatttagcagaaacacgagggaatctaagagggagtcttttagatatgccttagatatcggggttgaagcatggaatgaaaaatatctggggttgccagtgtatatggggagatcaaagaaaaagaccttcaattatttgaaggagagggtctggaagaagatacaaggctggaaggagaagttgttgtcgcgtgccgggaaggatattttgatcaaagctgtggcacaagctattccagcttttgcaatgtcatgttttgacctgacaaaaaccctttacgatgaaataagcagtttgatctcccgtttcttttgggcacagcatgatcgggaaaacaaaatgcattggattgcctgggacaaactatgcagtcgaacggaaaaagggggcctgggatacagagacctccaccttttcaatctagcgatgttagcccatcaagcgtggcggctcctttccaatctagactcattgtgcgcaagagtgttaaaggccaaatatttcccagatgggaagcttatggaggttagagaaagtccgggcatctcatattcttggagaagtattgttcggggggtgcaggtgttgaaggttggcctaatctggcgtgttggtgatggtaccgacatagatatgtggaacgacccatggatccccttgggtacaaccaagaggccaattaccccaaggagagggatcgttctgaacaaagttgctgacttaattaatccaattaccggagaatgggatagagagttgatccaggatatattctgggaggaggatgtgaaaaacattctagccatcccagttcataatggctatagcgatgttgcagcatggcattttgacccaaggggcattttttcggtgaagtcggcataccacactctggaatatcagcgtgatcgtcaggcaatacgacaaacaggtgaatcttcatcggggaaaacgagcagtgcagcccttcagtgggagaagctatggagactgaatcaccttcctaaggtgaagcatttcctgtggcgcttagcgcacaacagtttgccactccgtcagaatatcagtaaaagaggtatggagatcgatacaaggtgcccagtctgcctccggttagatgagaatggtggccactgtttcttcaagtgcaaatttgtcaaaccttgttggcgcatgctgaactttgagcacattaggcaggagctttctcttcagacttctacgttggatgtatgtaagcacattctgaatttgagagaagacattatgttaacgactgtcatactgctctggaattggtgggatgcaagaaacaaagtgaatgctggggaggataggagaacgcatgaagaggtatatagcagagtcataaggatggtgtcagaaaactccttgctctttcgggacaaagctcggggaaatcctagcagtcaaagtacatggtgtccgcctccccagtgtgttctaaagctgaacattgatggtgctttccaggcggctaatctaagtggtggttggggctttatcctccgggaccatgaggggaatggggtactggctagagcaggacgaatcgaactggtgcatgatgcgcttagcgcggaagccgtcgcttgtctgcatgccttgcgtgctgttctaaatcatggtttttcgtatttctctgttgaaacagatagctccatcctggtgagcgcactggactccgcttgctacgaccagtctacggcgggcgtgacttttaaacaaattagaactctgctccgtatggacttaggtatgatcaaggtgtcttttgctaatcattcatgtaatagttgtgctcatgaactggcccggaaaggggctagttgggacccgtgtcatatgtccatatgggcagaccccctcccggattttgtacagtgttttgtggttcgtgattacactgaaccaaggtattaataaagagcacgtttcctgtcaaaaaaaaaactactagctctagtttatctatagtcaatctaagagcgggtacaatagcaaactattagccagctataaacatattttaatgagataaaggacgagagagaagagcagctgtcggtgatatgggaccgggggtatcgagaccagaggcttgaggcagacacaatcgcccacgtggcctggcaccctcggggacgtcgggcccaagggtgaggtgtccgccctcctcttgatttccccgaggggggtcgggtgactcctgtcccggccccgagggccgaggcgccccgaccccttgagggtttttgcgtcacatatatgggttaggtgaacacggcagggctcatctaaccgcatttattgcggtctggtcaagcgtgtcacgctgcatgcagcgcagtgcagcgcgttcctttatccggtctgtgaccagtcacagaccggtcagatcacgggttaggtggcgactggcggtctgacgcacgcctcgccccatcccgtcaagacgagagcctctaggcactcgtctctagccggagctagcgtgttgcctctcagagatggcacgttaccttcggtcagatatataccaggcttcatcccaaccattacaggaaaaatgttacatgaagaagggcgaacatgcacgttgctaaactgacgcgtggtggacaaggatgactgatctgtgaccggactgacactggacgcgtcatccacagacag

SEQ ID NO: 88354 - DNA, 899 bp, Oryza sativa
aaagccctcctctttgtctaaataatagaataaactcaaaataacaaaataaaatacttgataatgattattagtaaatttttgaaattttgaaattatcttttgtattatgccgtatctttgagtgctttgtttgcaataataagtaaataatataaaatccaaaaaagtataaatttttttaacctaaattctattgattataaaccccaattttatcacaagtgaagaaaagttaaatctaattgaaaacttgaactaaagtaactgagtacacttttcaacatttatcttatattctgtaaacaaatactccctccgtttcacaaagtaagtcattataacatttcccacattcatattgatgttaatgaatctagatagatatatatatgtctagattcattaacatcaatatgaatatgggaaatactagaatgacttacattgtgaaacggaggaagtagttatcttcttaaaaagatattaaaaatgtttttctttcctcgaaagggtcatttcccaaaaatcgtaaattcaaacctttggttttaaatacaaattcaggaactcaaatatattatattattaaaacagctttgaaaggaggtaccacgtttgctgtgggggctaaaaattttcacattaatcggagaaaaagaaaaagaaaagaaaagaagagtccaagtagaaatacaatctaaaaatagctgaaattcggaattaaaaataagcaatattgaaggaagtttccatataggaaccccatacgagatttatttaaatttcgaaataaaattaaattaaatctaaatttgaaaaaaaaagagagagtcccagttgaaataaaatttaaaaatagcctgaattccgaattaaaaataacgaatattgaaaaa

SEQ ID NO: 88355 - DNA, 962 bp, Oryza sativa
tgttaaattttggtgtacttgtcttgcaggagcacttcaaaaaatactatgatgcagtgatgccatacctgaaagctattttaatgaatgcaactgataagtccaataggatgcttcgtgccaagtctatggagtgtataagtctggtcggaatggctgtaggcaaggataagttcagggatgacgcaaagcaggtaattgtgtcttctccactgtaattttgctctgtatgctatgttctatgcatgcacttttctaatctacacattgattgataggtcatggaagtacttatgagtttgcaaggaactacaatggaaaatgatgatccaataacaagctacatgcttcaggtacacataaaacctattatgaattaatcataataaaattcagatcctttgtaacattttctcctttatgtgacaggcttgggccaggttatgcaaatgtctcgggcaggattttcttccgtacatgaacgttgttatgccaccactgcttcagtctgctcaactgaagcctgatgtcacaattacttcagctgaatctgatgatgatatagaatcagatgatgataggtttgtgcatcttcttcaattgctatgttttatccactgaattaaatatgcccttaatattgatgctgtgtcagaggcattctatttaaatttatctatggttcattctttcttaagaagtactatttgtttctataccatactgaatgtaattacatacacttcgttcatagaaggttcctttttttcgtgaaactcgtgcctgtttatatttccgttatcaacctttttttttttgggttagtgggactgcaacttgcaatagctaccttatgcttgtaatatgtttccctattgattatcttttttcttttgcaatttgatttgttcagaaatatatcatccttttttatgtgaggtgtggtggttgtttttagcttc

SEQ ID NO: 88356 - DNA, 2493 bp, Oryza sativa
ggatcatggagccaatgcaaagaccacatacgtggtaggaactatgggttacattgcccagagctcatgcacacggggaaggcaacaccgttgacggacgtgttcgcgttcggtgtgttcctcctcgaggtcacctgtggacgaaggccgattggggaaagcgatagcaacgagattctattaatagattgggtgctgaagcattttcttagcggatccatccttaacgtggtggatccccggcttgcagggaggttcagcttcgaggaggtgaatcttgttttgaaactaggactaatgtgctcacatccattgcccaaggcaaggccaagcatggacaaagttgtgaagtacctcgatggtatgcttccagcaccagagctatcaccgacgcacatgagctataacatgatggagttgatgctacagaatggggttggttcacatagtttacccgtgtggtcctctttgttagataatagtgttggtacaatgtcatctgcttcggttctctcggacgggagatgattctgaagcttgtacccgatacttgtcagtgggctcggtaatcctttgtattttgttgttagtgaatgcaaacaattatgcacttttagagttcctatttttaatcatttttttcttgatagaagacacatatatactacacacgcatcgtaattgtgccctatttaacacacgaccagtagatatcagaggctgcgacaagcctaaggcagctaagacttgagccctagttttttttttaatttctattagattctataaaaaaaagtgaaattttttaagatacaagatgtgtaaacaagttgaaccggagtctcaagaagcataaaattcctatgctgatttagtactgctactgttgtattgcacatttatatgcttaaaagatgatatgaaattgacacatggtgtgggcaatgaagggtgtcacatttgaacttatgtgatttttatggagtttaaatttgactaaaatggagtggttcacaagtaagtttcattataaaggcattttgtagtatacgcaaaacgaggtgagccattagctcatgattaattgattattaattattttaaatttcaaaaaaggattaatatgatttttaaagcaactttcctatataatttttttccaaaaaacgcaccatttagtagtttgggaagcgtgcgcgtggaaaacgagatgtttttctctctcaatctcctagatctcccaggaagaacgaagcctaaggtatttatgggatttttctaggttatgaaaagaactagctgggttgcccacgcaattgcgcggctagcacccaaacaaaattatatattttttttatgattttactaaaaatttattaaatagctatcttattgtcttaagagtttgaaagaccaaaccttatcatccccatgtttctaattatatattattttaaaagtcacaccagatactaccccttatgtcatcttcttctttatttgcttgctcgatctaccactatttctattcattctccttagaacctttaaacattggatcttataggttttagagtttattttcacgttgagtttcgtttttataatttctagacgtcatgtcaaacgttgccattatactcctctatgacccgtctactatctcttctctttattgtcattgagattttaaaaatcaaacataattatcatttaggttcatttttactttctagaagtcccgccaaaccgtcagtgactttgccattgccattgtacttctctacggctcgcccgctacctcccttctttattgtcattgagattttaaaatcgaatatgattatcattgttttttttttactttttagaagttccgaaccttcaaaaattgaaccttgtagtttttagagtttattgtcttgttgggctttatttttttataatttttagaagtcttgtcaaacgatgtcactatgctcctctacggctcgtccgccgcctactctttattgtcattgggattctaaaaatcgaacataactatcgttggaattcattttttattttttagaagtcccgtcaaccgtcggcagctctgcaactatactcctatacaccccgcccactgcttctcctttttattgtcattgagattttaaaaatcaaatatgattatcaatggggtttattttttttactttctagaagtcccggcaatcgccttgatcgtttgctttacggcctccctgtcgcccctccttttaatcgtcattaggattctatttggtgtttcattaacaatttttttatgtcgtatcaaccgccaccactctactcctttatatgcctgttacttaatttatctcgtcatgtgttttacatggtcttttctttcaatagtctttatttttatcacaaattttagttatttataaattgtattcttaattggaatcttatttttcttttttctaatttcagattttttta

SEQ ID NO: 88357 - DNA, 885 bp, Oryza sativa
atccaagaaagcaggtagtaataatcttaaaacaagcatgatcagacgataaaattattccacacgactccgagcccaaagtactactctttcttggggtgaagatcaatataatcaacagggccatgaacgtcgaataaatcagcccaaaatccattcttcctcctcgggttgcaccccatgtcccggcatagcttatcattgtaccagatgtgaaggaatccgatgcaggatctgcgaaagtaagcacgagaatagcgcttcatgaacttctcccattcctggacatcattctgcatcacactgatgcttggcaacctgaagccaccatccatgaaatgtgcgagccacttggcccttaattctgatgtgtacaggtttgccaagctttctgaatagccgataaccgccagctgcgggatcttagggtgaatgatctccctgtgagaaatcatgcagcaaattaattaactacgacacagtcctggatagaaattggaaattgtacaaattaaatttttgctccttgcaagaaacagttattgagttgacctgtagagaggtatagttgtagatgcagagcctactgcaatgctctgaaagtattcagaagtgaacatctccttgatcttctgtccccctctgaatccagttccaaagatcactatatcgctctttatcggcgaagattcgccttcaacaagcacaccttcattgcaaaagctaaatgtctttgatttcttgagaacgatgctgccttcttctaatctcttgtaatggtctttgggtgtaatggccatcaagcatgtaatcaaagcttcaaataggctatggtcaggcaccatgccatacttcttcattggaatggaataatagctttctgca

SEQ ID NO: 88358 - DNA, 503 bp, Oryza sativa
gtcaggatgtccaaaaaggtgtcaggttcaagtggctctcgtctggacgcacgttgtgctagatcatccggttcgatgttgtctttacggtatacatgtcggacctcgatcccatcgaaccttttttctagcttcctgacttccgcgagatacttggataactcggggctagagcacttgtaatctttatgcacctggttcgcgactagttcggaatcccctttcacaattagtcgcctaactccgagtgcagctgtagctcttatcccggcgagtagtccttcgtactcggctgtgttattggtcgccctgaagttgaggtgaattgcatgcttgaattgatctctcgaaggtgatgtcaagatgaatcctgcccctgctccttggctattgagtgcgccgtcgaacgccattgtccacgtttcgttgtggatttggttatctgacctgttatcaggcatagtccaatcggctacgaagtcggcaagtacagctgggacttg

SEQ ID NO: 88359 - DNA, 574 bp, Oryza sativa
ttgtacggcagtaatatgtacgtcttgaaatgttgctgcgttaggagatgcacgagattgtcctctgtatgtttctcgtacttgtcgatcatttcggtgttgattttccgagggtcgatgaacccagtatcgtagactctccgccgtcgggccctttgaatctccattctacaacgatgaaaggaaagtattattgcttacatatatgccaggagctaattattgaacgaaacaaatcgaactcaaagatactcacaaaatccatgcgctcagaagagagacatcgagggcgtccaactggtacagatcgaagagttccttgaaatggatccagagaacatcgtctccttgcaagaagtcggggtttctgatcctcgctccgaacatctctctacccttggcgctcatttccatgtaccgttcatggaatttgtacatctgtgtcggtagggactccagctgttcaggtttgacaagcggtttaccgagttcaaacttgtatgccaattccgccttcgggattggtgcgccttgaaccaattgatccacaaatagaccggtgtctgcaatgaaa

SEQ ID NO: 88360 - DNA, 1442 bp, Oryza sativa
cgcctccgacacaggtcgatgaagagagagggttgagagggagagagagatggggggagtggttgagatggataaggatgagccggtagtagaggataaggatgagccgggatgagaggggagggttatgagaaagattttttttttatcatctttgacgggcacataaaatttgacccgtcacaggtgactttatctcacctttgacgagttttgtttttggaccgtcacaggtgactagttacctgtgacgggctaaatatttttggcccgtcacatgtaattttacctcacctttgacgggtttcatttttgaaccgtcacaggtgactagttacctgtgacgggtcacctcctgatggctcaccgatgacggcatcctgtaggacccgtcaaaggtgaccctcatcactgaccagcacttatgcccgtcacagatatgccgtcacaggtgcaaggatctggcgtagtgtaacctcatttatcacctcaaggtttgtcccaaatatcagtatgtcatcaacatacaagcacagaataactccctcacccccaccatggctatagtacacacatttatctgcctcattgactgcaaagcctgtagatgtcaatgttttgtcaaatttctcatgccattgcttaggagcatgtttcaaaccatacaaagacttcaacaatttgcacattttgccttcttgaccttcaactacaaacccatcaggttgatccatatagatctcctcatccagctctccattaagaaaagctgtcttaacgtccatttgatgaacgagaagactatgtgaggctgctagggaaagtagcacacgaattgtggtcaatctagcaacaggtgagtaagtatcaaagaaatattcgccttctttctgagtatagcccttagtaacaagccgaaccttgtacttttcaatagtaccatcaggcctaagcttcttcttgaacactcatttgcacccaacaggtttacacccatagggtcgctctgtcacctcccaagtcccgttagcgataatggaatccatttcactacagacaacctccttctagtagtctgcatcaggagatgcatatgcttctgaaattgacttaggagtgtcatccacgaggtacacaatgaaatcatcaccaaaggacttagctgtcctttgtctcttactccttcgaggagcttcactgacatcctcctcagtgacatattcatgtgtatgttcagtttgttctggtggtgtgattgaactaggaattacttcagagggttggctcgaactactatgtgtatccttcattggaaaaaagctctcaaaaaaggtagcatcacgagacttcataattgaccaacatgcatgtcaggtacctcagatttaactattaaaaatctataggcaatgctgtgatgagcatatcccagaaagacacag

SEQ ID NO: 88361 - DNA, 1359 bp, Oryza sativa
ccgctgcatttgtaatcttttctatttttgtaagacgtggatctgtatgtcaacaattatcgcttgtgtaccctggctggtcctggacagggatttaatgcacattcagcttagaaattctggttcgagaatttctgggcgtgacaaatttgtacttacccaattgggtatttggacttttccctatgcgatagtgaggttataggtgcaatattcctgttgttcgacaacacaactatatacaaagacctgatgataccagtaggttgcaacagttcattagaatgcacataaatgagtcaaatagctatagcttccaatgatcgatgcactctttgaaaatgaaaaaaaaaagataagaaaattaacatacagaatgaaagcaatggcaacgtaagaggattactgagtttttacacatggagtcagtatttgtggggtcaattgtagcaataaaaaaagctttgtaaatcaagaacctgattaattatcgattcaaccattcacagttacaacagtgggcaggatatttgttaattccattataaaaaaagggacatcacaaataacatggcagaagtagcacaccaaaacttacacgggacggtttcatgaaggcaaggaaaacatcaaaatgaaataaaatatcaaaacaaattagatagaaacttccaaacaccaggacatacaaacagtctgagatgaccggtcggccattaaaggaagtagtgaaattaccatagtggaaggtaagtgtcttcctcattctttgtttgaatcttgtgctccttgtgtcttttcttcctctttctcaggctcaggtactggcctttgaagcctgtctgccattgtctccatgcccaggtagcactgagaaaaccagactagtgtgagcggctctataccgctgcctaggctgacagcgtgcaggtaccccccgcatcggctagcggtgtagcagagcatctcaatccacacatctcgcaccattttctccaatgtagaatggtcgagcagctcctccatgaagaagatgagcgcgtcagcaagctcgcatgccttgggaatgaggggtcccacgcaatccccataaacccagcggtgtcgcgccgtgtgaaggattcctttggcgagctgctgtgccggctgcgctaaggtgatgctgtgcccgacgatgtcgctatacttcgccatgaatgtgatgtcatcacaggcattggcaaacaggtgcgatcgggtcccaggcatgagcatctctggctgcgatgtgaagaggtacatcatgtagcgggatatctccagaccaagaggcacagctgaatctaatgaggtgttgtcatcattgctggtccgggtctg

SEQ ID NO: 88362 - DNA, 5361 bp, Oryza sativa
aaagcacacaagcaaaacatgctataagactactgaaataggaaacaaaactatttttaatggattctttgcatttttcttgatttactgagacttgaatggacttaaacggagctcggatgaattacttatgaattttaaaagataaactgtgtttttactaataaagaaaaagccttaatcactttattgcgcaataaagcccagggctaacgtcagcgaaaggggggcgccggcacgtgggccccacgggtcagcggctccaaagggagggaggtggcgcctggcaggtgggccccaccaggcggtagctcaaaggggaggcgagggaggcgccggccgggctcggctcggactcaaggccgaccggccgaccaaggtgaggcggcagcgaggcatggccaccgacggcggtgaccggcggtgcaagaagcggcggcgacggccgaaaggcggcggcgcatggccgaaggcgacggtggcggtcgaagacgacggcgcacgcgcggagggcggcggcgctcatgagagagagggaaggagggaggaaagggactcctcaccggacgagcggcggcgaccggagtggaggatggaagcgggggcgacggccgacgaacggacggcggacgggcggcggcaacacctaaagaaggggagggaggagttagggatggagaggacgaccgcgacgacccataatggccggccggagatggaaacaatggcgagctcaccggcggcgcgagggaatcggagctccggcggtgattcgcggcaacgaagcggcggtcgaggtgcgggcgggctcggtgagcgcgacggcggcgactgcgcggcgcggcggtggctatagtggcggcgggcgcgaccggagatgggcggcggcggcggagctcgggtgtgacagcgcgggcgcggtaagggatgtgggagaggaccgcaaatgggggaaacgagagaggggactcgggggagcgatttataggtgcgggagggggcggacgtggccggggaggtggccgaaaccgccggcgacgtggggtggagagagagagagagtggggtgggattcgaaatcgaatcccccctctcgagcgcgcgcgcggggcaggagcgacagggcgtgggcggcgtcgtggggaggacgcgggaacggcacggcgtgggcgcgggaggagcggaggaggtggggcggcagcggcggttgccggcgtggggcggcagctggaggaaggggacgacctgacaggtgggccccacctgtcagcgtcccgaaaagagggggaaggggaaacgggccggcccaaagaaggaggccgaacgcggctgggcgagctggattgggccgatggcccaagaaagaaaaagaggaaaagaaaagggaaaagggaaaaaaaaggaaaaaggaaaaaaaaggaaaaaggatttttcctgggattaaaatattgcgcttgcttatttttaattggttaaaattatttccaaggctctgaaaattccactaaaaatcttgttaatgcattggagcatggggaactcaagaaaaattccaccatgctatttccgattattaattgcatttattaattagggaattagctctaggttaattaagataatttcttcggacgatttatttagccaatttttaaagcaaggagagggggaaacttcagggcgtgacaaaattaccccttcagacccgaaaaccataaatttttcacgcctctttgagggtgttggcgagggcctccatctccaagttcttgcggcctatttcttcatccttagcccgaagacggttcttgaatccgtcaagacgggcccgcacggttcgttctgtcgaacaatgagccgcaagaatctggatgcaagataggagtaggcgaagagaacaaaatgtcaattatgagacatgtaaaaaaagaagagtggaaaatcaagaagagagaaaaagcatacccgaaccgccaagcttttaatagcggaacacccctcatcgaactcgttcagttcggtgaataggcttggggtgctggcaggcaagacaagattgcttactccctcgacaaagggaataaggtctgcccgggtcttgaaatcgccagaggcgaagtggggcgccgcaagggaatattccgaggcggatgtttcggcagccgcacccttccccttcgttttgaccataggcgaagcaaccggttgacgtggagggctgtcgaagatcctcgccgcagccgtcacgatccgttctgcggaagctgaaaccccggcggcggcgctaccacctgccccatcggcaccgagtgaaagaatgggggcggtcaaaaggtccaggctgcgcctagtgggcgaagtcggagtctcgtcggaagactcgtcgtcgctgaaaacgcgagcgatatcgatgagtcctccctttttggagatcttcttgaccggacctcccttcgccaccctgcctgacgaaaatgcaactagcgtcttcgccccctccaaatccttttgtcgaaggggggagctgttcgactccaccccggtctcgttgtgaactggacttggggtaggagtgtagccataggtgtcgacgcggtcttcggccgcctcgttcacggccttttcggcaacggcctccgcctcttcttcttcatccccttcctcctcctcgtcaggctcttcggcatcgtcctcgtcgtcggcgtcggaatcggaggaagcaggaacccttcgcttcctaggggcaagcttcacctgtccgcgcgttcgctttcgcgaaggtcctgtatcgtcatcggctttgtgggggttcgcccgaggaggcaattcgccgttgtaaacccggttcgcccggccggctgcctgtcgtgtcagcaactggctgtactcgacgaccgacacgtcgccgatcatcctatgggcttcggcttcagcttggtcgagtgtcaacactgcaaaagtaaagggtgtaaccgcgttgagcgtcaaacaaagcaaaataacaaagcgcaggagtgcatagcgaaagagcagtcttactattcgttccctcagggagaaccaacttcggcaaaccgtcagactctttgccttgatcaactgcgacttgccacgattgggagaggggaaagatgcgaagcatgcaaaattcctccaccaagtcgtggcagctaaggcgggagcaaaccttacgcagcagagcgaaccgcgcctccatagcgccgtccacggcgatcttgggtttccggttcggtgcgatcgccctgcgccggcaccggagggccttcgctgagtcggagccagcctcgaaggggatggtgtggtagaaccacctcgccatccaatggcgatcccacttcgacatggcggcgttcactggccagagatcgaatcgctcggggcgaacattaaagttcacgctcccaaacactgtcttcttcgtccctaccggggtaatcaccgtcttcgagttcacggtggcggacaatatggcaccgaagagttcggcgctaggctcgaatccggaagtccggtacgcccagtcgaagatagcgatccggaccagcgccgatgggctcaattgtgggagctccacctggaaaaggcgaaggatctccggcaacaacgcgttgcacggaaaccggagccccgcctcgaaaaacacggcgaacaccactgttcggttgtcgacgggcttcggtacaacggctttccccggggcgaaagcctgtccttcggctaacgccccagcactgaccaacttcgccaactcgtcgtcgtccatgagagaaatccccaaataagcagtggagtcgtcgtcgatccggccagggtcgggccctttcaccaaagaagggttaggcttgcggggagccatgacgaagggtgtatacagcggcaaacagtgtgtgcagtggcgaacaaagggagcgaacgaaaggtctaaagagccaaggagtgccaagagaagaagaacagaggaagagcgcgcgcggtgaaagtgactagcctagtagtaaaaagagaacgggggggggggagaatatatagctcacccggacgacggttcgcctacccaccagtaataaagcgccacgtgtcgcgagggtaggcgaaacggtaaattcccatcgaccgagctgcacagtaaaaagcccaattatggagaaggaaaagcccacgtggcccattactattcatagtaataaaagagactaaaatcccccccttcgacgctttgcagcagatgcgaagaggatattttctcaataaatttttctaagcataaaaacaaaacaagctttacttgcaggaatgatgtaggtttcggtaggagcaccagtcgaaagggggcgccacataccatattacatggtttgcacggtctcggccgaagctcctatctcacccttgcccgtgaggggcttgttggcgatatggcatgaggcctttcgaccaaacctgccgaaagcctgcgaccggcgaagattcaagcccgagacgttaggggtagtcaagacgaacctttcccatggcgaagactatggagcaaggatggcgagaggcaaggaatcgcagctaggctaaaggcttcctgggcgaagggcgcaaggcgaagagcatatgccgaaggggggggggcgacttcgccgtagcaggttcggccccggaagggccgaagaagctatcctggcccaccaagcctaggggtcaattgggtcggcaataatccgtcagcccactaagggcccatagaccgcaattacgttatatacccatgtaaatgtccctttcataagggcaatcatgtaaattcccctgtataaacaaagccctagtagaaagaacctgtaatggggctataaatagccctatagggccatgtaatagggggatccgagtaaaaaattctcaaattaatacactttgttttccaaccactgttgagtaaccacgtctttcgacctatgcggttgtcgtttcgacaacatacttaaaagacattgattttgaatttctaaattatgcactcctagacctccctgatctttgggttggcatataatatcccatcttataagcctatacttcttcttgtgctcatctccttgccaaaagaaacgtgatccataataatcaattttttgaagaactccttttggaatctaaaaaaaaatatcatcaatatagctaaactagagagcacagaattaatcaacactaacattcctcccacagacaaatgtttacctttccaactactaagtttcttttcaattctttcctcaattattttccagtccttgttactaagtttcctaaaatgcatcagaataccaagatatcttgtaggaaaactcc

SEQ ID NO: 88363 - DNA, 1087 bp, Oryza sativa
accgatctagcggccaactgtctcgacagataatctagcaaaaccaaaaagctaaagatgtctgcgggtactgataaatagagttagggtcgtacaaacccctctcgacgcacccctaatgggttccacacgatacacgggccaaaggcccaaatacggtgacgtaataccgggacagattctggccatcaaattgttcggtcaattcccattgactcggaaataatttgaacgtgggaccaaaaccattggaaatgatatcttcttagctttccatccatataaagaacgccccaatccgagcacgtatgcgacctgggcgcatgttttagtgcagactggtcctggactccgaattgcacctgacgtcgacttggtttgggcctccaccttgacttggacgtcccggatggtcctccatgggtctaagtccttctccaagtgtctgcttgtcccctccattgttactaatcacaatataatcattaggtagcaatccattctcgaattcatacaaagaagaacataggaacgagctcacctctaaatttaattgtcgctcacgagctcttgttatcggtccttgaatgaccgttggaggattgttgtgtgtatccgaggtagtgatgtccgcatcatcctccccctcttcaattgaagtcgtcctcgactcaagctcatcctcttctcccaagtatggcttcaaatctgaaatgttaaacgtgggactaaccccaaactcgggaggcaactcaagtttatatgcattatcattaatcttaacaattttaaaagggccatcagcacgaggcatcaacttagactttctcaattccggaaatctatcctttcgcaagtgcaaccaaactaaatcacccggttcaagattaacctcttgcctacctttactaccagcaattctatacttttcagtcatcttttcaatgttgaacttggttaactcatgcgttttcaaaataaattcagcgcgtgccttagcatcattatgaaccctctcacttgtaggtaaaggcaaaatatcaattggagcacgagggttgaaaccatacactacctgaaaaggact

SEQ ID NO: 88364 - DNA, 660 bp, Oryza sativa
cagaggtagacgacgggcctgacaggtgggccccacatgtctgcggcagcgagcgcgcgcgagggcagctgcggctggacttgggccgacttgggccgagaaggacagagagcggttatgggccgactttcggcccaaagccaaaagagacttttaaaatcctttttcaatttaaattattcatgaaatgcaattccatttattaaaaatacttccttagctcaaataaatcccaaaaaaatctaggaattatagaattaagcaaagtatttaataaaattttatctggccccattttatattggaatttattaattaaaattagatcttctcttctagacttttaaaataaattctaataattccaattaaacaacaatttatatattttggatttttagggtgtgacaaacctacccccttaaacagaatctcgtcctcgagattcggaagaactggcgaacagatgcggatgagctgacttcaattcatcttctcgttcccaagttgattcttcttccgagtgattactccattggactttgcaaaaacgaataactcgatttctagttcttctctcgtctatttcctagatacggattggtttctcaacataggtcagatcctcttggacttctatctgttcaagattagcttctt

SEQ ID NO: 88365 - DNA, 2672 bp, Oryza sativa
gctatttttcttccctcgcggaagcatcggtaaaaaaaattactaacagattacttcacccaaccaatcttcatttggtaaataaattattggcttttagtcatgttagatcttttcagtaaatcagttactcacgaatatatcactagattaatttcttattattagtagattagttccttattattagtaatgatattagtagataagttccttattattagtaatgattttttagttattttcagtagctcgatgccttatttgtggtagtagtatttttactgccaagtgatttttatttttaatgctatgtatcaatctattagtatttttatcatgaacgcttattaacgcatagtaaatgttttacttgatgacaatatatgagaagagtttttttttcaaattatatatcctacacaacatgaatacaatattacggtgttggctggttccttaccaataaaaattacagatgggaaatagacatacacatattcattttgataaaaaaaatcaagaagattgtaaccaatgactactccctccgtcgcaatatgttacaatctaggatgagattaaaccaatactagaactacaaatctggaagaggttgctacatattgagatgaagcgagtacatcccaactcgccaaataccatcgccggtgccgaagactcacggtcgacgtcaaaatcccactgccagctacatccatggtggagtcggtagcatcggcatgctccaccgaggatccaaccttcaccctggaacccgccaacatatgagagaacatgatgatgataattcagatgagagcagatttctcagaatactgcacacacaaatttgcaaatgacatatttctaattgacatttagagcatgatttgtctataaaccccataattttcataacatttcagagcttttgacacaactgtaagtatcaaattgtccagccgaccaaactaaaatttatgagaagggcatgtacttgcaaactgagagaacatgacactcagaactctgaatataatttctctgaacgaaaattctcccatctttcattcagcaataaccactgcaaatcaacaggtgagttgagagcagccactggacggattaaaaaattatcacttctgcacatgtctgtgtgaacaaaaaaaattcagagaactgtattgcctatcaagtaatactcttccaagctaggaaatttcagaagctaatagcctaataaaatatcaactagaaaatctaagaatctactagcacatcaaatagaaaatttcagaaactattggcttatcaattaaatgttgtccgaagacttatgagccgatagcccaaaagccaagcactaatcatattccccataccagtcatgccagaatcaaatctctaaactaggaaaagctgaaattgtttgtactgctagaacaagtatgccacctggaggttttatgaagcaactctttggtgctgttatttggaaccagaacaaaaggcatgcatcaaattagtgctttattagtagccatcaaattagtgtaggtggggactgaaccaacagatttttatggtggagatcaatacatagtcatctgttaaaatatgaacatctctaaattgacagataatcctaaaatatagttcacctttaatatgagttattgagaggattgatttcatcctaaaatacagttcaccttcaacctgagttattgagaggattgatgttatcattaatccgagcagcatctttgaaattaacaggagctggactgctggctactacttactgagttactggtaactaccatcatttgcaaaaccactggtattagcatttaatttgatgaagaagccatcagagaggagctctgttaattaccttaaatgctacatttagacttgctgatgttcttgatcttgacagcactccagatcgacttgcttcccaggctcatctgtacctatcagtagagagcaaagtcagagacaagcaaggactatgtactgtatccatcaatcgtgctgattcaatctattccgtttgcgagcaacataataatcatatgcaattcgtttcgtttttattgtttccagttttgcaggtttttgagaaagccaattttcttcgtggagacagaagaacgagtgcacaaagcgaagaccattcttaaccaggaatcagtatgcgaagagaaacaaggacagagccttggactattctgagccaagcaaatcaatcaagaacaattgcaatcgcgcagcaaagcgaactccaattaatccaaccaaaactgaaaaggattccaaaggaggagtagtctctagacagagcaacccgccatgagaggggaaaaaccagagcaagaagacaggaaagcagcagcagcagcaacagcgggcggggagcagcgaccggatcaccgcggcgccgctgccggatgacgtgccggccccatccccttcttgttcttcgtccaccggcgcgggaaggcagagaagacggccccgccaccgacatcccgactcgccgcctggctctcctggagacgcgcttcgacgacgggaatgttgaggagaggagggaagagggcggcgacggcaggagctagggttttgctcccgagccgcccaccgctgccgcaggccgttgc

SEQ ID NO: 88366 - DNA, 656 bp, Oryza sativa
gcagcccttgcataaacagcatttaataaacatttcagaatttaataaagcagttaataattaagcagtattaatccaacgctatacaacataccctgttctataggcccaaccattctgaacaaccatcccggctgcacagtcctatctccaaaccaggaatgtaccattccaaaccaggagctaaacaaattattaccatttaaagcatttgttatcatgatgagaggtgtgagactaatcacgaaaaacattgttagacccgcccataaccgcgggcacggctattcgaatagttttactctgatcagaggtgaccactgtacccacaagacacaaccccacatcatgtcaccatgtgcctcaataccaccacggtacctcggaaaggagttgtgacaataccccttgcataacacaatccaccgcagcgcacccttctggatcataatcacccccttataaacaaggcatggactccccagcgacccccgggggcttatctcgccacttctcagtctggtgctctgcaatgaaccatgctatacaaaagataaagccgtggccacgctggcttgttggttggcacggttattgtttcacaaccgaaactcgtgaaccggtccttaattgtcatgagcacgaaccatcaaaac

SEQ ID NO: 88367 - DNA, 8811 bp, Oryza sativa
cgacagttcccattttccctcttggccttggaaaagcgaaacagtggttttatgccaaccgcgctatgatcaacaattgggataaatgttcaacggcattcttatcgaagtttttcccgatgggcgaaaccaacgcccttcgcggaagaatttcaagtttccagcagacgagagatcagtctatttctgaggcatgggaacgactacaggagtacatggctgcctgtcctcatcatgggatggacgactggctgatcctgcagaacttctacaatggactcactcccatgtcccgtgatcatctggacacggcaagtggaggagccttcttttccaagacggtcagaggagcaatcaatctcatagaaaagatagtctccaacatgagctggagcgaggaaggagtccagacccgtcagcgtggcatgcacaccgtaaaggaaacggaaatgctcgttgcgaagctggacctcctcatgaagcgattggacgaccacgagaagaggcctcaaggcatcgtcaaggccatggactcacactttatgtgtgaaatctgcggcaaaatgggtcattctgggaatgactgcccagaaacccgtgaagaggcgatgtacatgggcaacaacaacaacaatgggttccgtccacaaggaggtcaggggtggaaccagccacgcctatatttccaaggaggcaaaataatggtaactattttaaccaaccttccttgaaggatcttgtttttgccaagccaaaaccacagatgctcttagctaaaagctggctactaatgacaagactttggaaaacataaatttcaaattagatggctttgcttccgttttccgaaaccagcttagttttaataaaatgattgaaacccagctggcacaattagttgttctagtacctgctaatgaatctgggaggattctggggcaacccgaaccctctgttgagaatgttaaggcgatcacgacgaggggtggtaagtccacttgcgatccaccgtatcctaacgttgtaggaacaggcaacgctctggaagcaccatctagcaacacggctgtcgaagaagtttggccagaaaggaccgggccgcaggaatgttgtgacatgaggctgctgccattcccccaaaggtataagaagccatcggtggatgaacaatttgctcggtttgttgaggtaatccagaagatccacatcaacgtgccattattggacgcaatgcaagtgcccacctacgcacgttatctaaaggacatccttgacaacaagaggccactaccgacaaccaagttggtcaaactgacagaggaatgcagcaatgttatactccacaaactcctagaaaagaagaaggatccggggtgtcccacgatcacctgctcaatcgggacacaaaaattcaacaaagcactctccgaccttggtgcaagtgtgagcgtcatgcccaaggacgtcttcgataaactcaacatcacggtgttgacaccaacaccgatgcgcatgcaactggctaattcttcggtctggtacctagctaggatagcggaaggcgtaccggataagatacgggatttcttcatctcggtcgacttcgtggtgttggatatggattcggagaagaaaacgtcactcattttggggcgaccattccttagcaccagggacgccaacattgatgtggggacggataaaagttcgagtttcaaccaaggatggaacaatgctccatggtgaggatcaaatatggaccaaacacgcaaaatattcaagtggccgaagtggagccacccaaaatggatagcctggggaagttcatgcggaacttcctgggagagggagcacccgttcctaggatccgttattggaagacgccggcacagtctaaaacaccagccaagaaaccagaggagacggctccagagaagccgccgtccacaccaaaaccaaagaaggtgtggcaagtgtagcaaaagatgctcgctccatgacatccgtagacggttggaaaattagcaatctaaacgaaaggagaaacggtcttgctcgtcagatccaaaatgacgcggccctcaccagcaggtaaattggtatgtacctacatatttatttctatcaatttggattctttatcaatgcatgtttgagtttccaaaaaactacatttagatttgagttttgaggaaattacttcaaatgattttttcagagcaaaacaaaataaaattttcaacaaaaatttgctatgccacgaccatactggccattgggttccaacggtcgaaagtggggccagttgggcccaccaggggttcggttgaaccggccagggcaacggtcgggtgcctctttctttgaggcaacaactagtgggtcccaacggtcggttatgaccgttgtgggcagcctatttaagccaactggccagttgaggaaaatccatcccatttcaactcattttcatctcctctccgaactttgctctcaaaattcattcacgctttgcaagtttacctcaaatttaagccattagttgcattcacaagtttccttagtgaagctaaccggtgggtaaatatctcgctattctaacccccgcccgagttagtccattcttattcatttgtgcagaatgaagagacgattgtcccgctagttcaatatgggagccggctctcgatcaagtcatcatgacgagtctagcactcgctcatccaccgatgcctcaatggaggatgccgacattccacatctcttgaacgacgccgacctcgaccttgtcggtgactgggaaaggcaagcctactccatgctgaaagaccgggtgtttgctcacacgcgggcatatgatccggagctgctgaaaaaaaataggtatggatactgattttcgtgctatttgaaaagctgttggatggcagagatttgctgtagtagatgagcctggttctcgtttgcttactttgcaattcctgtgcaccttgaaagaaatagaagatggaattttcttttgcttttttccataaagaatacacacttacatggaaaggattaagtacacttctttgttttcacgattcctgtaaaatcaatcttaagaatggaatttctgggttcgagaaaaacagattttgggaagacatttctggtgctccaatttgcaagaaacctaggacgaatgacatccataatcctacacttaggcttatgcacaaatggattgctatgactttgtttcctagaggtgatcttagacctataagagaggatgaattgattatcatgtttgccatggttaggaagattaaagttgctcttgtaaaatatatgataagtcaatggttagagagtataagatttactgctcctgttgagtgcacttctctggttactcacatagcaagaggacttagggttattgttaatgatcaaattgcttatattttaacccctcgttcctatgttgatgagaattatctagtgtaaggtcatattcttaagcatatagtagatggatctttcatattctttttcctcagttgtatgaatgaaatcctgttacctaatgcgggatatcatttgtacaactgtcatgagctaaccattcccctataaaccatagaagaatctcgtgtaggtggaccatacagggagacatgcaacatggcaagaatggaacgcgaaggttcaacatcctcaacacccgtgcagatgtatgtggccggttgggagccatctggggatgcgcccagatggacccaagctccaggccattgcattggaggctcgggctgggaaagtgccagtgagagccgacggcgggcgtatcatgacatacaatggggtgggttgaacactcaatcccccggatcaagcagtatgcctccatctcccgctgaatggcgctcaagttcctctcgttggaacttgggtgaatcaccaggagaatggatacccttgatatgcaaatgggagagatcaaatacaacctcgaggaacacatagcacagacgcaagaatagcagcaaaatactaatgctcagttcaccaacatcaacaacctgatgcagcaacagcacgatgatcttcaagcttacttccgctttcacggattcaatccttatcaaggactctgagtgaaagccaagcttgggggagacgtctctcgccccactgaggtaacttgtatcattacatatttccctttccatatgcatgtttatttttccaattgcatcctataaactaaaaacatcataaaattttgaaaatagaaaaataccgaaatgataagttagattttattatcctaggtaagacaacttagttctctttgttgaaataacgaatagttgctctgttttttatctctcatatatgggttcatggttaagtactctctcaaaaattgaataagagtagccaacaattatccgggaacctgagggaagtgagctgcacttgctaatctgagtttaagttgctgtgagatatgagatagtaataagttgctataatcctagtctgagtttgacttgacttacggatgttttattttcaaaaatgataaactttggaagttcctcacttgatataaattcctaccaaagccaaaaatattcatattgattatgccatatacattttggttatttgcaatttcattgaactttgtcaagtccttgtgacttgtgttgatactttccatgctctataatcaagatcaaacatccacatatatgcacatgctaaacttctgcactggaacctagcagatgtccattccatctccataccaccatcaaaataaattctccatgcttatatgtgctttcttctcctagaaaagaaaatcatttatgaaaaaaaagagagaaaaggagggaaagtcatggttataaaaataataaagttatgctctatcaattttgaacatgatgttgaaaaaaaaagaaaataatgtgtagccaaaccctctccttatttataaaggaaggattttggagaaggaagtaagcacaaaggagaagcacaaagtcatggttataaggaagtatgtttagttatctattttagtctaagtttttgacttagtaataaatgtgaatgcaagtatgccatgtttgattgctaccaagctccatatatcaaccgtagaataggaataaaaaaggcaaattgctgaggaattcatattcatatacttggagagatcgagtgaatcatttgaggaacttggatttcttttgcaaaatcatttgaaaaactttcggaataattgttgaatgtagattgggtaattagtgctctaattgatgttctgtttctcaaccgctctttacaaagaaaggcagtgtcttgtgggaatcaggggtaaggataagccaccgtgccaaatttattaatttgagagagagagtacacataccttgcacctgtacatttgagatatacagcatggtagcaactcctgatcaacaatcaagtttttttttgtgagtccttcactcgggacgagcaaaggttcaagcttagggggttttgttgacggttgttagcgatcagtttcgcccgtcaatattacctttaaataaaagagaactagttatgcttgcaatgcatatttgtgtttaaataataaatattcaactagtactaggattattaaccccttgcagagaatgagcacaaaatggaggagaatcgacaacaaaacaggcgatcgatcaatcaggacaatgtcaagaattagacttatcaatgaatgggccaagaactcagaaatgacaggaccaattgggccaaaattcacaagtctgcaaaatatatcaagagacaaggccgctagccgaaggtgggctggattgggccagcccatggttcgaccaaaccctcgctggtaccattggatgcaggttttgtttttggacggcgtggatcactacccaatgacggttggagggcaattccgaccattccaacttcacaaccatcattggcagcctttttaaggagctcctctcatcacttcttccacacacctcaagcaagaagcttcatacatctctcaagcttagtatagtctctagagtatagtggaatagaaatagaatagaatctttagtccttggagtcttcggaagaattcaggtatggctctagtagcttttccttcttttgtaagaattgtactttatttagaatattcttctttatactactttggtattgtactactttccgagtatatgagtaccaactttattatatatccaagttatattcattatgatgctagcttatctaggagatgcaatgatgtgggtataatgatcgtatttacgatgactctatatcatgactctatatctaaaagtatattaataggatttttctattttcctttccactttgcttagataattatgaatgagagtataaatgcttctgcttagtgtcactctaccctttgaaatatattaaccccttcctagactttggttattacaagtaatattaaattattagtatggttttctctattataatcttcccacgagattaaacaaatatgatacccttggaatactctcagttgaaatgctacaatggtatatctgtgcgcttgttggtgaataaccataatatgccagaagtatttctgcgccattgctaggaattatatttctagtaatgtcgttaagaaatagtaacacttgcccgctgtgttgggctgctaagggggtggtgatatgccccttgccggcctaggtcctaggcggtcgcacaaccagcctaggcccagggccagccctgatgatggattttcttttgtgggtacaattgtataccttgaccagagtaaaactattcaaatagtcatgcacgcagctatgggtaatcgaccagcttcaccacgattagtcctactctattgcttaacttgacatagtgaacttgtgtagttcaggtggtatggttgggcctattcaacatggtatagcattgtttagaggatatttaatcttgccttaattaattagtagttttattgttttcaactataaatgtttacaaccgcctttatgcaaccgccttgtctccccttgcatgtatgcatcgttggtgtggcttgctgagtatggtggttgtactcagtcttgctatattccccattttcagaagtgtagtgcttatgtgttgaagatgaatgtagaggacgaaggcttatacctcagttgtgtttttgcctgtggggtggagctgaagtcccgctaggatcgcccgaatttttgttgttattgctttcttttcggtttgaggactaaatgcgtcctttgtaagcatttacaggttatttacgtttggatctatatattaatttgtcattttgtgtaccttggcttaattatggacagggatttatacacaaaatagtctagaaattggccaaatttcatagcataacatcgttgcaaccttcaatgaggggtaaaatgagagaagggagccggttggtatttcttaacgacattactagaaatataattcccagcaatggtgcataaatactctgggtatattatggctacagagttcatccgcaagggcacggatattccattgtagcatttcatccgagagtattccaaggttatcatatttgtttaatcccatggaaaaattatagtagagagaaccgtactaataatttatatattacttgtaataattataatctaagcatgtgttaatgtaattcatagggtaggaagacacacaagcataaaactactcattctcatattattctaagctaagtggaaagtaaatagaaaagaatctattcctatacttcttctagtatacgtattatacgtacatcctagttataatattaactagctaatatcctcttttcgatgtcctcctggtacttcgagaagccacccctgactgtcgagttccatacgacagcccatcatgaccatacaaccggggctaaatacggaggagtaccgtccccaggaaattaacttaggaatatatacacgagcgaaggaatacccatactgagctgtcaccatcagcggcccacctctcttccgcagcatatatccctaaataatgatacccagtaatctagacaccacgccaaaactactatatactactctaatatcatcgtcatgacatagagtaaatgcataagcaaacattatacccgtacctatccatctcccagataagctagcagtttaatcaatataacttggatataaagtaaagttggtattctaaataaaattggaaagaattacaacaccagaattgtataaagaagaatattctaaataaagtacaagtcttacaaaagaagataggagagctgctagagccctacccgaactcttccgaagactttcggactccgatttctattatattcctactccactagcttgagaatactaaactaagcttgagagaatatgagagagttttgcttgaggtgtgtgttgaaatggaggatgagagggctttatatagcttgagaatgacagttatgaaggttggaaagattggtaatgccctccaaccatcactggggagccatctcagccgtccatccaagcctcgaatcaaatggccgtgagaaaggttcggacgaacccgagccaggggccggtccaactagcccatggtgtggctggtggcctccactcttgatccctgttgtagacttatgaattttggcccaatccgatgtgacatttctgagttcttggctcattcatgcat

SEQ ID NO: 88368 - DNA, 543 bp, Oryza sativa
tcacatcatctggacgtgctgcaaggtagaaagactgaatataagataagtttgtatcttaatggaaaactaatatcatctctaatctggcatctgtactatctgcaggctaattgccaagtataggccaaccatgcctgttctatctgttgtcattcctcgtctaaaaacaaatcaactgaggtggagtttcactggcgcatttgaagtacgtgatcagcctttctttttctactatgtccatgatctgtttctaactttctatacagatgtttagcttgtcttgtttggttaacgcttagctgttgtagctcatatttcttgtatccttgttctgcaggcaagacaatcgctcatagttagaggcctctttccgatgcttgctgatccgaggcatccagtaagtttggcttctttgttgactacagaaattgcaaaaatattcatgcaaaacatacttggtggatttattttcttgcaattgaaaggcttggccttgtcatgggggctttttcagatttctaatacattacaatataacaa

SEQ ID NO: 88369 - DNA, 663 bp, Oryza sativa
attcctgcagcctgaccacctgcctatctttgttcatgttgggttgattgatccgcatccatatccgctcgcgcgagcccttcttttgatttcgattctgtatctcgtaatttggtcgatgcgtaggtggtcagtcgtcttgatgtgatggaggatataagctttccctacatgacacgcgagatggccgccgtactgcggcggagccgtgttgccgctgtcgaacacaacaattttaacatcaggcagcttgctaatccttaccatgggtatgttggcttctttcctctctctctctctctctctctctcttatatatataactggagtatctcggacgcaacagcacaatcagtttatgcatattgatctaacctgtctcaatttgcattgttcgtaggccggctgatggagatatcctgtatgacagggcatggattaacaatcttgctctgctttttactctctccacgttatttggggcgtttagtactctagccaagctaaagcagacacggacagtggaccaatgtgtccagacccaaactagttaaagcaaccactgaggttgtatggattccagtcccaaacttgttaaatcaaccgctgacgttgtattggatatcatactctgtatgtcgtaatacttaatttcatatgcta

SEQ ID NO: 88370 - DNA, 513 bp, Oryza sativa
tcgttcagaacggtgtttatcaggtggggctctcatgcgagcttgagccgttaacagatgatcacgaatcaaattctgcatcttatctggttccagtagccaatccgacaactctggtgactgacagagagcattatcagataaaccaaaatatttgggtttgcgaccatatagcacttcaaaaggagtagttcccaaggatgagagaaagtatgtgttgtaccaataatcagccaaagccaaccgtgtactccatgagaagggcaagcatgcacaaagcaacgaaggaatgtttccaaacattgatttaccctttccgtttgcccgtcggatgatacgatgaactcatacgcaattgagagccagccagtcgaaacaaggtagtccaaagagtgcttgtaaagattctgtcgcggttggaaataagggattgaggcaatccatgtagcttatggatgttttgcatataagcttcagccacatcgaaggcagtaaatgatgaactacttgcag

SEQ ID NO: 88371 - DNA, 703 bp, Oryza sativa
  unsure (1)..(703): unsure at all n locations
attcctgcagccctgtaggttaagacctaagaaaaaaataatttgaagttgtataagaacccagactttcacttcaatgggctggtttagtttccaactttttcttcaaactttcaacttttccatctgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggggganagccgctcctccatctatgaggacacgccccaacttcacgttgcagatagtgggggaaaccaccatcgcaatctgccctccccgggcaacgcacggtgggtggtcggtctgatcaaaggtgagggccacctccgaccaccgcgcccgacgcgtcgcctcatgagtaggggccgcggctagaagctctcgcttcatagccttgaagctccggcgagaaacgtgagcacacgctcccccgtcgacagtggcaatggtggccccaggttcttggaaacctaggtcatcatcaccgtcatcggggtcaacggcgggggccttctgtctggcctcacttcgccgtctaccggagggaactgcccgcgacttgccctcaccgcgttcctgctcctgtgctcctcccactttctcggtcgctcagcccaaatttttgact

SEQ ID NO: 88372 - DNA, 676 bp, Oryza sativa
attcctgcagcccttagttttacgagtactactaaatacactgtaggttaagacctaagaaaaaaataatttgaagttgtataagaacccagactttcacttcaatgggctggtttagtttccaactttttcttcaaactttcaacttttccatctgtcggtgatatgggaccgggagtatcatgaccagaggcttgaggcagacgcaatcgcccacgtggcctggcaccttcggggacgtcgggcccgagggtgaggtgtccgccctcctcctgatttcccccgaggggggggggctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcatggtatagtattgcggacttggcaaaaccgctgaatgtacgagcgaagccactcatcctcgcctcgctgtactgtctgcaggtccgtttctttcacctgggcgcggatatgtgccttggaagttcatggcgaactgttggcacaaaatcttcc

SEQ ID NO: 88373 - DNA, 4162 bp, Oryza sativa
tacagagagaattgcaacgacgagagaattagagcaaaaggaattatggcaactcaatatagtagtcttctccgattccaacaggaatggagccgccgccgcctacgccaccgtggtcgccattcaagttgccctcgagctcgctatatatatatatatatatatatatatatatatatatatatatatatatatatatctcctatctctctcttctttccccttgttcacgctagcctattacaatatggacttctattacatggtccagttaggcccacagtacttgggggttttgcttaacaggccttgtagtacgacgcatattgcctccctttgactgcacagctccaacttgacgatcttcagcttcgtcagagttttgctccccaactttagtcaatggaacatcgtcaggtaccgcctgatccttgacaatcccctccccttggaatttggaaagtcgctggaaaacgagcacggagttcctccaaatcctcctaggtggcatcctctgctgcagtaccagaccaatgaattagcacctgagatacagctgaattacctttattgatcaccctggtatcaagaatttggagtggcacttgaaggtcagaaagagctgaaggcaaagtagactggatgtctccttgaaaaccacaagctgccttaagctgggacacatggaacactgggtgaacattactagtctcaggaagctgtaatttgtaagctactataccaatcttctgcagaacctggaaaggcccaaaatacttgaaggaaagcttgtggttagctctagtggctacagaagattgcacatatggttggagcttgagatatacccaatcaccttcagcaaacgacctgaaactccttttcttgtctgccatgtgtttcatttgttgattagctctattcagatgttgctgcactaaggcttgcatcaactttctttccttgagccattcctgcagatctgggattgcacatgcttccacagaaataccaaagtgacgaggagcatgaccatataagacttcaaacggagatgccttcacggaagagtggtaagaggtgttgtaccaatactcagctaaatgtaaccaagtggcccatttggagggatttgcatggacaaaacaacacaaatagatttcaagacattggttaaccctttcagtttgaccatctgactatgggtgataagatgtactcaaatgcaattgtgtaccagaagatgtaaacaggtggttccagagttgactagtaaaaatcttgtccctatccgagataatcaccaaaggaagcccatgcagtttgtaaatatgcagcataagagttttgcaacttccagagcagtgtaaggatgtgcaagaggaatgaaatggccatatttagagaacttatccacaattaccaggatgcagttaaaggacttagacctgggcaaaccttctataaaatccatggatataacttcccatgatccatcaggaacaagcaggggttggagaagtcctgggtatttagctctatctggcttagcttgaatacaaatttgacactgctgaacaaatttcttagcttgagatttcattcctggccaggcaaataatttcttgagtctgctatatgtgactgggaaaccagagtgaccaccaagtgggctggcatgaaattcagttaacagtttccattgtagctgagcattattacctatccatatcctccccttgtatttgataacaccagattgcagttggtaacctggtttagagtcagcttgcagagccaaagctgtcagtaattcggtagcgtgggaatcttgttcataccccttaaccacatccagtaaccaacttggagtgcagttggatataatagacaattctgcatctccttggaacttccttgacagtgcatctgctgcagcattgcttgtcccctttctataacagattatatagttgagtcccaaaagcttagtaaaagctttatgctgccaaggggtatgtagcctcttgtctgataggtgcataaggctgtgatgatcagtgagaattatgaactctcccaattgtaagtaggacctccaatggtcaacagctaaaagtatagccatacattccttttcataggttgacaaaccttttgttctaggaccaagtgccttactaacaaaagctattggatgtttgtcttgtgacaaaactgcaccaatccctgaatctgaagcatttgtttctactgtaaatggtttgctaaagccaggtagtgctaggactggtgctgaaactagagcttgtttgagctgttggaaggctaattctgtttcctgagtccatttgtaaggaacccctttcctcagaagatttgtcaatggtttactgatgataccaaatccttggacaaacttcctgtagtagccagctaagcccaggaatcccctcaacttcttttgattggctggagtaacccaattaacaacttcctgaattttaattggctcagtagcaaccccagcagcactgataatatgccctagataggtaagttgttgctgagcaaatgaacacttggagagtttcacctgccattgatacttctgtaacagggacagtacttgctgtagatggtccagatgggaagacagatctggactgtatatgaggatatcatcgaagaatactaaggcaaatcttctcaatactattttcaaagtttcatttattgcactctagaaagtggttggtgctcatgtcaatccaaatgacctaaccttgtactcataatgaccaatgtgggtctgaaatgttgttttgtattcatcaccttccttcattcttatctgatgatatccagccctcaaatccagttttgaaaaccacttagcacctgacagctcatccagcaattcatcaataactggcattgggtaagaactcttaactgtgatagcattaagctgtctgtagtcaattactaacctccaagttccatccttctttctaaccaataatgcaggtgaggcaaaagcactttggctgggttgtatgacccctgtgtgtagcatttcagagatctgggactctatctcatctttaagggctggattatacctgtaaggtctaaggttgacaggttttgcactaggtattagaggaatactgtgatcacaaatcctcttgggaggtaacccttttggttcctcaaaaacactcttgaattgatccaaaatttttctgacagaatcaggaatttctgcagattcagtctgaaacatagaattcaactgaattaagtacattaaggatccattcctggccatgcctagacactgatcagttgatataggagggcaaatagtagtctgagttgtgatgccttgtagggtgatcaactttccttccaacataatctccaaccatttgtttacccagtcaaccttcatgggactgaactgctccaaccagtccatccctaaaatcacatcatagcttcccaagttaagtaacttaaaattacttttgaacacatggccttgcatccaccatttgcacccccagaatttgttggttacaggtcatggtacccccatcagctatctttacaattacaggttggcgcaaattagtaatgacagagagagtgctgccaatttctatatcaatgaaagagtaggaactccctgagtcaaccaacatgagtatctcagtgccttgtatccatcctctcaaacgaatcgacttggaggattcagtaccccacagagcctgttgggatatagccatcaaagtaccttcatcttgctctttggttccttcaggactagtatcattttcagaataagattcagactgcagagcctctaacaattcatgtacaacatgtaaatgtactgtagtggcacatttatggtccctaccccatctctcaccacaaacaaagcacaaccccttagatcttctgtaggccttgagtgaagccactctgtcctctttaggtttggttgattcagtcaccttaccaccatcagaagaactaccaggaaaaaatttatgccctggagtggcaggaatgaagctagagaatcttggaacttgtttatagacagatggtgagtcggctcttttgctaacagtgggtttgcaactat

SEQ ID NO: 88374 - DNA, 666 bp, Oryza sativa
gctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagatttaggtgacgggtggtgacaatgagtccgtgtcgagcgctgattttttcggcctttagagcgagatttatacaatagaatttggcatgagattggattgcttttagtcagcctcttatagcctaaagtctttgaggactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagtcgtttttgctcacgaatatcagaccagtcaacaagt

SEQ ID NO: 88375 - DNA, 546 bp, Oryza sativa
gcgagcatggtgttcgtcgccgccacgctcctcgtgctggtcaccagcttgaaccactggctctccgggtcgcagctgttgtccgcgctcaggcaccggcacgggttggtcaccaagctccggccatcgtcgccgacgtccaggcagagcatgccgccgttgctggtctcgggggacgacgacgacgacgaggcgttgacggcgaggtgcagcttggagtccgaggtgaggctccaccgcgccagctcgtcgccgcacgacaggccgaggcgcgccggccggccggcgccctcggcgcggaggcacagcagcgggctgtcccgcggcgacagcctctgctggctcgccgtgtacgcccacgcctccgcctcgccgcaggaccccagctccagcgtcgtctgcaccaccgacgacgaccgccgcaccacgcaccgccccgtcgtcgggtggaacatcaccgtgtacggcgccgcctccgccagaccaggccctgcacacgccaaaccaaagtcatcgccggagaagatagataccggcggcggcggc

SEQ ID NO: 88376 - DNA, 2003 bp, Oryza sativa
aataataaaaattcagaaataaaaataaataatattggaagaagagcatagagtctatatagaaatacaatttacagaaaattcggaattaaatataattaataactgacacgtatataaaatacaatatgaatattacatatttgtattttcgtaaagctattgcaaaatttaaaattatgatgtaattttaatatttttgaataatataatgagaaaacatatatgctattatataaaagaaaatataatgatgctagccgcgcaatctgcacgggccaccatgctagttattatatattgggtatacttaataggggcccttaagatttggggccctgtttagtcgcacagtccgcactggtacaagacgccctgacaagatacaatgcctctaatcctcatcctctttcaccttcacattaccaattcatgcacttctctcaccaccaaagacgcacgtactcattttttttcctactcctccaaggaaaaaaacaaaaaaagaataaagatagtgattgaattgatgaatatgtggacggacgacaataccgccatgatggagacctttgcctctgcagacctttacgtggaggtagcttccatgccgccgcagcagcagcaggtggtgccaacagcgctcgcacccacggtgacgttcaaccaggacatgctattacaactcctccaattcatcatcaaggtcctattaagaatatacgtaaaacatttttttaaaattttctatgataattgtatacacgtaaaagacttatgtgtataggatacattcccgtgcaacccatggcaattatcaaccgaaccaattaaccattcgattattttgagggcgacccatgcattcgcgcgccgtggtcggcctgcgttgtctgatctcgatcgcgatggcccgtgacgcgaggcttccgtgacccggtttgtccaagtttactccgtacgtagtagtatatttgttgccgttgccaatggaacggtactcaggcgggggcggccggctagttccacacgctgccaccgctttgccgaacccgcgcgtcgatcgttcgtgcacgcgtctcgcatgcatcctccacaaactccggccgtattctgcacgttgatgttggcctctggcggtccaacaacagcgctgccccaagccatccagatacggccatacgggaaaaccaatggcgatcggcgaccgggacgaccatccgtttatctgtaccttgaaggtgacccgtgcgcacgacgctcgccgccgcttcctgtactgtctttacccaatcctgcaccggaaacaggagagagagagagagagagagagagagagagagctagtaggaaccggattaacttcacgacggcttccatatgctccccgttctagctggccctctctgtaatgtactaccagtagtactgtcatttctcaccaggacggctacacagctactgcgtttatctgagctggaagtaggaaattcgggaacccaccgagcttaaatttttacagtatcacttttgataactagatatatactccatagtaatgatactccgtaagttacatgcctgcatcgtcaatgagcatctctgttactcttgctcttggtggcgatgagcacgagagggttcttcttgcgcaccgccagcccgttctcctcctccacgtccacctcgcgccccggcagcgcgcgccagtcgaagcagaagaggaggttggccagcagcagctccgccgccgccgccgcgaagtgcacgccggggcagctcctccgcccgatcccgaacggcaccagcgcgaacccgtcgtgctcgtgctgctgctcgccgtcggcgtcgtgggcgcggtggcgctcgggcaagaaccgctccgcgttcgggccccagacgccggggtccgtgtgtatcgccatcgcgttgacgacgacgcgcgtcctggccggtatctcgacgccgtgcgccgtgcggaacggctccgtcgtctcccgtgg

SEQ ID NO: 88377 - DNA, 4356 bp, Oryza sativa
gatttttttttcttctttttcttcagaggggagaggacggtgaagaagctgcggctgacgaaggcggtgacgatcccggaggggacgacggtggcggaggcttgccagcggatggcggcgaggagggtggacgccgtgctgctcacggacgccaacggattactctccggcatcgtcaccgataaagtaattttcctcttcttattttatttttcaaatcaatctgtgatgtgttttctaagctggaggtggttgcgattggctaataagtgggttttggtataattgtactctacgaaactccatatagagttttgcttgtgtctacatcaagtgcctagatttcttaaagatggacgctttatgttattgcaactttttcttaggactgcacaactcctctttgccacatctgacttgttcaataatgaatcgttgagagtttaaatactttgactaatgctccatgaatcaattgttatttatgtattttgcttcttatgtattcgactgcggcccaaccatgttgtgttttctttttttcttttttctttgcgggtgcctatgttatgtgttcgactgtaagtttgtacaaatcacagcaatgatttaatactataagtacatgccaaagtatcttatgcttatggtacttaaagcttaaagtagatgctttatcttttcgcccttatttgcataattgggatataggacatggctggtacttctagcttaaaggagataaggagattctttatcgtttcgtttcttatttgcttaatttggatacaggacatagctaaaagggtgattgcagaggggttgcgggttgagcaaacaatcacctccaagatcatgacacgaactcctgtttatgtcatgtctgacacacttgctattgaagcactgcagaaaatggtccaaggtatcttgtaatcttaaagcatagacccagtgatctgcctgtttggttcagatacttcggacttgggtcaattgaactcacttcctttaactcctacaagctgctgtggagtatatttcatatgcattagttatctttgttgtagctacttattgtgagaatgttttggataataatgttgtgatcagtaaatccttgttgacaatgttggactagccatattgtttaaaattatcactatttttgtatttctgagaagcttcaatcagcattctctttccctgtttacagtataatctctttgaaaatctattcggtcaagactattaaactatttgagtacttccatttttttttctcttttcttgcagtcttttatgcattcatcagtttgtcttttcaagtttgttgcatttccttttagcaataatctaaattaatttcagaggaactttctaatttctagacattcttccagtattgagagtctcattggctaaatttaatttactataggacaactgcatatctttaacctctgaacatcagcattctacaatcccaatgacctgtatgcatattaagaaagcattattcacttgttaataaagcagtaacagctatgctatgaaatcaatggtcattgttagaaagtttgtttcttattttaataacatgggctcatcattccaattgttttatatactgtctctccgtattccaagtatgttcattttcctctccttagagctaatatgaaacactcacgttttaggaaaatttaggcacctcccagtggtggaaaatggtgaggttattgccatgctagacattgcaaaatgcctttatgatgcaatatcaagactggaaaaggcagcagaacagggaagtgcattagcagctgctgtaaaaggggttgagcgtcgagtggaagacaacttgccaggttttctgttgcatatggtgctgactagttattttcctttgtttcactctaaatgttcattgctacacaagaacagaaaatgtatactgcagtcagtagccatgtgaactaggttatgagcaatttgtaatacccagtttatcccaaagaataatgagatgattctcaggattggaactatgtttgatgtttgatgctttactgtatacatttgtacattattttctaaatagatttcacttaaccactgttttctggtcttgtttagctgaccaaattactgtgtttaccatttgcagatcattccagtgtaatagaaactctaagagaaaggatgcttaaaccttcattgtcaaccattatctcggagaacacaaagtacatgaaatttttattagtattccatttttgggataaatccacaccatgccactgagttttattcatatccatagtagaccactcactgtgaggatgacatgtggccatgtgggcagtgagacatcagtagtatattgtagacactgaatgaaacttggtggtataaaatggatcatccaacataatgtggtttgaatcatgggagttacctcttttttaacttgcagagtagcaattgtttcaccatgggatcctgtttgtgtagcagcacgaaaaatgcatgaattacgggttaactcagtggttatcactgcaggaaattcattgcaagggatttttacgtaagcatttcaatacttttatggaataattctttattctagagtttatattattttatatttcttaaggcactaatggctatgtcattgtgaaattcagctcaaaggatgtgcttatgcgcgttgtgacacaaaatctctctcctgagttaactcatgtagaaaaggttgtttctccagattgaatattattttaaatgatttaaactaccgatgggttatacaattcattctagactaacagcattactcactgttttgctcaaggtaatgactgcacaccctgaatgtgctacattagacacatcaattctcgatgctctgcatattatgcgcgatggcaaattcttgcatattcctgttgttgatggaggtaacacttgactcttcttcagcctaaggtttctctttatggtactagtattttatatctgactgaactttttaattttaaaaatgaacagaagggagagttgttgcttgcttggatgttctgcagattacccatgcagccatttcaatggtctctctgcacatgcgtattttttcgcttctcattccttgctttttccttatggtttccgttcatctaacatcattctgtgtgaaggttgaaggaggtcctgagaccacgaatggtgtggcaaacacaataatgcaaaagttttgggactcagctcttgctttggagcccccagatgaggaatttgatagtcgcaggttaattaacgcttccttttttgtcctttgtcctctttttcaaatttgcaattcttacctgcatttttgcattgttcagtgaaatatctttgctcatgccatcagaggctggagatggcaggagtagcattaatcctcctgttgttggcaattcatttgtctttaagattgaggaccagaagggacgtatgcatagatttgcatgtggtaggtgttacaagttggttgaatgttaaactatggttgtactgctctaactaacagtttggtttgttccgtctctgcaggttcagagagtttacatgagctggtgtcttctgtggtgcaaagattaggcattgatggcgaaaagggcacagttcaacttttggtaatttgttgtcccttattttatgtatttcgttagtgtttggaagcaaaaaaaaaaaaaaaggttgtcagtctgatcatcgttcaagaagttctgttgttttatatggaatgctaactgatgtaagaaagtacttaaccaccatccacttcaagaataagaatttatctttatcttatgtcaccccatatctgtatctcagtatcctgattttcttatagacattatattgaaccatagagactatatatagtgttgcctgtattatagaaatttataagttgactggcataaaacggtcttattttgagtagcgctggtaactaattatcccatgaaattgtgaatgcacccttaactgttacaagcacttcacttacagctcaattatcacacctcagccacaattacaagctaaattttgataatgttccgtacagtatgatgatgatgaaggtgatagggtgttgctcactacggatactgatcttaccggggctgtgctccatgctaaatcttctggattgaaggtttgtcttttctgtaatcctcaaatagattggtccctctgttttcacattgcgttctttttttgttcattggattatgactattgcttcaccggagtgaaattttcaatttcagtcattgaggttgtacactgatgagtcaa

SEQ ID NO: 88378 - DNA, 685 bp, Oryza sativa
acacaaaagacgggaatctttcgggttaccttccgggccctcctttaaggtcttccctggcgaaaaacctttcaaaaaggacccttattttttaggggattcctttaacaagaacctcaaaatgcctggttggaagttggggatttttggaccccaaataggatgaagtcccttccttgcgtgtcaaggaggacagcatcctatcaagaaatgagtcaccgtggaaacaaggagtaaggagatcaagtgtacgatctacgatcagcaggccagcagatctcttattacgaccaacatcatatagacttgacatatccatcatcagcttcccgatgacctttgatgtatctccaagtgaaaatatatcgagctttaggtccatctacacatgttttgtaatacggatcactaagtggttatatgaatgaaaaataagaagccactagtaagaaatatgttcttatgataaatctttaccttactggccagatggtaaaggaactgggcagtcaatgtcactccggggggaatctcatcaccatcaaaagatctaccagtagatatgggaggtagccctggactaagggaatcttcatgatgagtagataaacatgattcacccattgtgccttcagatggcaaaacaaaaggcctagaggaaaataggagagaaaatcatcggaaa

SEQ ID NO: 88379 - DNA, 592 bp, Oryza sativa
agttcgttcctcaagctcatgcccacaacattttttgttttcctaaacattgttgccattgtcttgaggccattcaaccattcttctgggtcaaagtacttgtcaccaaagaagccattaccatcagttgtgctgcagcaccatcctggagtggtcatttggttatcaagtatgaccataatattgttcctggccaaagctgacactacttcctacagttgttcaatgttaaccatgtcagatggaataaaaaaccagagtttttatcatgtattaaaactgtttactttagtttcctttcatatttagtacatataaactctctatatactcgtgactctatgagcatctgttttcacagattactgggtcaactaactggataactcattgcaaaaagagagataactatagatacttgatttggattagataaaaagtagtacacctaatgcaaccagttgccgtctatcttaatcattagaatagatccgtagaaagaaagatctgttctagctagagtattgtggcttgcaagataccctcttggaccattaatttggtaactagtaggtaatctgtacacgttcaa

SEQ ID NO: 88380 - DNA, 742 bp, Oryza sativa
tctttggacttccatcttctacttagaataagcctgttaatcatgtaacccttttctagtcatttatagttctatgttattttgtttttcacaagtcctgttgaaattcatcacaaatgccagatccctgcaaacctggactggtttgggtggtgcacttgggatgctttttataaatctgtcaacccagtgggaattgaagagggccttaaaaggtacaaatgaatcgatcttacttatgtgatattcgaaaacaattgaaaggtcttttttattacccgcatcctccatttgtcaattcctgataaagcatttcttgttgtatagtttgtgtgaaggaggtgcaccaccaaggtttctaattatagacgatggctggcaagaaaccgttaacggattcaaggaagtggatgaggcctttattgaacagactgtgttagcgtctaaccatttttcaacttgctgatcggtccatgaagtatattaaattcctgtttaacaaagaaaatttactccaggaaatggacgtttgagtatttgatttcatattaaataaacaccaatacattttgaaatctctccttatctgtttgtgaaagagaatctagatccaccaacatagactgtatactttttctttattgtgagatttcctatccaatttccttttttttttcccctgaaactgtaaatcactgtcataacctcatattatatctatacacataaaaagtgggggatc

SEQ ID NO: 88381 - DNA, 558 bp, Oryza sativa
ggactcagggcgatgcttcagctctgaagccaacacttatgactgcagtacctgctatacttgatcgtgttcgtgatggtgttagaaaaaatgtattgttctttacaatgatattatccattgtttctttctggccttcttgccatcttgaccatttgtttttttcatgatgagatgaattaggttgatgcaaagggtggtgcagcaaagaaactatttgatattgcctatagccgtcggttagctgctatcaatggaagttggtttggtgcatggggattagagaagtatttgtgggatatgcttgtctttcagaaggtgcgtgcgatcttgggaggaaggattcgatttatactttcaggtggagcacctctgtctggagatactcagagatttatcaatatatgccttgggtgagatagtactcttcattattttataagccattctcaagtctcttttgttaatatcaagttattgtttttggtccacttgtgtttactgttgattgaacttcacaatattcaaatctaacttgcatactgcattttaaaccaa

SEQ ID NO: 88382 - DNA, 560 bp, Oryza sativa
ggagggaggaggtcgtagccctcgccgccgctgattctgtgccggtgagggttgtggccgtcattaggcggtttccggtcgccggaggcgaccgcctcgccatcgtgtccaacatgaggatggcaagccttgtggtgcgcctccatgacaagctcttcgtcctgccccccgacggctcaactgtcaccattgccttctccgagcgatggttccgtgtcccctccaattggacggaggagaagttgtatgctagggtcggccatgatttcatcaacattacggccgcattggaggatctggccaggactctctaccagatgtatgaacaagaggagcaaaaaaagatggtgcttcaggagaaacaagagcaggagaagaggaagcaagaagagctgaacagggaaagggaggagctggagatgatgcctcttgcctgcatccctctaggccatggggagatgcagtgggaatcgccttgtgaagcgatgcaccgaaggttcaaactatcaatgggcactgatggggaagttcgctgcaactttgtggagcagtaatgtcct

SEQ ID NO: 88383 - DNA, 628 bp, Oryza sativa
ggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggctggccggcggtgaagatgacgatgcccatcaacggtggtgtgaccaaccgaccgtataggcggggacaccagtcggcggcgacggaggcaggccggcggtgaagatgacgatgcccatcaacggtggtgtgaccaaccgaccgtataggcggggacaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggcggtgaaaacgatatcgccatcagcaacggcagcggcgcacaccaaccgtggaggcgatgaaaccaatcggcagcgacgaaggcggccggcggtacatgtataaaataatagatcaaataata

SEQ ID NO: 88384 - DNA, 983 bp, Oryza sativa
agggggtgccggttttgtcccagggccattgcggcccgctcgaaaagcctaacggtgcgacccccccggcctggcggcgcttctggccttttccaatggcgtgacccgaaggcccccgggatgttcgggtgggccccggcaccccgccttctgctcgtggacgggggtttcctgtgttctcgggagggtggtggcgctggatctctccaaccggagcctctcccggacctcgcttcgcggcggcgagacggtggccgggtcggcccggcttccgagcctgaggcgcctcgacctcagcgcgaacggcctccccggcgcgttcccggcggcgggcttcccggcgatcgaggtggtgaacgtctcctccaacgggttccccggcccgcaccccggcgttccccggcgcgccgaacctggcggtttttgatatcaccggcaacgccttctccgaaggcatcaacgtcaccgcgctctgagcttcgccggtcaaggtcctgcggttctcggcgaatgccttctctggtaatgtcccggccggctttggtcagtgcaagctgctcaacgacctcttccttgatggcaatggccttactgggagcctccccaaagatctgtacatcatgccagcgctaagaaaactaagtttacagtagaataagctctccggcagcttagatgacgcacctcggtaacctcactgagattacgcagattgacttgtcatataacatgttcaatggcaatatccctgatgtgtttggcaaattgagcagcttgcagtccttaaacttggcttccaaccaattgaatggcacattgcctctatccctgtcgacctgcccgatgcttagagtggtcagcgtgaggaacaactcgctgtccggtgagattaccattgactgaagattgctcacaaggctgagcatcttcaaggctagagctgtctcctgggtgggagtgataccccctcgccattccacgca

SEQ ID NO: 88385 - DNA, 859 bp, Oryza sativa
aacacgtttatttcgtgatgttggtcttgggttttgttttggaggagtagaacataagggcccctttgaatcgtaggaatgaaaaaacataggaataggaaaaacacaggattctgacaggaatacaattgtaaaacagaggagtgcaaaacacaggaaaaacacaggaatggctgtttgattggaccacaggaaaaacgcaggaatcagatgagagagatagactcagaggaaatgttccaagaggttagacctcttgctaactttcctccaaaatgtgcataggattacccattccataggaattttaaaggattggataggattcaatcctttgtctcaaaggccttcataggattttttttccataggattgaaatcctccaaaattcctatatttttcctacaaatcaaaggggccctaagcttgtagattttgcatgtgctaattcttgcttaattcttgctaattcttgaaatcctccaaaaggaggtagtttgatcacaaaacgtgccgtgccatcctggcaaaaataaaaagactcgaatattataaaaggaactaatatcaaataattaaaagaggtaaggctttgaacccagatcatctagcccatcatcctgtggagttagctggaagactcctagacatttttcaccatcctcacaaaaataaatcatgcaggactaataattaatcaatctgccagttgttctcgaaaaaaaaatcaatctggcagctggtcatattttttctatgccttctataagaaaattaaaaaaaagtgtttattttcttaaaaaaaaaattttggcctacaaaaaaaaatgcttgcatggaacacccttgaaaatttcg

SEQ ID NO: 88386 - DNA, 1357 bp, Oryza sativa
  unsure (1)..(1357): unsure at all n locations
cgggggcgttgacnatcgaaatgcacctactcagaggtacagnagttcatcacggcgcagacgcgacgcgacacgggcggcaaccacgcgagcgcgcgcgcgaacgagcgcggggagcggcagcgagggagcggagagggaagactcggctcgacgcgggcggctcacgcgcacgcgcgcgggcagagcggagaggcgcagggcgcggctctcgcgctttcgcgcgccaagcgcgagagaggggcactcggcgcggcgacgcgcgctcgcgcgcgcggcgcggggcggagcggagggagagagggagagagggagcgggagcgcgccgggggagagagaggaaagggccagggaagaggggaagatgggccgagagaaaatcggcccatcgaccccgggggaggcaaaatggacttttgcagaggaatttgatttggaaggatttggattcggagttgaactcgacgatagatcggggatcgagatcttgagatggcacgggcactagacaacaagcaaagaaacagatttcgcaattagggtttttaggagataattttcccgctaggcgccacgacggaacgggcgctacaactggggaggccggtgcgtgcgtggacgtgtgacgaggagctccgggcacctcttcttccccttccctggccgctcccagagagcttgctcccgcgccgccgccgctcgtcacggcgccctgtcccgatgcggtagccctccgttcctcttcctcgctcgccctccccctcctttaactcgcttggtagctcggttagccttccggtggttcgtaggcgccgccccaagcccggccgccgctcgccatggccttgccgccgtcggcgcctgctcccggaggccgcctctcgtcgccggacctccacggcgcctccccaccccatccgactccagaaatgaaacccttgagccacggagatgctctcgccaccttgaatcgacctctcgtcgccctgccgtgatttccccttttgctcgccgccgacaatcgccgtcgaaatccgccgccgtcggctcccctctcgtcaatccctctcgccaccacgctcccggggatccccttgacctcccccttgctgccccatggccgccggcctcccttctcgctctcgcgccgtgtcgccccttccgccgccgcatagcgccgcggcgcgtgcgtcgccggtgaccttcgggtcccgcgtcaccgcgtgcgcgtcgcaacccctttccgcaatagctgagcccgagcccgtgcttccttcgctcttttcgcgcgcggccacgtcggcgtgccggcgagattggccgccgcctgatganggacgtgcaagtcatagtcaaa

SEQ ID NO: 88387 - DNA, 548 bp, Oryza sativa
  unsure (1)..(548): unsure at all n locations
ccgccccccttganttttcgatatccgtttaccgcaagtagntcatcaatggaggctcatggcgtcgtcgggaaacgaatccaacgagtcgtacttgggctcctcccatgtcgacaagctcggcacgatcgagcaccacgacgacaggctgccggcgccggcgacgtccgtgggcaaacctagcgagtcgaaacagctctgatccatggcgaagttgagctcgccgagcgcggcttgcacgctcgcgtccgtgcacagcatggaggtggttgcggtggttgcagtactcgtcgggtcgttcccgctcgctggactggaccactcgccgaacccgtcctggttcgggtcgaactgcgccgacgccgccgccaggatgccggggctcagatcgctggacgcgctgaacgtgtcgaacgcctcgtcgacgtgccctcccgactccggcgtgacggcgccgagcccggcgtcggtcgacgggtggttcagaaacttggcgtacagcattgcgaggtcgatggtcgagccgtccgccgctgtggtgacgttgg

SEQ ID NO: 88388 - DNA, 2649 bp, Oryza sativa
ccaatatggctcaacgacggcgttgttcttactgggtggagtggaatcacggtgagcatccattgcggagatgatgacaacagctgtgcattcccatccttcacctcagcagataactggacacaccaagttctagaatggaaggttgatgataacaacccaatatcatgttcatgtttgcttcttcagctcaataggaagctttgccggctaaatgccgcaaggatagactggcaagaacatgattttggactcagtgccatctttgcattagaagcagaggaagatcagggacttctgtatcagcagaagcagcaagaaaacgaggagttgaggcttaatgcgttatctctacctgggacactatcagggggaggggaaggagaaggcgagtacagcttgttgtttgaatctcctgaggaatctgattgggcgaaggtttcagagccatatgtacccaagtttccaactgaagaagaaattcagaagagggaagagtggcgcaaggagcagcttaagctggtcatggagccaatcatacaaccagtgcaggaaccgagaaggggtataaattatttcatgtgtgagccacgcagcaggagcactagggaagcagagctcccaatgcatgaaccatactcagtgttactatactactggaccttgtccgacaaatcagaatgtaagtacacatctatattcatctgaattgcatttccatgagcactaatatttacacatatttgctgatttgttgttatactgggtaaaaaaatggtcattagtaggaccaatacatattggtactgaaattaactagcatgatagagtgcttacatagaaaattcctaccaattcatgtaacatagataaaaatacaacatatcttaatcagcagtagtcgctggtttactaagtggacaggcaactttcttttgtcttcattgcaagtaataattgccactgtgcgaacattgatgtagataggggagaaagacatatattttagcactcaaaaaatgaaacgggcacttttccttaaccatctctccgtgtattttataacttgaggaattcagttactgcttggggcttcgctaaggagccttaactttgcagttcaaataactaaacagatgcacgtgtgtaagacttcttctccaaatcatgcattcttttctctaagacaaagttctggatactagttattgtttgctttggcccgatttgtaatccaggctaattaagtaactctttgaatccagcaaagttgaaacctaagaggaaggtgtatcctagacttgtttgtttggagtggtgccttgtgcacccagcagcatcttgcaagtttacaccctcgagatcattgtagctgattctcttcattcctgcaaactcgacatatccggattcgtcgcgattagggacttacgtgatggacggcgcaattacattttcaacagagaaataggccaccctttcaccgtcgtatcacgacatgtatgcactccatctcttccacatttcttttcaggacttcttctctaagcggaaataatgaaagctctatatgggcatattgctttactctgcagggtgttttgcggctgccaacattgagccctcggagagccattcataccaatcctgaaatcttgctcgagttcaacctgaagataaagagaacaggtaatggcattgacagttaccgtgagctgatccaaggagtagtagagcatcctagtatatatcggcacgattggtccagagtcaatgagctgtccattctaccttgtggcaaccgctctactccaatgatgcgcctgaagctcgccaggattctgaaaggcgtcgaggccactgttgagctccagccgctcaggctgcctcccggaggcattgatttgcgctgcacagctcggtcaggccgcatagctgatgacattgagcttttcgatggcaaatacggtggcgacgacgacacttccctacagtttgtggtagcaacggagttgcatggcaacatggagatccacttggaaggagtatgcaatggcgtgagcaggagatggtgcattggttttgtgccaaagttccatgctttgttctctcaggaggtagacttacaattcgctcagcttttgctgactgttgcctggtccatgtagataatgcatttttttcttcttttatttattttggtaatagtgtcatatctagattgcttaggcatagtcgcatagaactttttttttcttttttttggaataccaggtatagaagaaattgtttctgcgtcgccgttggtgtctgagactgagaaaatgtattatttaaaaagatcgtttgattgtctcagatggacgagaatgcgaaccgcgcgtgggctgttgttcttttacgtgcgtgttggtgttatgcgtcccttttgcctggcaaaagaaatgtcagaattgaatctagagcagcagcaggagtataaaatgttgtaatgaaaagacaagaaaatgtcgtctttgttgcattgaccactgctgtgtgtgcaggcattcaggtggatgatcgtagctagtagactgtatatgcctgatgagttctttgctaaactgaacggacattcagcattccataatttggtcattgaagcaa

SEQ ID NO: 88389 - DNA, 751 bp, Oryza sativa
ccgttcaatcaagctgtttctgcttatggtaagtaaaaacctttctcaaggatcttcctttgtctgaagctcccttttgtcttcgtaactattaggagtagataactaaatagtcattcagaattaactaatgtatgcggacaaccctcataactaaatttgatgatctaatttccttacgactaaagtgagaaggacaaatttaccattttctgctttttattttccttatggtggtcacgatgtaatgcataagtggataagcagtaagaaacctgaatagtaatgcagtatgcaagaggatgttactagcattcacagcttttttgtgacgtgcagaatcacgcagtcctgaccggaaaacaactatacctcaggtgacaggaactgtatgggaagcatgtcttgctctcaacaaggtaccaacaaccaactgtgttgccataggacgagccatgactcagataggtgtgtatctgaaggatattctccgagagatgaaagaactaccaattggtgattctaatggcactgctgaaaaatcttctaatggagctgtggacaccacaagttgttctgatagagatggatcgtcaagtgaccttgagttagatgaggacttcactgaagaggaggttgctgttgccaaattggttgtcactgtggcttccgatgcgcttgttgtggtgaaagaaacaattcgtttcattacttgtttgcttaagatctcaggtaaccgaagtggagctaa

SEQ ID NO: 88390 - DNA, 588 bp, Oryza sativa
tacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaaggccccccccagctccaccacctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaagtccaaccagtccctcagcttagagagcaaccaaaccaggagatc

SEQ ID NO: 88391 - DNA, 552 bp, Oryza sativa
agcatactgaagtccctttttcagtgtattttggctccacaaaataacttgtcgtttcacttgtcaatattgctaaacagttttgtttactcgcttttgctactgctaaatcttcagggtaaccaaaattgcccgccaattcaatggagtgacagttaccactgaagatggaccaagttactctgccgatgcttgcatcattacagtaccgctcggtgtgctcaaggcaaacataatcaagttcgagcttgagttgccctcatggaagagctctgcaatcgcagaccttggtgtcggtatcgagaacaagatcgccatgcacttcgatacagtcttctggcctaatgttgaggtgctgggaatggttggcccaacgcctaaagcatgtgggtacttcctgaacctccacaaggccaccggcaatccggtcctcgtctacatggccgccggtagatttgctcaagaagtggaaaaactgtcagacaaggaggccgttgatctggtcatgtctcacatgaagaaaatgctacctgacgccacgaacctgtgagt

SEQ ID NO: 88392 - DNA, 572 bp, Oryza sativa
atgggtctgagaacacgacttgctttgtgagcctacacatctccacattatcgcagtactgagcaactgcagttcacagaacacaaacattccatcaatttggttatcatttttctcccttttcatagtcacagaacacaacattctatcaatttggttctcatttttctcccttttcacaggcaaaccaaacctgtataataaatcaaccaacctcctttcttgtgatcagtggtggagttgtagagaagggaggtgaagaagagcgtcttggccatgtaatccgccatgtgctcggcgagcagcgggtactcgacgccagcgatgaggcccttgcggaggatgatgtgcggcggctcgatgtagcgcatcccgatcagcgacatggcccggtcgaagtggtagacctcggggacatggtccgggcagaggccgcggtgcttctgcagcgcggaggcctcgaagtaggcgcgctccctcgtcatcggccacgaatcccccacgcagcggatgtacggcagcgcctggattgcagcgtcgtcagcggaggaacggagagagaagatgcgtac

SEQ ID NO: 88393 - DNA, 520 bp, Oryza sativa
tcatcattgatttgcatcgaagtcgggggctactgtcagggttatggataccacatacctaatagtagttgactaaatctcggcaggatccaccacataccatgtcttatacggaaactgacctcgagggagttctgaataaggaaagacaaccatagttctacatggaaacgacaaggactactcggattatatccatattagtttccctaattctacttggacaagttgacacctatgggtataaatacaagcccccctaggaggagaggggagacgaacaattgacgatcaacacgatcaacacggacaacacagacgaccacctcaatcaacacacctaccacaatatacggaacaacacaagtcacaacatacaagccaacatactccaagacaagtcgccagatatcaacttcagggataggcatggctattcccctacggtatctccggatactgtcaggagagacgaaagcgctatctctaatctcgccggacacggattcgaggaggaggg

SEQ ID NO: 88394 - DNA, 820 bp, Oryza sativa
gatgacgtcctcaccccacccacccccacccacagccacgagcaacgagctcgacgctaggatgggcggccaactcggcgcagggggaggcggcgcccgccgacggctcccacggcggcggcctcaccggagctccgccacgaatcgaactcgcagggttgagatgaagaagcggaagaggcgcggcggtggcgcctccgccgccttcgaccggagcgtcttccccatcctgctcgccgccatcgccgccggacagcgctaacccgcgaccccgagcagcctccgccaccgttcatcgccatcccgccgccccaagctgcgtccgccaccggcgccgtccaacaccctcctcggcgccgcccgctgccggcacatcacgcgacgccctcgtcggcgctacccgtccctgcgcgccgctgcccacgcccgtcgccatcccgcccccccaagctgtgaccgcccccggcgccgtctaatgccctcctcggcgccacccaccgccgccgcatcacgcgacgcccttgtcggcgccgcctgtccccgcgcgccatcgcccacgcccgtccccacgcgccgccgtcttccgcgtgtgcccgcacgtcgccacccatcgcccacgcccgtccccacgcgccgccgtcttccgcgtgtgcccgcacgtcgccacccatcgcccacgcccgtccccacgcgccgccgtcttccgcgtgtgcccgcacgtcgccacccatcgcccacgcccgtccccacgcgcctccgtcttccgcgtgtgcctgcatgccgcccgccatcgcccacgcccatccccatgcgccaccgt

SEQ ID NO: 88395 - DNA, 502 bp, Oryza sativa
cgtattgcatgacttgccttgctctcgcactgacgagacctcagcaacatcttcgagaaaccgcggatcgacgaaacggccgaaatctacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataaactgtgtttttactaataaagaaaagtccttaatcaatttattgcgcaataaagcccagggctgacgtcagcagaagggggggcgggcgccgacaggcgggccccgcttgtcagcggttcaagagagaggaagggggcgccggcacgtgggccccattggcagcggcacaagggagggaggtggcggcggcatgctcggcacggatcaagccggccggtcagccatggggcggtggcggcggcacgcgcggtcac

SEQ ID NO: 88396 - DNA, 1081 bp, Oryza sativa
agaatttttcaagatcagcttcccaagatgtatcgcgagatctgagcacggtggtaactttagctagcatatttaccttcttacggccatcaaatggcttatgtacataccatttgtgagcatgaacttcgagatatgaaaggagcactttaccccttgaatgggccttgtggtgatctttgtgcacgagtgagtcgatgtgccgagcactttgtattatggtatcaatagatacagatgttcttagccccaagcagagcaacatatcaagaacttcggggttttgaaataagccatggggaaaacaatctgattcctggagaagagcatagagctcttccacccgaggatcataaagagattgaggacttttcaagaccccattggtcgtaggaacaaatctaaggaccttcaaggcttccttaaaccttggattttccaaggacagctgaggcagatcttgcaagatggttagtagaactgaatcacgaaactctgtttgcaactcatctaacctattcagaacgtacctctggtagaagtttgattttggcatgcgctcaataccataatatctcattattatatcttcatcacttggggatatgcagaagacaaagtcatcattcagtaattgctctgcaacaccaagaggtggcagatactttcttgaagtggataaatccgagaaaccataagaactgggagaccctccatcaaataccctaaaaatgggtaactttttgcatagatttatgctcatatcagaaaggtggggtcctaagtaccattttgcatcaagaacaaactgatatagttcatttttttcagcaggagtgatgcgctgaaacaaagcttgcaaatcaacaccctccaatgaggcaaccccaaagattgaatggagtactccagatgcatcaccatcatacacataattagacaaatgctggcacgtactcaaatactttgtgtctagtatcttgcaacctaatttggtcaggagttccttcatcaaattagacagtgagcctgtattaattaattttgagactgtagatgctctataaaggtgccctgaggt

SEQ ID NO: 88397 - DNA, 524 bp, Oryza sativa
tcggtagccatggcaaacgtaggcagcttgtgttgaagatactgatgcctattagtagcgacagcgatgtagccagccgtgaagaagatagcatcagttggcgttataacaggccagccgtgcaagcggtgacaccagtcagcggcggatgcggcggccggtcggtgaagacgtagacgcccaacaacggcagcataataggccagccgtgcaggcggaaacaccagtcagcggcggtcgaggtggccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggcgaaggcaagccggtcggtgaagacgtagacacccaacaacggcggcataataagtcagccgtgcaggcggaagcaccagtcggcggcggacgaggcggccggtcggtga

SEQ ID NO: 88398 - DNA, 1164 bp, Oryza sativa
ttttgaaagatgatccatcagcccgtaccagctgggttgtcttctaatttttcatcagcaaatggcccaaaagaccatatcagaattggaccaactcagcagcagcagcaaatggcttcctcctcatgcagaaacaattctattcccatagtgtgattgataacgattttcaagcgcaattgcgcaatggaaggcctagaatggatgcaaaggcgagatctcagttgcttccacgctattggcctagaataacagatcaagagctacagcacctatctggagagtatccaaaaaattctatgtatcttcatcagcaatttcctctagataatatagatttactagtaaatactgtcatttttttcacgtgtttttttttgtttaaactcttgcctgttcttaagtgtttccttaaccctccaacagctcaaattctgttattacccctttgtttgagaaaatgttaagtgctagtgatgctggacggattggtcgtttggtgttgccaaagaaatgtgctgaggtgagttattcagttatcgttttaaactgtcttttcttttattagattgtattactgaactgtttattatgctaggcttgccatgcatgggatctgccctcattagtgtttactaataacccatgtatgatgtatggttatataatctgtccttttacttttactaggttttgcaacttatcccgagtcatgcacagatatttgacataatctcgtgatttggttatatatatgtgaataagcttgtgatttaaaactaatctgatgtatgggaacttctatagaaatgtgggttatttagaattaccagcaactattgccttcattttagttgttttaaccaaaagtgggttgaaatcagttgatgctacattataattggatgtgcagtcattttacatactttgctgatcacctccaattttgtttattttattgcataaatactcttctaacaaaaaaaaaagtttcgaataggcgtacttccctgccatctctcaggcagaagggcttcccttaaaagttcaggatgctactggtaagaatgggtgttccagttccgcttttggcccaataataacagcaggatgtatgtattggagggtgtcacaccttgcattcaatcgatgcagttacaagca

SEQ ID NO: 88399 - DNA, 673 bp, Oryza sativa
tttaccaaagttgctacgaatagaataatgagtgttgctcaaaaggtgattagccctactcaaactgcttttatacctgggagaaatattatggaagggttgttattttgcatgaaactatgcatgaattacatcgcaaaaataaaagtgtgatttttaagatcgattttgaaaaagcctatgacaaggttaaatggtcttttgtacaacagacgctcagaatgaaaggtttctctcctaaatgatgtgagtggataacttcttttattcaagggggacatgttggtattagagtaaatgatcagaccggtaataattttcaaacttacaaaggtctaaggcaaggagatcctttatctccaattctttttaatatagtagcagatatgcttactgtcacgccctgaagttttcccccttttgcttgctttaaaaattggttaaataaattgcccgaagaaattatcttaattaacctagagctgaattccttaattaataaatgcaaataataatcggaatcggcatgtggaatttttcttggattctacatgtcaaaatatgctaacaggatttttagtggaattttcagagccttggaaataattttaaccaattaaaaatgagcatgtgcaatatataaatcccaggaaaatcctttttcttttttttt

SEQ ID NO: 88400 - DNA, 1074 bp, Oryza sativa
ttggtgtccagtccatgttgcaccattgctaaaaggacttccatggttcatatctgaagatcatgtggctcctccaatcacaacaaggccaaaatcacaaatgtggcttgtttcatcaaaaatgcggattcttagtgctgattcttgctccatgtatctgcaaagaaaacttggttggttagacccaccaaatgcaaacattttatcttcccagttagttgagatctccaagtcttatgatgaactcaagatgttttctgaagacagtaccaatgatgccgttccgcaaaaggaaattcaactgatctactcaaaattgcaagatattattgacacagccgataccaacattctaaaacggaatctggatggacacccatgggtttatataggtgataggttcgtgccacctcaggcacttgcttttgattcacctgtaaaatatcacccttacctttatgcagttccatctgaactgtcggaatataagaggttactgtcggttttgggtgtgaagcagacatttgatgcagcagattatctgaatgtacttcagtgtttacaaagcgatgccaaaggagagccattgtctacagagcaactaagttttgttcatcgtgttttggaagcatttgttgattgttatcctgataaccaagcacctgatatgatggtgaattcattgttgattcccgattcatttggtgttttgacacctgccagaaatcttgtctacaatgatgcaccctggatgaatgctgatcctacttcaaagagctttgtgcatcttagtattggtaatgatctagctaataggcttggggttcgatctcttcgtggatcatcattactggatgacgagctaatgacggatttgccatgcatggaatatgctaaaataagtgagttgctggctttatatggtgagagtgactttcttttgtttgaccttatagagctagctgatcattgcaatgcgaagaaagtgcaccttatctatgataaacgagatcatccaaagcagtccttgctgcagcagagtttaggtatgatagaaattttgggctgcaggaa

SEQ ID NO: 88401 - DNA, 3306 bp, Oryza sativa
ccttcgagaagattcctcatcccccttcccttctcttccctctcatggcgtccgcaccgagcaccaccgcgtccggcctcgcgccgccgccgttctcctcggcgcgcggcgcgcgcctcctccccggcgcgctgctgcgcctcccgccgcctccggctcggtgggtagcttccgcgtggtggggcccgccgccgccccacccggcggccgccgcatcgccagcgcgcgcgtgcggtgtggcgcggcggtgaggttcatcgggcagagcgagttcgaggcggaggtgttgcagtcggacctgcccgtgctcgtcgacttcgtcgccgactggtgcgggccgtgccgcctcatcgcgcccgtcgtcgactgggccgccgaggtctgctacttccttcatcattctggtgttacatcttgtctgaatagcttagaattgagaattaataaaccaccatggactcaaaacgattgaatttttggtgtgctaaataattactagagatatcaattccatggagacatcagacatggactatagactaagactagacagcagtgacgatgccaatgttaccagctaccaaccgctgtctgtgggttttaggtgttcatctgagaacaacaaaaagctttcagatcagtctattaagtcttactattagagagtaaaaagatcagtctataacaagtatacttctgttgtgatgtacactcttcaagttaagtgcaaacgcatacctcctttatactacctacatcccaaaatataacatcttttggctacgaatctggacatgtgcatgtctaaattcatagtcataagtggttgctatgttttggaatggaggtagcagttcaaaaaatggcatataggctacaccatttcagggcaggtttggtgaattggtgggatgatttcagcaaattctaaaattggcagttgccaggacttgctatcatggccaattaatgggaggacttagtttgcaaattctaactttgatatcttgatgatggaaaagggtctaatgaatcaaccaatgtgcagatacattcatatataaagaattaagttctactcaagcgaaataacagtccaaaacaagcagtgcaaccttggtcagtcatgcaaaactgcacatggttggtcgtatgggagtttgttctctatgtttcaacagaaataggttctcaagttatgttagttggactttgcatctctaattgtttaattttggttgaaaataggaatatgaagggagattaaagattgtcaagattgatcatgatgccaatcctcaactgattgaagagtataaggtttatggtctcccatctcttattctattcaaggatgggaaagaggtaccagggagcagaagagaaggcgcaattacaaaagccaagttcaaggaatacctcgaacctctcttgtcaacctcaacagttgcttaatatcatcatctgcagtatgcatcactgaatctgatgtctggagggtgccaatgcacaacacgacctgcatgttgaagttttttcccccctccatgaactccccattctaatttgtaattacctcaagatcatggttgcatatatttttcattattgatggtaaaaattagtatgtacgaagggctatctgaggtgcagtttgacctggcacaattcctgaaattgaacttctgccaattagtttcttgtacaattcattgttaatacccacaggaccatgcttatatgaaagcatttttcaaatgtgattgagatggagtcagctaaaataagatgctttttagagaggcaaaataaggtgtttttggaataactattggttgaaaaaaaaattgaggctcagcgtgtgtaccttaagaaaacaatagaaggggtaattgctaagcaagttcaaatgataatatttgccctactgaaaaccaatttcgtttacgaaggattaaatttttacattgtatttgttggtcaggtgcaactttttacccacgaggttatgcagaaatccatcgagccaaaaattccatcatttggacaatcaatcaacttatctctgtagaccgtaggtgatgcctaccaggtgcttgtacaaagcttgccttctctcagcttttctgacatggaaataggaaattgaaagtgtgcctggcaacagttctcaggcatggactcgaacaaaatagagatgggcagcttcatggcttctctgtccccttgagtcctttcacctctgctgccattatgtatgcttaacagcaacaactacaagctcaagtgcatgctttacatctcgtctgcctgcagtctcgttgctgtgaagttgacaagcatcatcagatcacatccaaaatttcaggcaacaactccagggcgaaatggcatccgagaaatcagctcttcagcctcttcgatgcgacctgcctttgtgagcagatcgaccatgcaagcaaagtgatcctcgcctggctcaacaccaaacttgtctgccatggcgtcgaagtatatccagccttcgtccacaaacccaccttggctgcaagcatacaggacagagtaaaacgcggcgtggttcggtgccatgccttccaacagcatgtcgtcgaacaccttcacagcctccctcgcttgcccgttctgcgcaaacgccatgatcatcgccgtccaggacacaaccgactgtcgctgcatcgactggaacaccttgtgtgcaccggttactgatctgcacttcgcatacatgtcgatcagagcattgttgacacccacattggagtctcctcccagcttgatcacatatccatggatcttccttccttggttcagattggcaaggttcgcgcaagcattggcagcagctacaatggtgtagttgttaggcctgattccatccaggatcatgtcactgacaactctgagggactcagcaggctctccacaatgtaggagacctgcagccagctctgtccaggacacgacatctctatggcgcatctcggtgaatgctctgatgccggattccagctgtttgttcttcatgtacatctccagcaaggagttgcccacgcagacatcgtcgacgaagccgctcttgacaagctgcgcgtgaacttgtaagccggtcccgccacgttcgcgcttccggacaacccagacagcacggtgctgaaggagaagccgtctgcgctgacaccttcgatggccatccttcgccagagcgtgcacaggcgcagggatgaacggtgcgcgaacgcggtgagcagcgtgttccacgacacgatgtcccaggcatggggg

SEQ ID NO: 88402 - DNA, 1043 bp, Oryza sativa
cttttggtaccccttttgctgtaaaacctgactttgtggcccctggggcttaggtcccttccttttgtttttgctgtatgcttgatgtaaaatgggtctcccccccataatgggtctcccccataacgttgctgtattcggctttcaatgtaagccgggcctaaggccttttgatgattaaaaaaaaaaaaacccagctccatcgtgtgctcttcagccttatcagccgcaggcatcgtttatattttaaaagcttaaatcttaaatttagaaatgatttcaatgtcggtttcattgcagtttattctttgtcgttggcttttaagtagctaaaaatacatatataaacagttttattccccagattttttttctctgaacgactttataacctgctgtaagcaaaacgattggactgttctatctatcaaatccaaacagctactaaattaaatatatccgatcatcttaaaaataaattctcttcatccccaagctggtttatactctattttcttagcaagccaattaacactgctattatttctgttattatattatcccgatcggtaagatctgaacttttgtcgataataatatcaagcgtgcacttaatcgaacaaaataagtccagaccaatgtggcgaactgggccaagaagaggcacgaaaccgcaattctgggccgtgcaacccatcttccacgcgcggcccgattctctgattctctcctcgcttaagccctcctcctcctgcttctgcttgctccccacgccgacccagtctcgccgccgccctcgccgccgccaccgccctccccaccctcgcgcgctccgccgccgccgccgcccctccccgccgtcccctgccgggcctccccgcgctgcccccatgtcgtcttccgcagcggcgctcgcctggcgccgctccctccgcgacgccctcctgcgcggctccgcgtggcgcggcgcgcccgccgccaactccgccgccgcgcggttggccagcacggcctccgcatccgaagcggcggctggtccgaag

SEQ ID NO: 88403 - DNA, 563 bp, Oryza sativa
caatccggctaacatgtaatcacatcatagagaacagaagcttttatttatatctgaatagtgaagctagcaggcaggcaacataccaagcttcaacaacgctagaagggcaggattaactagctcgagtagccggtgtgaaaaacacacaaagaaacgaagcaattaaaccactagtactcatgtttcctcgcttcgatcgatcgatcatggcgccgcggcgaagccggcgaccatctatggctttgccccacctccacaggcgggagcttggggaacttgaggaatggattcttcttgatcaatggcagcagcttcttgaacagctcggggtcagcctccgcgtcgtcctgcatcgccaccttcttctcctccgccggcgggtggtagatcggcggcgacggcgtcggcagcggctgcttgtacaccggcgtcgggtgagagtacgccggcgtcgggtaggagtacaccggcggcgccgggtgcgtgtacgacggcggcggcttgtggtacgccgcccgcgctggcggcgacgggttcttgtagtgaaagaagaagtcctt

SEQ ID NO: 88404 - DNA, 562 bp, Oryza sativa
aatccatacacaccttacgatcatttgcttgatcagcgtgtccatcttgtgaaaaatatgccaaaatcaagttccccaggaaggccccaatgtcgtaacccattgggccatagaaagcaaattctggatcaatcacttgagtagaatctggtgtcaccatgatggaactagtgtggagatctccatgaagaaaagcctgtgctctctcaataaacctgcatatgcaaatcatgtccatcatctccaaatgaaaaggaaagaaaaacgctggtttaatcaggagagctagttacattgattttaattcagcaatctccaacttaagctcagcatcctctcgaaccgctgcagcatcattatcaaggaagggtgatgtgcagcgattgtatttggcgaccctgtatggatctgagaatacaacttgttctgtgagcctgctcatctccacattatcgcaatactgagcaactgcaattcacataacacaacatgccatcaattcggttctcatttttctcccttctcaattttcacaggcaaaccaaacctgtaataaatcaac

SEQ ID NO: 88405 - DNA, 736 bp, Oryza sativa
tttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattgtagattacgtattaccaattaataggcttccattttcatgtgtgctgttgtggactgtgcgcgctactggatatggcactaccgtgaagcgccgaaagtgtgttgttgtgagcataagttgttcgagcacaatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccgcgtgagacgaagaggccccagtaccgaagatcccggctgcaaatcctgctggacaaggac

SEQ ID NO: 88406 - DNA, 986 bp, Oryza sativa
ataaatacattagcttaatgactcactacggtcttatttgcaacaggagcagttctaggggcttctctgatgtactcttccattgttccaagaaatgatgacggcggctgaagaaagtacagagaagtccatttggcattagaattctcagtgaaaacaaaacaatgataggctaagataaaggtaattgcctctcttaggactggaaattggaaattcctggcgagttccaaacccctgcagagatcgtagaagtcggacaggctttttgcctgatattctaaagctcattagctctccatatacatttctagagaatcaaaatgcatgcaactctacagaataatgaaagcacactgtgattacgcgtaccagatgtcctgttcttctgtagatgtcgaaagctttgatagcatcaatttttgtcatgtcgaagaactacaacagttcagaaatttaatttgatcaggatcatatccattagatccatcgatgattcaaatgcagagaaagctggtaaataataaaaggtaccatttcgacaagattaatgattccatcattgactgcacaataaatcttgaaactttccttcagcacctgagtaacattttcattcatcatgagcaagagcaattcggataaattgttctaactagtagtatctgaagttcagatatcagaattaaggtcagccacaataccagagctaatgcatactgtataagatagtttccaaatgcggctccttcaggcttcacacacagttacagcattggtaaaaatgagtcagaaactaatctagatcaagcagataacataccacaaagttaggtgtgtacattacctggcagccgactagccgatagagcagctgctgcagtgcaggaagttgctccaagagctcatccttacctaagcttctagttctactctgaccctgaacatcatatttcaattggtacatatttgtcaccaaaaaaaac

SEQ ID NO: 88407 - DNA, 1662 bp, Oryza sativa
accctgctgccgcccagcttgaagagaacaatgcactggctctggccattgtatcaccaggtgattagcatgcatctgcctatactatctcccgattagataattcaagaatcactagtaattctcccaaatccatgcataatcacatccttttggattataacaggtagcaacacatctgctggtgcaggcagtggcttcggtggcatgcttggatcgtcaggttgggagctagcgttggtcactgaacccaccaacagcagcagcaaccaactactgacagagagcaagctggtaagtcaacaactctctattgcttatttcaagaactctctattgctcaatgccattcttttgatcatactgtgactgagagtcatttccaatttttgcactcaatgactcttgtaggctggagggttcgacaagctgctgcttgatagcttatacgatgatgcatcaaggaggcagcaaggagcccagatggatcatcctcgggatccgttcgccatgtcgacaagtgtcgcgccaccgaccaacgtgcagatgtcgatgatggcacagcagcagcaatatttccagcaggagcagcagcagcaaatggtgttagggatgccacagcaattctcagggtggcctcagtatgctggtgtttctcaggcgaatcctttcggtgatacgtattcaggtggtactctccatggaagcagcagcttgatctgaacatttttttttctgattaaaagtagagtagctttgatgtgataatctgagaactgccattaattcagcttgctcttgttagcaaaacgttgtatcttcttcagtcttcacagatctcacttgtgcacagtgcactggcaatttacaagactggaaaacagaaattcatttgttcatttctcaggacatgcttgtatattaccagttaacgatgacattagataaacgagtacagttcaaaggtaaatttgtattttgggtattacacgccgtggaggatgtccaaacatatatggacaagcattgcgcagctttgatagcatagtgccatcatgtagtagctggcgtatacccatcaggatatccccagctgtatcctgtattcagtgcaaacatcacatgaagtacatcgtttctgctagacactgtaacaaaggatccaaacaaaaaacgatcaatccaaagaaaaaaaaaaggaggggaacatcagacaagcgagtagtcgtacatatgtacatggacgtggcaacaaactctcgggtcattttcattctggtataacgagtcaaaaacattttcggccatgccattacacccaacgattctattcctagttcttataaagttctcctgtcatattggccccattatacctgaactcctgttaacccagccctcaccgtatctagtatgcatcgtcttcatcgtgctatttgttcgtcgctttgtgtgacaattagatattgatccaagcctcttcatagtactccaggccttaatcttcatggtattctgggttcttccttaggatcacaaaaccctcaagaactggtgtcagtggaagatatctgcacatagaaagagcataagcataagcataagcaaagatcaactgacaaattagaatattgtactccagatgttatagtttacttttca

SEQ ID NO: 88408 - DNA, 1889 bp, Oryza sativa
gggacagaaggacccgtcagagtaatatggtaaagggtcagcaacccttcccaaggtgaacaagactttgagcatccctcacctgaagtcaaatgaaatgaactgatatgaaacttgaatgcaacagcatgagatcacaataactggcaaaacaaagataaaaatgtttattttagatttgaacttacacaaaacagatgtcctgcttctttgtaataataacttgagaggttccgaagcatcccagctatacgggcattgtttgtaccagcccctatcaagcccagggagatgattgcagcctgcatgtaccagtttgatcaaattaaaatcaatgctcatagaaattaatatggtaggttttgctggtgaggttactaaccatagaaacttccgcatctgcatcatggctcagtctactcattgtgtccataacatttacctaattgacaggcaagtggtagaaatgtagacatcagaaaactagataagatatttatctagccaaatgatacaatctactaattttcctcgaataaccaggatcaaataatagtcatctgacaaagcacattctcaagagtattgaattgaaatagatgatgcagcagagtacaaaactaactgtcacggcatgctattaaatagttctttctcaacaattcaattgaatgattgtgtgcaacggcatgaagatagcacacatttaatgctactagtatacaaaaagaactgttacctttggattggatatgcaaagcaaacccagagctagaggaaccgcccttctaatattctgctcgccatactgtaaaagacgctcaagggaacgtacagccatttccgcccctaattcttcagccatggcaattagggagattccaagaactgctggcccttggtgggtttcacctttctcaagatgctcggagcaaattccaaggagtttctgaacctgcaaatcaaacgggaagattcatcaaaaacaaataggcgctaaaaaaatgtaatcctacaacctatgcacaattcttctgttaattgggaatcaccttaagcacgttccctgtcccagcatatgccagtgacatcaatgtcacgtcacaataattccttatcttctcatcaaaggttttagaaacctctgcagtcgcctccacactttcctgagaacagtagtcaagaatgagtataatagtatattaacataaaactggctaaaaacagacggtgtaggttcatgaagaggttgcatgttacatatgcaagacaattgacagtgcttaatccagagaaaaaagcaattaccaaaagaataaaattgtacttgggatgaatgaactaaaaatacatttgagccagttcaactacttgcatggtgcacgcgaaccaaggccaaaatagtccacgttagcgaatctgagcgttatgctgctgaatgcatgcataaatcttgtgatccagaaaagatagggatagttctcctatgccttttggaaattatcttgctaggggaatttgcagaagattgatagaagtgcctgatgttcctgataatgatgagcagaatgagtcaccatacataccaaattccagtttcctttatcctgattgatctccctcctcactgcgcaaatccctcatctcacaactcagtggcctggttgcactattggtgccgcactgcatgagtgggccccacgtgtcgcatgaaataattcaaagagaaggtagcctccatcaggaaagaggcaagtttcggcagggcatgttactgttcgcaatgatcacatgccttatgcgcactcacatgcttgctggtatggcatcctagtcagcactcaaatgatttgattaatcagatgtgaactattctcagggggatccac

SEQ ID NO: 88409 - DNA, 632 bp, Oryza sativa
cctctctccacatgtttttaaacttctaatgcacaagtctctgtactgatgttgtgacatcttctccaggcatttgctctcatttctgagtatttcagcagggatgagtcaattatacgaattggagcaatccttggtcttggtattgcttatgctggctcccagaaagaggaggtcaaatccttggtcttggtcttgctatcccactggttaaaaaatattaaccatgtgttattttgtattaacatggtttccaaaaatttcaggttagagagaatctcacagcttttctgactgactcccaagtacctctggaggtcttggtcttctctgccatctccttaggtttggtgttcgttggttcctgtaatgaagaggttgcacagacaatcatatgcgtcttaatggagcgtagtgaaccagagcttgcagagccaattatgcgcttgcttcctgttgcccttggccttctatatcttggaaagcaggtaatttgattgtatacttattcatactcccaaattctacatttatgtttttattgaggtcaaggaccgtatagtacatatgaacatatttactgtgcatgactgccttttctactgctctgtacattgtttcatgattaatct

SEQ ID NO: 88410 - DNA, 2910 bp, Oryza sativa
actattgcccttgctcttataggtgagtcccaccttcatagcccatatgtcagtggcaacgctgtcgttctctctggagagggagacggcgacggcagtgatggcacagccgccaagacgataggaggtgcggtcgccaaaaaagcgcaaacccagattctcacccttttataaccattcccccccaccaaaccaaccaccgccccaaaaaatacccgccgccttttctcccctccccgccctgatccaccgcacggccgcgcgcgcgccacgccggtgtggagaacgatggccgccctccgcctccccaccccgccgccgccccgcgcccccgcgccgtggctccattcttcccaccgccgtcgggttgcggcgccgcggggcgcgggcgggggcgggggcgggggcggggcggtcccgccgccgccggtgaggacgctcctgatcgacaactacgacagctacacctacaacatcttccaggagctctccgtcgtcaacggcggtgagcctccgcctcgccttccctctcgtgaaaccatggcttgtgattgtcactgcttttgctcaacgtttccatggccggtgttttttttcccagtgccgccggtggtggtgcgcaacgacgagtggacgtggagggacgtgtacaggtgggtgtacaaggagagggccttcgacaacatcgtcatctcgcctggcccgggatctccggcctgccctagcgacataggtgagcatctccacttcagttcaatcgtgtggaatcagaattagaaattgctgcttgtgcttgttcaccatttctacgtttgtatctatgcaggtataggcctgcggatactttgcgagtgtggagatatacccatcctgggtgtctgccttggccaccaggtcgattccttttttgtgttaatccttgtgaactcatgatcagtcctgtaaaatggaaaattcatggacaatttggtggtaggttgaactgaaatggccgttttgttttaccactgcaggccctgggatttgtccatggtgctaaaatcgtccatgctcctgaagctatacatggccggcttaggtaaggccttgaactctattacatgcttaatactttcagctttctgacctgtacagcatttattttttatcttgtgcaattgctatggattagtgtgtgtcatgcataatcttctaagttctaggtgttctttcagttaagtagttaacacatgtcttgattttgataccccttttttttatgtcagtgaacttgaacacaatggatgctacctctttaatcacatcccatcaggtataaactctggattcaaggttagtgtaccactcatgttgctagccatattattggggtttcagcctctatatgcaccgcaaagaacactctacttacagttgttatttttcaggtagtgcgctatcactcacttgtaatagaaccagactctctatctgaggatcttatatcaatagcatggactgcttctccaaaaatgctctcattccttgaaagcgataagcctgatataactagcagtaccttgtggggatcattggataacttattcgtaacaaaccagtcagagtgcagtaccactgatggaaaaatgcccagcataaacgatgcaagtgagttagatggctacagggttctcatgggcgttaggcactctaccaggcctcactatggagtgcaggtatactgtctatatctctgcaatgttttttatttctttttttcactattcttatatttgattaccgtcaaattcagtttcaccccgagagtgttgctactcattatggaagacagatatttcaaaacttcaagaagataacaactgactttggattacagacaccattgcttcaggaaagaaaggttcacagtattggtaaactggaaagatcccaagtactaaattttttgaagactacaagtactatatgtgaacaagtattttccacgcatctcctttagactccaccttattgactttcttattgtactgcagatcagttctccagatctcaagaactttgttgcaaatgacttgttacattctgcaaggttgaaactttgggattctgttgggccttgtgctcttccaaagcgaagcagtggggacaaatgcttacggttgcaatggaaaaagattgataacttcctcaatcgcataggtggctctgaaaacattttttcagtgctttttggccatcatagcgctgaagatacattttggctggatagctcatcagttgaccaggtgctaattcagctagctcttaatatcgtttagttctgtcctgtatagattttatctgatgttaaacgaagattgaagggttttgagtctattaacaaaaatgactagatgatcatggacatgtggaacttcactgcatgaagaaacaaaaaaagtattcccctgattcaatatacttaatttcttcattctgacattctggcagatatagtctgcagaaattaaatgagataaagttattgataatgatagttttttatgtacatgaattgagttggttcaaaccagtgcctatttgacagagagtagtagatgtgtcaaaacttatcactgttatcctgtcattttctccccctcatgaaggcaatgcatccacttttatgagttgagaggttttttcttcaaagttgtgatgtggtgctacttgcagaatagggcacgattttcattcatgggcggcaagggcgggcccctttggaagcaaatgacatttcaccttgccagtcaacggtaggaaggcactttcctgaaacagaagaaaaacattctctatgtatttatataaaccttcatgttatttctgattcctcctatttcgttctagagccaattgtggaggaaacct

SEQ ID NO: 88411 - DNA, 3111 bp, Oryza sativa
aagacggattcgacgccgactctttcctcgccgtcgatgacggcgtggccgagggcatcgatagaatcatgggcaaactcagcatggagaagaactccgcagccgcgtcccgcgccgacgccgtcctgtccagcgccgccatacatccatacattagaagcctcatggtgctcggtctcgggttccggcaaggccggctcaacgccggccaagcactgaagcggcatgacgatgagagtgattggtggatgtgccctgccataccagtgaaggaaatcgcggcgcctcctgcgccatcggtggctatgccggtgccagtgccgatgccattgcaggcttcagataagaagaagaagaagagtaagaagaagtcactgaaggaaatagaaagggataatgccattgctgttggtgaatgtaagtttggtgatgagggaactctgggctttgatcatggtgatgctggaatttcggcgctgaaggacccaaagataggattgggcctgaatctgaacactgaagaggtgctgaaggcttggtgtaacagtggttctgttttcgctggctgcgatgcacttgaatcaccaagatcctcctctgatttgcatgtaagtatttctagctcatttgacttaaatctcttttaagatgataagaagaaattttgaagtgttgtatacttgtattataccttagttcagaattatgtttcatactgcttggcatataaaaactttaggcttttgtgtggcatatgttgtacaagtgcttgaaaaaccatttatgatttggttagtattactctcttcttctgggactattattttcttttgaatcaagccagcagttctattatgttatcctcatgtgtaccataattttgtgtcaatacacttctttaggagaaggggaccatacgtagattttgttcgttcaaatttctgctatataaatgtaaaaggaaaacatattatccacaattccaatcatcctatttttatgtgaaaatataaacttatccttgataattgtaatgatgtggaaattctcaagatggtatatgaaaagcacaacatgaaacttgataatggtctcatttatagagggaattttcaaagcctataagaagaactataagaagaacagaaaacttcagcacgataagtgttatatggctcctttgtttgtctatgtctgaagtaaatccttcttcaactaatgggttattacaattagtactaaccactctgaaaatatttagaacaaggagatgccagaacagaaaatcaagttttttttattctatcatgggggagtgattatgtgaaatcaacttttggtctgactgctaattactattacctccgtttcaggttataagactttctagtattgcccatattcatatagatgtttaatgaatctaagcatgcatatacgtctagattcattaacatatatatgaatgtgcgcaatgctagaaagtcttataatatgaaacggaggaagtaccaattttgatgaacatgcactgtcacgttaaagaaaactgctgtttcaccctttacaaaaaaaaaaaaaaaaaatctgctgttactgacaaactttaacattcttcatcgcaggctaaacttgcagacattgatctatttttagataataatacaagcggtgttatccgggaaggaagcatgctgaaattgcggcacaagcagaagcagtgcactcccctcctctccaataagacccggtatcaatcgcggaaggtgaatgctgaatgtcggcctcgggtcaaggcaagttctaagaactcattcctatgcaaacaacttatgcaaaggcaaaattgataactgttccaaatcaatttccacaagttttattccccatctctctaaagtttcttatgtatttgtctatgtttttggttctttgcaggggaagtatgttagccaggcttctcttcttcaacaagcctcagagaaagagaggtagaaaatgataaaagtcctcccatggacatttttggggcctcactctccccctcctaaagagaagcaaatgtgcttctctctttttcatttctgcactttaatcatgtaaagggtagagatgcctgtagagtggcatgttgctatggggatcagataatctttgtccagttctccagctataaaaatgatgaggttatcacccccagttaatggagtagtagtattttctgttctgttctttcatcttaatcctctgaaaggcaaaagaagagaaaaaaaccaaacagggagaaatgattatgagatgaaatttgttagccatcatgtccatatgacgcctgcaaagccgtcagagaatagaagctgctaaaacacctctgatgctctaaaattgtcaaatggagtaaagtttatccactgcgcctgaatctggaaggtttcctgtctacgttcagagattcccctaatcaagatttccttatgtcttactccaatcgaaatggcttgtccaagttgcaggctttcagcttggaagggaccaaaatgctgtagggttggtgaagattgggtatttgggttggtggagattgaaatcctgtgctttggccatttctatggtctcataaatatttgatgcttattagatttgttttgagaagtacaattatagtatcatagtaataaacttagatagttagagttctacaaaatacagttctgaatgtcaaatactcaaatatttacaaccagatcgagtacaaaaaatagtttgattgaatggaaaatgaattaaaaattcatactgaaaaaaaaatgatgacctaagatccccttttgttctaattaagatatagattttaccttgattttcattagcacacatttcaatattgtatttcatacatatagaagttactaaccccatcctgaaataaattcatttgtcagccatctcacaatatcacacatgccaataaacacaaaatgaattagaatacctcagttatatcatatcccaatacaactatttttatattttatatactcccaatataattattctatatttttataaactccaatacagtaattacaataaaaataaacttgttttaaa

SEQ ID NO: 88412 - DNA, 1755 bp, Oryza sativa
catatgtttaaaaatagaagtttcacttacctccattagaagatccacagcttcaggttcagcattatgctgcaatataaataataatcaatatcatcagtccatccattgatactagttgtttattggctactacctccatcccgcaatagttgtcgctttgacttttttctttcaatgtttgcccattcgttttatttgaaaaatttgtgtaaatatgaaaaaggataagtaatacttaaagtacttttgataataaagaaagtcacaaataaaataaatgataattttaaaaaattttgaataagacgaatgatcaaattttacaaacaaaaactcaaagcgacaagtaatatgggacggaggtagtaatatttaatgcattacacagagtgtaacaagacatctgtgatgaaataagaaaaacaaatgacacccatggactagactcagaattgaccttcatgtggaatgaaacgatttgctccaccagttccttcagggaatcagttggcatgccatcatcctgcaaagtggaaaaaaaaagttaggattataaaaatgaggtccacacacctaaactttgtgttgtcttagtccatgcacgtgtgataacataattgacagaagaaatcatgtgtgtggcttctaacagaacaaaaaaaaaattatatagcaatcatgctatctcaattcttgccaaataacaatcagtacggtatagatgtgggatacaaaagtcaaaagggtctcagggaagatcacttaaaacacttgttattgaaatcaacagcagctagacaagacaatggatgctaaactaaagaatatagtgatttggataatataaataagggtaatcttatcttgtgactttatgacctattgttaatggaattagagttttgttagggattaaaacaaaatttcaaatacttctttcattggggtgaagaaatacattatgcaattcatatgatgatatggattagggtccaacctggcgcttctggaattcctgtgcaatttcaccagccaagtttctagcaagcgagacattgacattgttagaaaatccaattcaaattcaaaagacaaacatatgtattccaacagaagacctgaaaagaataactttttatcaataatttcttgagtacaattcaatatttttttaatacactgagaacagttaaatatttgaccacaccataaattctaaataagctgatatgaaggtaattgtttggtaattcatcataaactacctcaggaataaatctttacaattaagattcacaagcagcaactgtctcattaataaaattgcaagctaaacaatttaggaggcctggaaattggtgtcacctcacatattcatgaccccatgaaccaatgtcaccttcagagcctatcattcggtagttgaggctctcctgaaacgataaaagaaggcatattagccaattcttgaaggattgatactgtacagttaatggtgagaaaaagttgaactctatctgtctatcatttaaaacccacgaaaaaatgtatgactatttatagaagtaaatcattctcagaagttagcatgcaagcaaattaaaaaagcactgggaaattgacacaaggaaaagacatcagaatggtatttttcacatactctttctccttcagcggacattgtcagggccaatactgacaaaatatcagccatatacttctgcagaataattgaagaatatcatataagca

SEQ ID NO: 88413 - DNA, 743 bp, Oryza sativa
tagggattgccacctgggcccaggcaagcacatcaaccatgtccttgaaagatggcaagtggagaataccaggctcaagtccagcttcaaagatgagcttgcctattgactttcttgcctgagaattcaagtaatcattagttggctcctttgaggattccgaatcttgcatctgtgatgaagaattctccatagagaaactcaatggatcaattctctgccctgaagatatttccggtggcttattcatcatacacggattttgatatggaggcctagttacttctatagtctggcctcccttctgagatgaacttgcattgcaagaaacatcatgggcatttacttgtgtagtttccccgggctgcaccaaattatttgtgaagtgaacaaagcagcggtgccaactaacagagccttcttgatccgtaccggatgtaattggctgcaaaagaggtcggcaggcatgagcagatgtgagggatagatttcttactggaggaagctcagaagatttatgttttcctatttttcgggctatccaatctttcttgcgagcctctagtgaactctttatgctttgcctgacactgtcaggtactaagctgcaaggataaacattgcccctgatgcccgctaagtggtgctccagacggttgtatgtcctaaccaccttcccacagtaattacagctcaccttctgtgtttccttatcgacagttttgccatgcttttccttttca

SEQ ID NO: 88414 - DNA, 698 bp, Oryza sativa
aagtcgaacaacgttatgcacggagccttggcacacttccaaaacttctggtgttcattgtcatagaagtgtctcttcaagttagcatatatgtgcctagcacagatcctgtgttcagcttgtggagcccatttatccatagcattaataatttcctacaggaaagcatacatgttagtaggcacatttgcatttgtaataattcaatactggacagagtatagatggaatgataccttctgttggtttgatatgaacacccagccagatccatcaccaacttgcaagtcactgcacaacaatccacagaaccagtgccattcttccttgttcgccttgtgcaccactgcccatgcaattggatacatctgattgttggcatcctttcctatggcacaaaggagctctccattttttgctcccttgaagaagcagccatcaagtcctatcacttttctgcacccagctaggaagcctttcttacatgcatctaagcatatgtagatccttttgaaaacaggtggatccatatctacctctctatccaccacaacagtgcttccagggttacttctaagtagctccagctgataattatacaacttttgatactgccacttagctgcatttatagctttcttcatcgtaatggatttggctctcttcagcttggagatgttaacatcagcaaacatctc

SEQ ID NO: 88415 - DNA, 3370 bp, Oryza sativa
tggaagagcagagtcccatgagagaggcggtggcaatgcgtgtcgcgatggctcccgcttccgcggcgtgacatgaggagttttctcatgtaatcgtccaaacgtgttgctcgcagccgcaatatctgctcgtcaaaaccatgtggtcgggaagacttttaaggctgactacgtttgttcacttttctaacttatctacttattatctattttgtttcttacgtatatatttttcaacctaacggtgtgtattttaaaaaaatttatatgattgttgctttaaaaatttatattaatatatttttttaaaaaaatacttaattagtcatctgctaataagttagtattctgttttgcatgtgtaagatgttagtttctaattaaccttaacaaagaaaacttagcctaacacctctcgagtgtattaagggctgtctttttttctttcttttaacgtgtacgttttctgaactattaaaattttttatataagttgttttaaaaaattatatacatttatttttagggtttttaataatatttaatttatcatacgttaattttatgtcatgttttacgtgcagagggataggtttcataacccataaaaagaacacgccgaggggaaggcaaacccatcaaaaagaacacggcattacttgttgaatgaataaacctacctgtgttgcgttgatgtattatttcggtactccgcgagacgagaacacgtgcattccgtatctgcagaattcgatctccagtatttacagaatggatcagtcagagctgggcaaccagaaataatccaacaaggatcaatagcagcattaaagctaatcactacaatccaatgctgattaagaaaactagtactccgtagtagactctagggggaccatccaaaccgtttcgaacttacatctggtgccttttcctcctcaatgcccacactattacgaaaagccattgcctaagtgtgatcaatggatgtcattagggccagatccaacctaacctcttcgatcaatggacgcgtgactataatactgtttgaactaattaatgggctttgtagtatgaacattgctcgtgaatttcaaggcacagcacacacccacctggaccccaagctaagacttcttcaaatcaaacacttgaactgaagcttcccttggttaaaaatgaaaaataaaaaccggcgcaagcagttcaagagcgccaatgcatatgatgtcacttgtaaatatcgaatggcagaaaaaaaaaagtcagaagtatttttcgcattcattgatccaattccatcattaattttaacctagtagtagtagtaggattaactgtacagagggacatgatgcatgatgtgttggagcttatcttgtcatgctgcattttcggtccatttaatacatgagacagtattacaggtagatcaatgggccaagttctttgcatggatgtatcattggatatttggatcatggcaatggcaatgtgtttttgcatttgaagtagccaagggaccacggaatgatccgaccagatcagcacacaaatcccagacagcatatatatatactgccctacgtacgctattacgcttgatcattcaggacaggacagggcttggcccatttgctagtacgtccccttttttcaacaccttttggccttgatcatttgctatgtcactgtcagtctaaaccctaaccatggccttgatgagctaaaactaaaaaagtgatttttgcattcgtcgtcgtcagcacaacatactattggtcgggattgagatccagtgcagttattactatcactacaactttagcagttgcaaggtagctaatggatcaaaaaccagcggctcagattatcagaaaatattgttcacgaatcactgtagcaatcttctactgtagcgattactgtagcgtatactgtgcagggggtggcagagcaaatccaagctgttggctgcatcgatccaacggttatagtatgttatcactactaaagttgcagtcgttattataactgcattggatctcaattctattgctcggctgctcgcttgctgggtcacagctaaaattttaactttgaaacttaatttaaaattaattttaagggtttctcaaatttaaaataactaaaacttaattaattatatgctaatgattttctcgttttacatgccatacttaatcttcactagattcaaaccggcactaatcaaatctacatgaatgttggagttcgcgagttttgcttccatcccttacggtagcccagtgatctttagccgcagcatagtttgttggttgcagaaaaaacaaagcagcaggaggagcaaagcaaacagagcaaaacataggcggcaaatagcgagagatcctccagaaaccggagagcaaaaatgctactacggctgtgtttagatgtgtttagatggtggaaaagttagaaagttagaagaaaattagtagtttggagaaaaagttatagtttatgtatgtagaaaagttttcgatatggcataaaatgatgttaagttgagaatttggggtaactaaacacggcctacaacacattccaacctatttagcgcccggccgatgattaaattcgccgtacatagacatagtaatgtcgtcgtcggccggcgtgtcggtctaacactccgaccatgcacgagtgcttcccttcacttgggttttcctttcctttctcaccacaaaaaattgccgtccttgcatcgcagctgtagtagatgggggagacacagggcccgtgtggtaggtgacgagaaattaacgaggtgtttggaattggacatcgtcacgttgcgaatctgcgttgctgtagcctgtagctagcgtaatggtgttggttttgtgaacccatttggatgtacatgccgagtttatcttattttctattaaaaaaaaggctagtgtacgtacctgtacatggttttttttttagaagaaaccaatttaatttgcctttgataaagcatgagaaaatagagcgtaaaagaaaagttacttacaggaggatttgagtctcctcacagcaacagcatcagcagtagagaattgcttcttctttgatctttgataggatggcagttgggggtatttgctaggtgtttgaatgaagatctttcattccgtagggttttctttcgtaaactccacttgaagcgcgaggtgcagggcacatcacgatcgtccgaccttaatcggaggcagccgatcacttgcaaagaagacatgttgaatccaaagaaaatattgcccatgattccgatattgtaataactattgttttctttcttttcaatatcttcaaaaatggaattgca

SEQ ID NO: 88416 - DNA, 1099 bp, Oryza sativa
cattcggctgccatggagaattcatgcgaccatgatgagcttctggaaatgcttgaattagctgggatggtacttgttcaggcgcttaaagaacttaagaggtaaatccattacctttcctcattttattgcttttatgctctgaccaaatctaaggttcttatacattctgtaattagagagaatgctgcctggtaaagcaaatttaagttttccattgcttctctatgataatacaagtataagttattttttatgggcttctgattttgcccaagaaaaaatatcttcacgagtaactgtatataatcataatatctgtcttgtttcctggtgaaacttccttaataccctgataaaaggttaaatgaaatgtactgcgtactaattgttagctgatgtcccattaatacgtaattcatccaggtgccttaaacccttacctaacttagcttgcctttgaaatgataaaattgaaaaacaatagatgtacacatgcaaaaagaatgatcccatactttctaatgtctggttcaggtttgctctggatttatatggatggatattgaaaaaatgtgtttttgtactaaacatgcaaacaatccttaatacttgttgttattatcttctttatccactgtgtagaatgtttccatagtttctgaagtctggtttatattctggtgtgtgtaacacattatgctaactgttccaggacatctgagatgtttatccagctcaagacaatctacggttcagtggcatcaataccattgaaaattttcattacagggtacttgttacagttacacagaggccccatgtgttgttggtttttcatggagtgttttcatgcttccccttctttgtatcaattactggtatttttcttctcgtagggctacgatgcacatggcaggaggatctggatctgatcttagaccaatcttcgatgaataccttgctaaatggagatatactgatgatcaagtttatgttttagatgaaggaaagaacagctcctcaaatgggttggttgttacatcggttatgtcacctgaacaatattttgaggtggcagagttgtacacggtaacat

SEQ ID NO: 88417 - DNA, 1142 bp, Oryza sativa
ccaaacattctgaaaaaaaatgaatgtatatatcaccgagtcagctttttgtcatgcaacatgtaatggaggtgatagctttgaagtaaaacaccatgacaataggttcacagtacacctagacaagaaggagtgttcttgtagatattggcagctgtcaggattaccatgccctcatgcaatatcatgcattttcttcaagactaagactaattcactggatgagtacattgctgagtgttattcagtgaaagagtttaagaaaatctatagtcaatgcctggaaccagtagagggcatgagcagctggccagaagatgacaaagagccacttaatgctcctgggtatatcaagatgccaggagagaccagaagagaatccaatgaaccattaaaagccaccaaactgtcaaggattggctcaatcatcagatgcagcaagtgcaagcaaattggccacaacaaatccacttgtaataagcatcatggaggaggctctagcacaccagattctctccaagttgtaaatccagctgataatttaatgctctcaaacacacaacaaagctctaaacaaagcaggaaaagaaagtcacgtacagctgctaacaccaattctgcaagtcagtcaaggaaaacagtgtcttcaaagcaaaaggttagctagatctagtgcaatttgaattcaatttatatttgatttcactcagagctaacaattctatgatttgcaggcactagtggaattgcatgcccattctcagggttctacaagtgcaacaattaaggtcacttctgggcaagcttttgtcaatgtttcaactcaagaatcagcaaagttcaagccaaagaagcttacacctggtctactgctgcttatgcctccatgggaatctgacaaactgtgatgtaatgttagatcaagttatctgttattaaacttgtgtgtgatgtaacgccagacaattaggccatctattagacttatctgtgatgtaatgcaagactttatggcctgtcattgtagttgccagacttaatggcatattgatgcagtcaagaaaaccatctgggagttttggctccagctgttccagcatcaacaattttctgaagtcctctgcaggttattagcagttttt

SEQ ID NO: 88418 - DNA, 2216 bp, Oryza sativa
atcgtagttttagaaaacatgaagcaaataacccatgagaaaaaatctggacaaaaactgaaaagaacatgtcctgatgataaactaccactaatcaagagacagttcatgcttagggttagggagtataaaatgtaggccaagacaagcaagaacacaacaaaagaagaggactgattgtgccaagagcagagagagagagagaggtaggaggaggagcacgaggaacgaggagaggataggaccccgacctaatccaaacaaaacaggacgacgcgagatctgatgaaaagtctcccgaccacaagccaatcaacgcaaccaagaacagaagcatgattgcccccaagctactagagtccagcaagaaccctacttggatcgaagccaatcactactagtagatctgcccgcaagcagccagcggttggccatggcgatacgctatccgagacgaagaagacgagacgagacgacgacacgaggtagtacaaaatgtatacagtggcgaagcagagcaaattgcatcgtcgccgtgaggcgcgatgagtccatgactcgatgaggaaattgcgggagatttgttggattcgccatggtaagcgagcacgtgaaggtgaagccccctccgcttcccgccgatccgccggggggaaggggaacggggagaccatcagactcgtctttgcttatgcttattcgataaaatttgaatttttaaaattatatgtagagttaattttgtggttttttaattataatttattttttagcctatacttttatatcattagcaatatgtatataaaagttttattcacaggttatttttcatttgtaaatattcggttcgcttttttcttcagtatgcgaaacgatggggctgcaagaaaccaggttaggttgttgcaggtttcatatttttctgttccaggattgcgtgaacgattttatatcatttataaatgcttttagaggattttaaattttaaccaacaatttcactaggcaggctccaatctcggcccgtagatatggatgggctgcgattttgttcgggccaaacaaggccaccatgacaattaagaaagttgagtagaagataagttgtagtttatatttctcttcaatttcttatatcttttaagattattaaggaaaataaggagtataccaatgtagccttttgttccaattatgaagtttggtcaagccagccagccggaagcattgcaccattgccttttttttaaccttggattgaaaacaatttggggcattttcgcaaaaactgaactagttttatgtaaaatttatgtgttctaaaataacccaatctcattccaattgacacactgatttgtttgtgttaatttttacgattttatttactgatgtataacatcataagtgagtatttcaacaaaattaagttatttctgatattactacctaactataatttcatagtcaggtttaagttttaaacttcatataaatagagaggtatatgtatataagcgtctgcttttatattgtactatacttcacaagaaaaataatttcatctatcgaaaaaaaaatcccttgaacatatatatttgcttaagagattaaagctcaagagccgattgggcaaggtcaaaattgaaaagaaatttaccagcggtcaaaattgaaaaaaaaagacgaaaaaataaaactagtaatcctagaaggtgacggtgtcgagcatcatgccgagcgtctgcacgatgttggcggacatggcgtccatggccttctcctccagcttccccttggcgtccaccttgcccgccctcaccacggcgagcctctccggcggcgtctcgtcctcctccctcacctgcgccccgtagcccacggcgaggtcccgcatcccgcgcaccgccgcctcgttgccggcgtcgtgcgcgccgaaccgccgcagcgcgaaaccgtcggaccacccgctccggctgaggcacgccagcatccgctcctccccctccttcatccggtagctgatggcgagcgagtagtagtgccgcccgaggccgtggacgagcgccaccgccgacggccgcgcgacggcgccgacgttcgacgtggtctgccgcgcctcgccgcccgcggcgccgccgagcaccatcgccatgtggtcgacgaggcggaacgcgtccatgaccaccttccccttgacgctctgcaccggg

SEQ ID NO: 88419 - DNA, 957 bp, Oryza sativa
aaaaaatcaacaagatagattaatatgtgataaatcatttcataaacatgtaagattaaatttaacttctacaagttaaaaaaaaccaaattggatttataatatacattaactagctatagtttaatttgtcttttttatttgtaaaaattgaattttaatttgcatgtttgtagagtgatctatcacatattaatatatgtagttgattattttttcaatttcttacataactactaggataacatgcagatgagaatttaggatccactcctgttcatttgctctgcctacgactattcgttatttctttctgaacgttttgttcctgagctaacaatcacataggccatgtttggataatgggtttggaatatgatttcttacccctcaaaggataagtttcaatcatagccatccattcttctcactccatttcatcttatccctccatcatttctatttcccaatcccacctctcctaacccattatccaaacacacccatatattatcaaactctgttcaccaatcgaggtagtacaagcaacaggttagctggagtgtagtactaatacagatgcgctaggccgcggcgctgtagggcgagaggtgggcgtaggcatccccaacctcggtccggtagtgcttccccatgccgaggtgggtcatgaggaggcagacgaaggtgatgagctcgccgccgtccttgagccgctccgcgtgctggtaccctccgcagtgcaccgccgcgtagcccagcatctccacccacacctcgcacaccaccctccacctcctccccgggtcggccatgctctgcctcagctccctcgccaggaagcacccatcccacagcaccgacttgcacttgtcccccttcaccaccgccgcgtgcagcggcgtgtccacgtccaggagcaccctgtgcgcgttgtcctcgcccaccgcccgccgc

SEQ ID NO: 88420 - DNA, 5270 bp, Oryza sativa
cacgacccggccccgccactaccgcgcgcatgcttccaagagatggaggcagagctcctcctccttctgccgtgccgctctctctccctctttcttttcccaaggtggcaagaggcaagcctcctttctctccttctttcctcctttttctccctcgccggcgtcatgccctctgccgccattttggccgcgagcgccggagcgccagctcactctttgacaacccaaggtcggtttccgaaccgacattgccaccctataaacccaagcccctccccaaaccaatctccctcgttttcgtctctcgccattgccgcctcgctcatgtctgttcgccgccgcctctcgttgccacgcgtgccggaggagccggcgcgttcgtggacgcggaaggggactccgggcgctcgtcttcatcctcttccccggtccgaggccggagagatcactcccgtgccgtcggcctctcgtcactgcgcccttcaccgcacggtagtgcatcctcctcgttctccctcctcgctccctctcctccccttagctttaggtagtagcacgagtagacctcccgtaactagctggcgccgccccgaccgctgccaatgctcgctgtgtgctcgccgctgtcgccgcccgagctcgatagcgcctgcacgtcgccggcctctctcgtagtgtctccgtctaatccgacgctagaaacggactccggtggtcgcgtagatgctcaagtgcgaaggaatcgatctcccatcgcgccgtcgccgttttcccttctctcgccgccggttgccgccgccgcaatccgccgccgtcgagcctcctccggcgaatccgagccgttggctctctccctctcgtcctcccttgtcattccggtgtacaccctgtcgcccctcgtcgtcgcacggcgtcccggagaaaccgccgccgcccaccgtccattcgcggctggcgccttcgtctttccccagccggcacgcgtggcagccacgtcggtgccacctcggcacgaccgagtcggctgacccggtcagccgctccctccgttccaccctccccgtgcgcgtggtccatggtgagccgtgaggctgcgcgtgggcccgccgcgcaccgcgtccctcccccgaaccctagcgtgcgccgcgtgctccctccgcacggtgaaccgagccgccgacaagcgggtcccactcgggaccacgcgaggtggacccggtccactggcacaccggctccctctctccccgcgcgtacctttgggccgccttctcgggccggccggcccatcaaactcggccgagccgcccctttctctcggaccgcgccctagccgctcgagggaagtctatttcccctccctatttcgattctaattcaaaaaaggattttaataaatccttttcctttagaccaacaatccaataatcttagaaattcaatatcttctcaaccatatgtccgtttgactccgttcaactttcaaaattcctcaaatctcgagatctatttaatggcacgtttagaggtcaataatagggctttatttttcgccgtttgttgagttgtcccgtttcgcgtgtagtttcggagcccgaagacccggagtgcacggatttcgaggatcaagctcaagatctcgagcaaggcaagtcacctttgatcatcttgcacctataatttaaatctaagtatttcttctccgtaaataatacatggataggattaacacaagaaatttggccgcggcttgcgagatagcctactggccctaatccaagttgctgcaattaccctccttgaattattgaacacttaaaacctcctttgtcgactgttgtgcttcgatgcacgagccttcaggcacgcgcatcggaacacctcccctcaaatttaaaaatatccaactgtcggtgacatgggacagggagtatcatgactagaggcttgggcaggagcaatcacccacgaggcctgaccccctcgggggggtcgggcccgagggtgatgtggccgcccccctctttgtctccccgaggggtcggaccgctcccgtttcggcctcgagggttgaggcgccccgaccccttgtaggttttgcgccgcgtatataggttaggtgagcgcagcagggctcacctaaccgcatttattgcggtttggacgagcgcgtcacgccacatgtaacgcagtgcagcgcgctcgtttatccggtctgtgaccagtcacagaccgatcagatcgtgggttaggtggcgacaggcggtctgacacacgcctcgccccatcccgtcaggatgagagcctccaagcactcgtccctagccgaagccggcgtgttacctccgtccccgccgccccgaggcagcggatgatcacatgcgacgaggtcccggtcaaggagattgccctgggcgacggcccgtccaagaccacacggatcggtggtcttctggacggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtagcgcgacttctggaggccggattcatccgcgaggtcatccatccggagtggctggcgaacccggtggtcgttcccaaggcgaatggcaagcttaggatgtgcatcgactacaccgaccttaacaaggcatgtcctaaggacccttaccccctgcctcgcatagatcagattgtcgactccaccgcggggtgcgaccttttgtgttttctagatgcatactctggttaccatcagattcgcatggctagggaggatgaggaaaaaactgcattcattacccccataggaacctattgttatacgacaatgcccttcgggttaaagaatgcaggtcctacttttcaacgtactactcgaatttctttgggtagccaaataggacgtaatgttgaggcttatgtcgatgacttggttgtgaaaacgcgcaaccaagagaccttactctcggatctagcggaaacttttgaaagtctccgctccgcccgcataaagctgaaccccgataagtgcgtgttcggtgtacctgcgggcaaacttctcgggttcttggtctctgcccgaggcatcgaggccaaccccgagaagatacgagctatagagcggatgcgcccacccagcaaacttagggatgtgcaatacgtcaccggttgcatggccgccctaagtcggttcatatcgaggctgggagggaaggcgctacccttatttaagctccttaaacgctccgggccgtttacttggacggaggaagctgaacgtgccctcactcagttgaaggcgtatctcagctctcccccggttctggtcgccccggagccagatgagcccttgctactctacttagcggcgaccccgcaagtagttagtgcagcgttggttgtggagcgcgatgaggacaatcctcattccgcacatccccaccctgtgctagcttggcccgggagagagcagggaggagaggccctcgagccgaacggtggcccaaggcccccgacgaccggaactggccctctgcccgcttgtcagacggtgccaggtgcccccgacccccaggatggcccggcggccactgcgggaaggccgcacctgtcgccctctgaccccgaggctaaccctgtgccgactcgacccgggagagagtagggagaagaggcccccaagccgaacggtggcctaaggcccctgacgaccggagttggccctttgcccgcttgtccgacgacgccaggagcccccgacccccaggacggccccgaggccactgtgggaaggccgcccctgtcgtcctccgaccccgaggtcgtcggcacagaagacgagtgcgccccgcgaggccgcttggaagaagagcgacccagagatgcggcccctagcgaagaggatcggccccaccgaaaggtgcagcggcccgtctactttgttagtgaggccctccgggacgccaagacccgataccctcaggcccagaagatgctttacgctattctgatggcttcgaggaaactgcgccattatttccaggcgcatcgggtcacggtggttacgtcttaccccctcggccaaatcttgcataatcgagagggtactggacgggtggtgaaatgggcaatcgaactttcagagttcgatttgcactttgaaccacgccacgctatcaagagccaggccctcgccgactttgtggcagagtggaccccagctcccgagcccgtctccattcccgaggccaactcgagcccctcgcagctgcctcacaccgcttactgggtgatgcagtttgacggctccctgtctcttcagggcgccggtgcgggggtcacgttgacctcgccgagcggagacgtcctcagatacctggttcgccttgactttcgggcgaccaataatatggcagagtacgagggactccttgcgagactcagggtggcagctggactggggatccgccgcctcctggtattaggcgactcccagctggtcgttaaccaggtctgtaaggagtaccggtgctctgacccgcagatggacgcttacgtgcgccaagtacggcgtatggagcgccatttcgacgggatagagcttcggcacgtgcccagacgggataacacgattgccgacgaactctcacggctcgcttcctcgcgagcccagaccctaccgggcgcctttgaagaaaggcttgcccagccgtcggcgcgacccgaccccttaggggagacggacgcgcctgaccggcccccgaggcccgtcggagtccaggcctcgggacccgaggggagcgctcccagctcccttagattgattgcttggatcgctgagatccaagcatacctcacagataagactctacccgaggatcgcgaagggagtgaacgcgtccagcgcatctccaaacgctacgtgctggtagaagggaccctctatcggcgcgcggctaacggaatcctcctgaagtgcattcctcgggaacaaggcgtcgagcttcttgccgatatccatgaaggcgaatgcggagcccactccgcctcgcgcaccttggttggcaaagcctttcgtcaaggtttctattggccgacagctctcaatgatgcggtcgacctggtccggcgatgcagag

SEQ ID NO: 88421 - DNA, 1041 bp, Oryza sativa
cacgcaccggctccttcggcacacgtgacggcggcggtcggcgatcagcgagacagaggggacggcaatggcgtggtggagcgagggcgaatgggagaggaaaggaaagggggggaaacttgggtttatatgggcgacaatgtcggtttgggagaggggaaccgactttggacggtcaagccagcgagctggcgctccggctagcagccaatcggcgacagggaggaggggaatgacgccggcggaggaagggaaaaaggaaaaagggaggaagaaagggggcttgcctccttgccgctttggggaaaaggaggaggaagagagggcgacgcggcagagggggggagctctgcctccgtcccttggaggcacgcgcggggagaggcggggccgagtcgatgacgacggcgatgacggcggggcggtttggagtggagcggcgacacgggcagcagacgctgggcaggcgcggcaggcgctgacggcggcggcgactggccggtcggccaccacggcgcgcgcgcgcgggcggcgcggcgatttgggcggcatcggcgggaacagccgcgagagtggagagggagagctcgacgcggctcacgggcagagcggggagagagagagagaaagagagagagagagccggggagggagggggagatgggccgagaggagttcggcccatcgaactcgagggaggctaaatagacttttgcggagggatttgatttgggaaggatttggattcgggattgaactcggcaatagatcggggatttgagatctgagacggcatggacactagagaacaagcaaagaaacggatttcgcaaatagggtttttaagagatagttttcccgctaggcgccacgacggaacgggcgctacatcaaaggaacatctaaatcttctataagtagggtttaccttatcggaggaggggtaaccataccccgatggtaagcctatttacatcgcaacaagaagtgttaaaaagaaaaaaagaatatcaaaatatatttgttattattatattttta

SEQ ID NO: 88422 - DNA, 1959 bp, Oryza sativa
gacggccgcggctgccgcgctcgccgcggcggccggagccgcgcggctcctccgcgggcgcctgcggctccgccgctcctcgggatccgggtccgtgcagtggttcatcggtgacgaggacgacaagcctcagaagcgggacaaggggaaaggcggggcgcacggccgcgtcgtgcgcgagggcgtggagttctacagcaatggggactgctacgagggggagttccacaagggccgctgcaacggcagcggcgtctacaccttcttcggcaagggcaagtacgaaggggactgggtcgacggcaagtacgacggctacggcatcgagagctgggcgcgcggcagccgctaccgcggccagtaccgccagggcctccgccacggccacggcgtctaccgcttctacagcggcgactgctacgccggcgagtgggccggtggccagagccacggcatcggcgcgcagacctgctccgacggaagctcctacgtcggagagttcaagtgcggtgtcaaacacggcctcggcagctaccatttcaggtgagcgtctcgccaaatttcgtgctttattactccatcacagcaacacactgttccgtttcatgtcaactgttcgattggtacactaattactcctatttgttcacatcttaattatactcggtgagaaatttatgcatctgtatctaatttggaacgcgtgctactaaaatttctttcagaaatggtgatcggtatgctggggagtactttggggacaagatccatggatttggtgtctacagctttgccaatggccactgctacgaaggctcctggcatgaaggcaagaagcaaggatttgggatgtacacattccgcaacggcgacaagcgatcgggggactgggattcagggactctgaagaccccccttagtccaactgatccttctgttcagcgtgctgtacaggtatatatatacacattgatctaactatcagcttatgggttacaattgcaaattgcttgtggtgttctaatggttgcattgtacaattaggcagcgcaactagctgcggagaacgcgtttcacctgccgagagtagacgagcaggttcacaaggcggtcatggctgctaatagggcagccacggctgctcgggtagcggcgatcaaggcggtccagaacaggatggatgggaaattctgtgatacctatgtgtgagtgagtgtgtggtgaagaaaccatggctttccttccttctaactgtacattagggtagcgaaggacaataactaatcggttgaggttcagttcagacgaccggagcaagcacaaccgcttgccccgagtcagagagttcagcaaagaacgggagccgccgggagagcggagctgacaattttgtttcgcaaaacagctcagaatctgcaacatcgcaatcgcgattggcggccccccctttccccctttcttgcaagctgtaaattgtaaatagatccaggtgtatcaatgcaagagtgagctttttttcctcagtccctcttcttgccatttactgcatcttctatgttctttatttgcattacacatataatgtggttgcatctactactacaattccattgcctctccagtctaaatcttgaccgcttgaggttgtactcccatgtgcagtgattctccatttgcaaatggtacatggtactgcacatgggagactgtaaatttctttctggtcctgcaacttgtaactgtgattagtaggacccaaggtactattgtaatttgagcactctgtgttgcctatccattccctgcatctgtgcccactgcatttttttcaaaactcggggcgattcatagctttgggtccacttgctgctccagatttttgcaccagaaatatgaattctggtgacgaattatgcaagtgtcaagctggcacaatgcattgctgtgtgctgggactgg

SEQ ID NO: 88423 - DNA, 3738 bp, Oryza sativa
  unsure (1)..(3738): unsure at all n locations
ccgcgccgccgccaacttctccccctcctcccctccacctcgctgaagctcggcctcctctcgcaggtgcggtggcctgggaggaggcgcggcgcccaacgagaagtgcggaggtggccgacgtgggtagtaggaaaggaggccggcggtgtgcaaggccacgacaggtggcgcacgaggaggttgggcggcatgcaggtggcgcgaggccatggggaacgcggaggcgacaacgcgcagaggggggcacgatgccgccccacacggcgacttgtgggacgactgccctcccacgcgacgacgatggcgcagcggggcgagcctgcctgagctgtgtgtggtgggctaggcttggcggctagagggacgacgtggttgtccgacgacatacgttgtgtgggtgggttgtgtggttttggatgaaaatcgctggtgaaagccttggctagcctttggttggcttgacgacggccgcccttaggcgtgcgtcgttcccctccttagaggtgtcgttatggcattttttctccctcactaccaagaaccctgcctgtgcaacgatggtcgttagtggactctcgcgtcgaacctctgtaagcctagctgttcagcgaggccttcgtctcctgggtttcgttcttggatgtggcgagcatctagcattcttcgttttctactaggtgaagtcggagctgcttcgttgggtgcgatgaagctcggcaacaataacacattgcagtttttgaggagtgttggtgttagctgtgtacaagaagtggtgctctggcggcttgggctgatgttcaaagtggacaatcggtgtcttgctcgtttctgcgatgtctttggcaatgatgatctgatagccgtggagttggagctgttgtgtcgctagtcgacaagctcggcaacgataacatttgcctcacgaagtcgaagcctttatatcgcttacaacaagctttttgtcgatggctgctttgggctccgcctttgtccttttttcttggtcttggtagcttaggttagctaagtgtgttgtagttgtggttttcgcataatttttcctaattaactgtgcattgtaaggtttggttctgttttctttttaaaatgggataccttcttctttatataaaacgtcggcaacggcctgaccatacggaaaaaaaaaacattactccggccggtgaccgtcctgaacaaaaacacagaacgcctgaggctgcgttctttcttcttatgaacagtgattacggaaaacggagcgatccattagcacatgattaattaagtatctgctattctttttaaaaaaaatggactaatatgatttttttaagtaacttcgtatagaaacttttacagaaaaatgcccgtttagtagtttgaaaagcgtgctaacggaaaacgaggaggactttgctgaaaagaacgcagcctgaaggaatgtgtacacttcggccggtgaccgtagagaaaccggcgtggagaagagaagggtggaactagacatgtgggaccgaggcctgcatgctgcggaccgggggaatctggcagaactatcacgttccgagggaacggaaggtggtcagagtccggactactcccctcttggatttacgcgaatatcgtgggaaaccaaaaaaacccaacccgctctggtgaggttggcttggcttgctgccgctatccacggcagcacagcgctcgcccgcgaggtacgactagctgcagaagaaacagcgcccaatgcccacacatgatgagcgttgcagaagcagagagagatcgagagagagagagagagagagagagaggagatcagaagatctcttgcccgttctctacgctttcggctccggattagacctctgatgagcatatctcgtccacagctctcctaatcatgacgctgcgccgttctcggttctcacgatcggacagatagtctacattaccgtagcttcctcttctttcacttgtctactcgtagctgcctggtatacctacgagtagtccagtaggagtacagtactagtactgctccagataaaaattacgtgtacagcatcccggaaacaaagactgtgccggcctcgctgtccgctggttcgctccatcccggccgatctcttcccttgcatgtgagcaaaaggacctgcatagctgtaactgcctttcacatctttgaccctgagagatcacgcacgagaggtggcaacaagcagcaggagtagtactactactacaaaagaagaacgggngaaagnagnatncanncancgcncgnnagcncgnanannaggncnttncnncctnnttnnccggnactnntgtcgtccaaaagatcgttggattcttgaagcattatcacggtccaggggtcagcctctcggctgctgctacgcaccgtactatactccagtaccgagtatgtacgttatgtggtggtagtggcgacgctgcgttacatctgtacagaaaacctgatttgcttgttcgattagttgggcacacggtggcttgcaccaaggtttaacccacttgggcttttgcaccgctgcggaattagaaccctaaccttgaccgcgagaacagaagaggtgagctaactaggaagctaaacgcgtcggattagaacagcaaaatggtcgtcgtcgttgcatggagtcgcgttggcgtttgcatgcgtgctgacttgactagctggtgcttgttggagaagaggcggctgacagctgctgctgcgacgacgacgacggcgcgacggtcaggcttaggtcgtcgcactccagcacgaggcgaggcttcgtggccggcgacgtgggcgggtgctcctccggcgaagacgctctcttgctgccggcgccgcacggggcggcgcttaggtgcacgccgaagagcttggtcggcgccgatgaccgagcggcgctgctgttgcctgcctccccgccgctcttctcgccggctagatgctgctgctgcggcggaggggaaggctcctcggcgatggtgagcgagctgctcgacgttgtgctcccgcctgagttgttgagcacgttggcggcggcgggcttcttgcgcgcctgcatgccgaggccctgcaggaacgcggccgccgccgggctcggcgccacgggacgaacgtggttctgcacgaagtagatgatgtcgttgtacagcttgcgcatgtgcgcaagctcctgcagcagcgccgtgttgctccgccgcaggcgctcgttctcctccatcagcaccgcggcggtggcggcgcgcccggcgccgccggcctccgccgacgacggcgacggcgcgggcccgcctagcgcgagcaggcgcgtcgcgaccggcaagttcggctcccgccaatgcggctgcgggaacggcatgccgatgccatgcgccgccacaaccccgtcgtcgccgacgaacgcgtggtggtgctgagccgccgcgacgccggggtggtggaacagagggaagtgcggcggcgcgaagaacggcggcggagacggcgacgccgtcgatgcggacgacgtcttcctgcggtggatctcggtgagcagctgcttctcccccttcctgaagaactcgttcgcgaactcccacctctccggcacgaccttcctgaacccctgcattgcaacgacgtcgttacttacacgcatcaaaacgcacgagagaacagaactacagaaggtggcggcatggcgctttgcttacgtaggtgttgag

SEQ ID NO: 88424 - DNA, 632 bp, Oryza sativa
tctttcacatactttgttctcaccctgtcatgcctaaacaagtggaccgtgatgaaacaatagtgagcatcgactagggttaaatggtacaaaattgaacattgcaatgaactcatacaaagataagaaatatttacttgtgtaattcaactccagttgagatgtcctcaaccggtcaatcctgtttcttcccgaactgtcacatgacacggtgcggaaggtggtactcaactgcccagaaacaaatcaatgggcactggtacatgaaatagtcagagtctcgattgcacatcgagttcagggtcaggcttgaagcctcatttgtgtggtatggtcaccactcaatctacaaaagttgaagagatgtcgttggttagtatctcaattaaagaagtaaatgtctaactagaagtgatattggaagtacttacatgttgaggctgcaagcagtccatctcattgacataatgcttgtatgccacatcccggtgagcatgtgcagtggcagtactctcaaaaaggtaggccactgtcttctccatgtctggctcattgtagggccaaggagtgaagctttgcctccacttaggccttccaaccggtagattaaccacatccacatctgaatcaat

SEQ ID NO: 88425 - DNA, 1525 bp, Oryza sativa
atttcaaaaaaaaaagaagtttgttaggcataactcaagtaatgcaaagtgctaaataaattttacctctaaaacattgcggagcgtgttctccgtgtcctcaccacccctcggagattggagggcatgccccatttcattcacactcctgaggagctctctcaactgaaagcgtgagaagatatatgttggggtctagggtgcaaatggaagtaactttgacaaatgcaagaaaacttacgactctgtctctaagtggggcgtgctccatttgatatccaactctagtccagacatcatagggattccgcccctcatcggagtcgcggtcatcctctatgtcggcttccgtccaagtagggcggaggaacagtctatatgtcctatgcagccaacgaaggtactctgagaaaagatgattttggtgtatagtctcgatgtacctatcgttccttccggctgttctccattcatcaatgtatctattatgctctagcccccagtctttcacattctttgttctcaccctgtcatacctagacaagtagaaggtgatgaaacaatagtgagcatcgacaagggttaaatggtacaaaattgaacattgacaatgaaagcaaacaaagataagaaatatttacttgtgtaattcaactccagttgagatgtcctcaaccggccaatcctgtttcttcccgaactgtcacatgacacggtgcggaaggtggtactcaactgcccagaaacaaatcaatgggcactggtacatgaaatagtcagagtctcgattgcacatcgagttcagggtcaggcttgaagcctcatttgtgtggtatggtaaccactcaatctacaaaagttgaagagatgtcgttggttagtatctcaattaaagaagtaaatgtctaactagaagtgatattggaagtacttacatgttgaggctgcaagcagtccatctcattgacataatgcttgtatgccacatcccggtgagcatgtgcagtggcagtactctcaaaaaggtaggccactgtcttctccatgtctggctcattgtagggccaaggagtgaagctttgcctccacttaggccttccaaccggtagtcttaaccacatccacatctgaatcaatagcacacaaccactcatgttggatgatggtgcctgacgacaacaggcctcacagagctgtctatatgtccacgccaacactgctgagccctaactgaaacggcccagatcaccaaggttggcgaccaaaggaatccatatcgccgaagcaatgtcacccccagcatcaagaaacagaacctctcccaacaagtgcaagatgtatgcacgggcataacactcaacacgccatggctcagcatcgtcgtcaagatgtgagaagttctgactcagccaagacaggggtattccattctgttcttcttccccccttgcccctgctcaatgttcagtggaatgccaaacagctgctgcacttgtgcatgccatccaggagtctctgtcctgcc

SEQ ID NO: 88426 - DNA, 1506 bp, Oryza sativa
atcatattaagtacaacaatagaaggaacaaattattaatcacagagttccttttacctgcagtgtacaagaagcatttccctcctttgctgacggacaacgtctggaggctgaggaacataggcaaagatgggccaatcgacaagagattggaggccgaggggatcaagaacgtccaggacttcttgaagcttaacaccatgaatcccaacaagcttaaaagtgtaggttctcctgtttcaattttgttcaaacactttgggggattatagttcataatttgtataatacaaattatttctgctttaatttgttctgttgtgcacacactgttcagcttgttggcatgtcagatcggcagtggagcgcgacattgaagcaagcaaaatcatgtgacatgggagggaaatgctatgttttcaaatctgaaggttgtgagattaaattcaaccccgtaggagagatcttagcagtgagattcggcggtcggatgtgctctttgcatgaactgcttccacaccaaatggtaacttccttcattccaccaaattaattaatccctgtatggtcaatgaaatttgattgtcttactaatttcttaagattaccttaaatttgctttgatctcaattgcaggtccaaatcaagcaattggtcagccaagcataccaacagtgggatcagatggaggaagtgcagaatgagatggcacttgttgataaaagctaattccatttcatgatgaaaagcccatgatttcttcaggcatgccaagtaatgaaattgctgtagctccctgactttgtcagctttatttttaatttcaaaaaagcatgcattgattccttggaccttattatttgcaggctatatcaatcaagcagagggattgatggagaattcaggatgggagccaagtgagatgagccaggaaagcatgatcagctctgcatctcagaatgccatgtatgttgacagcttgggaactgcaacaacctcaactgctgaaatggtgaccaataacatcagcactctagaacctgcatcaactgttccagattctgctttgtacagctggaattcgggcatggctgctgatgatcacttcagctggcagaacaacacaaaccttgtaccctgggatcatgctaattgatcattgctatctggagtccgaacaaattaatcctaattgctatcggtttagatagctagtgttgttatgcttttactcaaataataaatatgttcatattgagggagctgtttttttttctctaatcttaggttgtttggctcttatcttttcttaaccttgatgagtgcattttgtagcaatatctactggtcaagttagttattatgaaaaaaaaatagagggtcacatacgtcttccctattaattaatgcaatactggtagctcgtatatactagcactggtggagaaaccatctttcgtcggtcgggctaattccacaatagtcccagttgcaacaaaaagggta

SEQ ID NO: 88427 - DNA, 745 bp, Oryza sativa
tgttactcgccctacagactcccgagcatccaggacgaacacgagggaaatgtgtgattccctggaagattggatttaaggaggacatccacacgtacaggagtcggatgaggagcaagagagataccgaggcgaagattgcagatcttgagtacagggtatcgagctacgagctcagcatgcaagaggaggtggcaaggaaggtggatgaacgtatggccgcacatcggtcccaggatccccagccgtacattcatcctgcaatggtcagcccatcaggcaatcgtagcagctgcgtctcaacggggcaggtcggatcacagagcatggacgccatgcaaacccaggacgaaaccacctgccccgttgatgagatcacgcagcggacaccatgtgagctgcatattcccttcaagaacttatcaatcaaggtatgctcatagtttgatgatttttgacttgtacattccgcaagttgctgcttaggttgattactaatagataacctctcatcacgtgaaggtggcgtcaggaatggccatcccaacggacccttccgggacttaccactacaggccgattctagcaggatactcgagtgtcgaagttgagttggtggaagccgcgtacgaggacctcgagttggactacccaggaggagacggtgagacgcatctacgagacacaagccacgccatcatactatggcgcaagcagtacatcatccttcctgggcgacaagcgg

SEQ ID NO: 88428 - DNA, 1156 bp, Oryza sativa
cccaacactagcatcctcacgtagccaccccataaccttatcacaaacccacgctctctttgcattcctgaccttctcgctttttctagtactaagaaaaccatggtacatctcatggaccttaatctgaaaaagaaaaaagatgcaatttgataagaaaataacaaaatatgcaatgtaacacatacctgcactgctggaccaccatgaatagttgatgcatgaagcctccatccacatccttctttgatacatctagctctgaatctactaggatcagtttttttaacaaaaaactcgaattatttcttaatggaatattgagccacagccaatctaaactcacacattgaaggataaatagtctcaacagtcatgggtgggttctctttgtcatatgcaacttgtgggattactggatctgactgagcatctcgtgcaatccactcttcatcatcactatcagtgatacttagatcatctcccccttctacctcaggcacattatcagttccagcaatagagtcatcactctcagatgaagagtcatcactctccgatgaagagtcatcaataccaactgagtattgtttctcatcatctacacctacatgctcatagtgcgggaatggattttctaggtatgcatcacttttggatgcctgactagtgctgccttcctgagtaaaaaatgcctgagaggggactgaaagtgatggagtgcaaggcacaataacttgggacagattaatttggtttcccagagtgattaccactttaccccttttagtatgatgaaagcactcaaacattgctgtcaagtcctgatctttgcatattggaatgagttctttgctactagcatgaatataatgcaaacatacagtttcatttaaagcccatggatatttttcacaaatatcacccagaaaatctttgaagttagttacgtctgcatcaataggccatttgaaagaaaaaccacccggaaattcaggcctacatgtcttgcccattattctcacgtcaagtaaataagtagaagatgggtccattctgttgatgaacacatcgtcgatgtgtgagaagaaaaatgtgaaaaatgtaactgctctgactccctaatacaagtatattactcatagggcataagatg

SEQ ID NO: 88429 - DNA, 556 bp, Oryza sativa
agcgcgccagctgagtgaaacggttcaggtactcttgtactgtggtattcccttgctgtagtctcctgaactcattcttcttcatccgcatcaccgcagcaggcacgaagttgtcacggaaggctgtggtaaattcctcccagtttggttctccggcatcttcttctcgggcttctttgtacgtgtcccaccagtctccggctggtccttccaattggtttgccgcaaagatcactttatcggcctcacgtactcgaacaagagttagcttcttctcaatgatccttaaccaatcttcagcatccataggttcttcagctgtggcgaatgtgggtggcttggtcctcataaactctccaaagcttgaccctccgcggtcgccttggttgttcgcgatagcttgcagaacttgagtttgggtggccataactccggccagagtggttaagtcgggtgtctaagtttcgtcaaagctggttgttgcccgacgtcggcttgccatctgtgtaggttgatggagtaagtatcctattttctggggccagagctgaatgcc

SEQ ID NO: 88430 - DNA, 719 bp, Oryza sativa
aattcatcagtattgtacaaattgagcctccatcatcattaatcatcaaaatcattgttatatcaatcagtatcagttttttcatcatcagaattatcagacccagtcggccgaaggtcgacatcttggaatctctcaaccacgtcagcagcaatcttgtcagcggctttttgcgcatcattgatgaggtcaagagcagcttcttcgctcatcccatctgcaaagccatcaatggcatcaatgtcaactcttggataaagggatttggtcatcgccaatgccagacttgctcccatacttccaacttctttgatgttcttgaagtaagtatccggagcgactctcagcttgtcgaagatttcggcaacatcaagtgtactcggaccggcgttattgaagaacatggcttggatgagtggagtagcggcattagcgactttgtccctggccccttcaagcctattgatcttgtcgactaagacatcaaactgtgcctgggacttgatcttgcggtctgcatcaatagattcacattaacgaatcagcatatagaagataatggcttttgaggtactgattatttggtaccttcaacctcctttaaagatgagtccctctgttttgctagttctgccttatcattttccagagtttgaatttgcttctctagttgagatatcttggcagcttgcactacattgactctggttaatcaagat

SEQ ID NO: 88431 - DNA, 595 bp, Oryza sativa
acatctctggatcatgcgttgataggttgctcctgcgttctttaatccaaaaggcatggtgatgtagcagtaggccccgaagggtgtgatgaatgaagtctttaagcagttagattcctttagtcggatctgatgatatcctgagtagcaatccaaaaagctgagtagctcgcagccggcggttgagtcaactacctagtcaatgcgaggcaacccaaagggatctttggggcatgacttgttgaggtcggtgtaatcaacacacatgcgccattgtcccgtcttcttctgaactaggactgggttggccagccagtcgggatgaaggacttccttgatgaagcctgctgctaacagcttggccagttcctccttgatcgcatccttcctatcctgcgcaaaacggcggagttgttgcttgattggtttagcgtcttccttaacatgtaaaaagtgctcaatcacctctctaggaataccaggcatatcggatggtttccacgcaaagatatctttattattttgaagaaaggtgatgagcgctttcctatttacaatctaactcagcgcctattacagcagtcttagtaggatc

SEQ ID NO: 88432 - DNA, 537 bp, Oryza sativa
attccactttactttctttcagaggtgaggggagcatttgggctttggaattctgcatatcatgcttgttgctcttgggatgtgacttttcttttccgaatgacacctctgattggggatttccatctggtgggtaatgagttgatccatttctgtcttggagagaagtaacacttctcttgttttcatgtaccatggaatcacctttagtatccaagactgccatcctatgttggattgaagagccatcagtaagcaagttatttttattagcataatgcaagtggttatgacttctagctgcattggagcttttcaaagaagaatctttcctcccagatgcatgctgcagatcatcatccaaactccttcccgaaataatcccattggaagcatggccttgagttaactgaggcaattcattatctttatcagagttcccttgtgaaaaaccattcataacaggttcactagcaagcatgctctcatgtgacttcctggcctgccgaacattatctactataacttcagtattct

SEQ ID NO: 88433 - DNA, 641 bp, Oryza sativa
atatgtgttttactcctgtggaatatttctgttaaatttttggaatttctgggtttctgtgtgatgtagctctggccaccagtggaaggtctggtattttataagcttcttgttcacattgcaggaaacaaataaaaatttggatgagatagttgaactggcaaagaaactccaggttacatttctgcaaccttaaaattgttagcattttgtcgaaatgcattggttctgctctttgctcagatatgatctgaacttcatgcaggaggagaccaatataaaaccactgtgggggactgcacagcttttcatgcacccgcgctacatgcacggtgctgctactaggtagatcagttttgctgcccctttgcatgaaatttggagtatgttctgaagctaatagaagccttcattggtactgcagcccagaggttaaagtgtatgcttatggtgctgctcaagttaagaaagctttagaggtgggttatctttgaactctgaacattgtgataggttttccataagtcaattcttgatttggcttttaccacttgaaggtcacccactacctaggcggtagaaaactatgttttctggtgaagaagagagggttaccaaactcttcttaattctgacatgaa

SEQ ID NO: 88434 - DNA, 570 bp, Oryza sativa
  unsure (1)..(570): unsure at all n locations
actataaggcgaaaaacgactcgggacaccagcgaaaaggaagcagacacnggaacggaaagcacccaaaaagggactgaaaaccagaggtttgaaggcaagacaggaaacaaaaccgaaggagacagggaagggaacgctaagatagcccgaccaacgacacaactacggaagaaggaaaagaagtttgagcggtcagaacagggccaggaaagcctggagcagctcaaagaaaagctgaccacggcaccgatggaaggtcttgcagacatcaaaaaagactgagatatatattgtgacgcaccaaggcaaggactaggaggagaacggatgcaggacgggaaaacagaggcctaagcgtcacgacaattgcgaccacatgaggaaaactaccctacccaagaccgagaacacgcagacgtggtacatgcgctaaagaataggagacaatatctaaatggaaaccaatgcgatagctacactgaccacaagaggcaaaagtaaatctccacccagacagaaacaaaacggaggcaaaggcgatggactagaaaaaatcaaggactaaga

SEQ ID NO: 88435 - DNA, 626 bp, Oryza sativa
tccttgctaacattggcatcagtggtgccattattgctatcaccattggagtctttctcagagtcaaaattgctagggttgtcattctgggtgccttcattgatactatcgtcgatatcttggtgaatgatgttgacattgcacgcttgatctaagtggtcatgaatggggcaagaaccatggttgttggtggtatcatcatcattagtattgctagtgttgttgtctgcgttgtgtccgtcttcttggggtagtaactcttgatgcacaacagaagatccggtgatctgaagtggctcagtgcgctgtctttggttaccacatggaaatactgggatgttgacaatccttctcttgcagttcgtcatccgattatgctcactttcgagttgcatggctttgtccacaagtttctcaaaatcttcataatcctctaggagtagttgcactgcaagctcatcttttaacccctggagaaacttctcttgtttgtcttcatccgtttccacatcttctggtgcatagtgtgcctcccgatagaactcgtgcaggtactctgtaaaggtcaaatctccttgcttcaggtagcgaaactctcgttttcttagtgtgatcattcctgcggg

SEQ ID NO: 88436 - DNA, 629 bp, Oryza sativa
ttttcaccgcctaggtagtgggtgaccttcaagtggtaaaagccaaatcaagaattgacttatggaaaacctatcacaatgttcagagttcaaagataacccacctctaaagctttcttaacttgagcagcaccataagcatacactttaacctctgggctgcagtaccaatgaaggcttctattagcttcagaacatactccaaatttacatgcaaaatgcagcaaaactgatctacctagtagcagcaccgtgcatgtagcgcgggtgcatgaaaagctgtgcagtcccccacagtggttttatattggtctcctcctgcatgaagttcagatcatatctgagcaaagagcagaaccaatgcatttcgacaaaatgctaacaattttaatgggtttgcagaaatgtaacctggagtttctttgccagttcaactatctcatccaaatttttatttgtttcctgcaatgtgaaacaagaagcttataaaataccagacctttcacctgtggccaaagcctcattacacaaaaacccaaaaattcccaaaatttaacaaaaatattccacaagagttaaacacatctttcaaaggtaattagacccaattaaatttccaaaatttaaca

SEQ ID NO: 88437 - DNA, 807 bp, Oryza sativa
tttgtgtttatatgttgatgacatactcatatttgggaccaatattaatgtggtgtctgaattaaaatcatttttgtcccaaaaatttgacatgaaggatttggaagaagctgatgttatttcaaacattaaattgatcaaaggcgaggatgggattatgctttcgcaagcccattatgtggagaaagtcctaactcgtttcgggttgatggactgtaaaatagctccaacgccttatgacccaagtcttaagcttcgaaagaacaaaggactaggaaaggatcaattgagatactctcaaatcattggctctctcatgtatttggcgtgtgctaccagacccgacatctcatatgctgttagcaagctgagccggtttacttctaacccggagatgatcattggcaagcactagaacgcatattaagatacttgagaggcacaatgtcatatgggattcactataccgggtaccccgctgtgcttgaggggtatagtgactcaaattggatctcggatgccgatgagatcaaggccacgagtggatatttgtttactcttggtggtgctgcagtttcatggagatcttgcaaacaaacagttttgacaagatcaactatggaggctgaacttgtagcacttgacacagccactgttgaggcggagtggctgcgtgagctcttgatggacttaccggtaggtgaaaaacctatcccggcgatccttatgtactgtgataaccaaacagttctcataaaggttaagagcacaaaggataatatgaagtcctcaagacatgtgaaaagg

SEQ ID NO: 88438 - DNA, 1085 bp, Oryza sativa
cttgacaactaggaccatgctcacaacctaggaggtcgccgacacatataacagtagcggctcttgcggatgtggcgaggccaaaactggtggagtggtgataagtttcttgaagtcttcaaaggctttttgtgcttcggatccccactggaaattgtcagtcttcttcagcagcttgaaaaagggcatcccccgctcgccgagtcgtgagatgaaccggctgagcgccgtcatgcaaccagtcagcttttggacgtctttttgggagcttggcgatttcatgttgaggatggcgttgattttctccgggttggcctgtatgcctctttgagataccataaatccgagcaacttccctgacggtactctgaagatgcacttttcagggtttagtatcatcctgaaagcacgaatgcttgcaaaagtttcttctaaatccgcgatcaggtcatccttctgcttggtcttgacgactacatcatcaacataagcttcaacattgcgaccgatctgagttgaaaaacatctttgaatcatgcgttgataggttgctcctgcgttcttcaatccaaagggcatggtgatgtagcagtaggccccaaatggcgtaataaacgaggtcttcaagcagtcggactctcttagtcggatctgatgatatcccgagtagcagtccaaaaaactgagtaactcgcagccggctattgagtcaaccacctggtcaatgcaaggtaacccaaaagggtctttagggcaagacttgttgaggttggtgtaatcgacacacatgcgccattgccccgtctttttccgaaccaagactgggttagccagccagtcgggatgaaggacctccttgatgaagcccgctgctaacagcttggttaattcctccttgatcgcatccttcctgtcctgtgcaaaacggcggagtcgttgcttgatgggtttggcgtcttccttaacatgtaaagagtgctcaatcacctctctaggaatacccggcatatcggatggtttccatgcaaagatatctttattattttgaagaaaggtgatgagcgcgctttccaatttacaatcta

SEQ ID NO: 88439 - DNA, 568 bp, Oryza sativa
tatagggcgaattcgagctcggtacccctactccaagaatttgacttagaaattaaagataaaaagggagtagaaaattccgtagcagatcatttgtccaggctgcagatcactaacatgcaggaacaaccgatcaatgattttttaagagatgacatgctgatgacggttcacgactccaacccgtggtatgccaacatagtgaactacatggtatccaagtacataccacgaggggaaaatcaatgaaaattgaagtatgaaagtcgctgtcacatatgggatgagccatacctatatcgggtctactccaatggcctattacgaagatgtgtgccaactgaagaaggaccaaagatcatagaacgatgccatgcctcaccttatggtggccattacggtgcattccgcacccaggccaagatttggcaaagtggtttcttttggccaacaatgtacgaagactcaagagaattcgtcagaagatgcaccagctgccagaggcaaggagaaatcactgctcgcgatgcaatgcccctcacatacaatttgcaagtcgagatattcg

SEQ ID NO: 88440 - DNA, 561 bp, Oryza sativa
tatagggcgaattcgagctcggtacccgatacaaacgaaatgcctaagcataaaatcgacgaagatgttcaatattccaagaattattgatgagagtaccatcttcgcgcttgaggcgataagaacctggccgagtgacttcagcaattatgaacggtccttcccataagggagataatttatgccgatcctgtgtggtttgaattttcctcagaaccaggtcgccgactaaaaaggctcgcgatcgaacattccgattatgataacggtccaacccttgcaaataccgagtcgactaaattaaagctgcttcacgggcttcttctagtcgattgatgtcgtctactcggccctcttcataacactcctcgttgaagttccgaaatcgtagtgattcaaattccacttcacttggcaacattgcttctgcaccataaaccaaaaagaacggcgactggccggtagcccgactgggagtagtgcgtaaagaccaaagtacggatggcagctgatctacccacttgccagcatagggacgtagtcggtcgaaaactcgtgctt

SEQ ID NO: 88441 - DNA, 582 bp, Oryza sativa
cgggtgagaaacccactctttatagggcgaattcgagctcggtacccgttgaggggtgcgaaaaaccgcagctccctcgacgtcttgctgcccgataagctctcgtgctcgtcgcccggcgtccaaggcccgttgtcgtcggtcctcagcctcctttgcagcccgttcgcgttcctgttgttcacgctgcagccgttctcgctcttgtgcttggcgctcctcttctagtcggtgtcgttcggcttcctgttgtacgcgtagctcttctgtttctcgggctttgcgctattcttccatctcgttgtcagccatgaagatgccgaagtagagaggcgtgtagttgtcttcaaagccttcgtcgaagtcgttgaggttgcggtagtcatagcggtagccgaagtcgtcgtactccacgatctccgttggtcgcgagtcgacgccgggggagctgaggtagccgtccagttgtttcgtcgaaaccgtgccgagtggctggagtatgacgccgacttccctggagctaggccgaaccggggctgaagccggatcccgcctaggcctacggggagaagacgcccttgt

SEQ ID NO: 88442 - DNA, 743 bp, Oryza sativa
atgccacctccaggagtatgaactcgcattggtatcttaagcttcactaaagataacccatgtgcaccagcaaaaagcttggaaatgaaggaatgggttgcaccagaatcaaacaatattactgctggtgtcgagttgacggggaatgtgcccaatataacctctggtgctgactgcgcctcctctgcagatgcatgattgacccgggcctgaacgaacttgggtccagcacgtcttggcttcgagcactttccaaccgtgtgtccgggtttgttacaattgaagcagagttcgggcttttctcccaacctcttgggctgttctggcagagctggctgaactgattgagctggaatctttagtgaactcagagtagggttgaggctgtgctgctcactgttgttgtgactatcactatggtggttcttgttgaagctacccgggtggtagggacggtactgccggataatcatggtggaaggtccaccgtgatgtcccattgtgaaacgaggcttctgactcttcccctggggagtcctgaactgagctgccttcctcttacggtttattttgttacagtgctcctcctgacggatagccttatccaccagcttctcaaagtcctcataatctctagagatcaactggttagtcaattcatcatcaagaccagacaaaaacttctcctgcctctcggcatcggtacgcacgtcctcaggggcgtaacgcgcgaggaggttgaa

SEQ ID NO: 88443 - DNA, 776 bp, Oryza sativa
aatccgtgaccgtctaaaagtggcacaatcacgacaaaagagttacgctgacacccggagaagagatctagaatttaaggaaggggattatgtatatctgaaggtttctccgatgagaggtacaaaaatgtttaaggttaaggaaactagcaccaagatatgtgggaccttttccaatcatcgctagacaaggagaagttgcatatcatgtacagctccaaaaaaatatcgctgatgtgcacccagttttcctgtgtctaattaaaaaaagtgctacaagtgccggaggaccaagctccgttggaaaaaattcatataccattgatctcacttttccaaaccacccagtccggatttgggatgaaccaaaaaaaaggactaggaccaaagtgtggcgtatgtccaaggtacattggagtattcttcctgaggatgaacccacttgggaaagcaaaaaattcttggagacagattacccgcatctaagcgaaatccaataaaaaatctcgggatgagatttattaaaggggggtaggtttgtaccaccctgaaaattcgaccaataaaaacaaaactctaaaaatgcggaccttcgaaaactttttaaattaactacatcatgccgattctattcgcctattttatttggatttgatttcgaaattcattagtcgtgagtaaagaatagttaattacgaataaaccctaaaaataaattggcaaaataaatataatttaaaataaagattagtgaggatagaaattaataaaatttt

SEQ ID NO: 88444 - DNA, 598 bp, Oryza sativa
tttagcaggatccactacaactccaccggctgagattacgtggcctacaaaggcgacttcttttaaccagaactcacattaactaaactgtgcatataatttatgcttccgaagttactcgagtaccaaccgcaagtgctccacatgctcttgctcgtctttggagtagattaaaatatcatcgatgaatactaccacaaatttgtccaagtaatccatgaacactttgttcataagattcataaagtatgccggggtgttggttaatccaaacgacattactgtgaactcatataatccatagcgtgttgagaacgcagtcttgggtacatccccggtcctaattttcaattggtggtatcctgatcgaaggtcaatcttagagaacaccttagctcctttaagttgatcgaaaagatcatcaatccgtggaagtggatacttgttcttgatagttacttcgttcagtgagcggtagtccacacacattctcatgctaccatccttcttcttaacgaataacactggggctccccaaggtgacgaattgggacgtacaaatcccttctcttgcaactctctgatttgctttttaagt

SEQ ID NO: 88445 - DNA, 518 bp, Oryza sativa
agtccaaagtccatggcctagggtaaaaccaaaaaaagaagggggaaataagttataattcacatggcaaatgatgatttactttcttctgatacatttaagagatgaaagttacttcagatgaagacatgaaacgatccctctctgtccactgttgtaccatatccaaggtttgcccagtaaaagcagcaaacatcttatcaactttctgcatccagatttttcagaagctttaatcgcttagagagcagaatcaagagaaattccttaccctcatcaaacatctaattcaaatgtacactgaagaaaatatagaacttgttatctatcacaaaacacttacatcacgagcataaatggtttccccaacctgtcgcctcacctcctccacattaccctgcaaatcatccaatttttagaataaaaaacaaacttcaagtacaacaaacacaaaggcaagcaagtatgtcctagcaagactgtatattgtaagtttcatgtggccagctaaaatgatg

SEQ ID NO: 88446 - DNA, 688 bp, Oryza sativa
cggtgtccgtggactcccactagttggcatagtggagttcattttacaagggacatgcaggtattttagggatcggttccaggcagttcttccctctatgccgaacaacagcattttattcggaactttcatgcagaaaaagctagaggagttgcgtaaaaaggccatgaaacatcgagctctagtgcaaggtacccaacagcacaggtttgagatactttgtcaagataaggcaggcaggggtatctaccgtaagagagtgaagcaggaatgtgttctcaaagccgacggcacatgtcattgctcttgtgcaaagccgaagctgctccacaggccatgcacccatgtcattgctgccgcaacggagtgtggcataccatatgcagtatatgtgtcacagtacttcagtaagcaagcagtatatcatacatggagtggcgagatttatgggttcggcatagctggggagttcacagagactaacaatgaagtactaaatattcctgacccatcgaagctccgaggcaaagctggaaggaggaagactcgtcgcatccgcaatgatatggacgagtcggaggctggcagggtgaagcgttgcagcaaatgcaatgaatgtgggcacacctacaagcattgtcctaaagacaaggagaaaccaaatgcggcgggaggcaggactatcagg

SEQ ID NO: 88447 - DNA, 736 bp, Oryza sativa
attcctgcagcccagaattactagccaagtgctatgcttactgctcatgtcactaaacgggttgatgccatacgtgctcagcccaaatctaatgcttcttggatcctttgtaaattcagaaaatatccgatcgatatttctctattgtacaacatctgcaggatgtcttagcataccatcattagtgcggtcctctttgtgccgcctaaaaagcttagcctctcttggattagcaaacaaccgcttcaaacgagcttttataggcaaatagtatacaacctttgccatatcacctttctttgacttctagtcttttgtgctactattttctctcttgtatcgagatgccttgcatgaaggacatgcttctaaattgacatttttcttgtagtacaatatgtaatcgtttggacaagcgtgaatctttgcacctccaaccctagtggacatagtaccttctttgcttcataagttgactttgctagcatgttcccctctggaagcatgtcacttagcatgtcaagtagcttagtaaaacttgtatctgtccatccattacttgtcttgagcttcataagttccagcacagctgataatcttgtgtacttcggtttacaatatgtacagagaagtctcctgatctgtaaccaaccgggtaaatctctcataatcttttcctttgtaactagagtcctctgctcacgtaacatttcttcgaggcaattatcaacatcaa

SEQ ID NO: 88448 - DNA, 701 bp, Oryza sativa
ttcctgcagcccttggttgtgtgtataaatcgagtagccagctcaattgatttagcttgataaacatgtctccgcttatgcttccagtaagggcattacatgaaaggttcaatgccaacaattgttggcacctcgataagttgcaggtattcttccagtcagttgattttctgctaaatagagttcagtcaatcgattcaagttaccaatggattgtggtatttctccagagaatatgttttgtgaaggctaaggacaacaagattgtttagttggccaagagtatgaggtatgctccctgtcaatagattgttaccaagataaagtagggatatgctagataggtttccaatctccaaaggaatggtgccagatatgtagtttgaccgaaaactagtgaagttaatgttttcggcaattcggctacagagctgggcatgtccccgcgtaggttgttttcgccaaagtgcagtttctgcaaattggagcaattcttcaaggatgacaggaatgcccagtctccagcttctaactggtttgagtacagcatgacgacccgcaaatctgtcatcaagccgaaagaaagaatcacccctctcaaagagttgttggccagatacaggaactgcatgttggaagcatttgctagagatttagggatttctccatgaaaatgattgtcagacataatcagaacttgg

SEQ ID NO: 88449 - DNA, 705 bp, Oryza sativa
ctaatacgactcactatagggaaagctggtacgcctgcaggtaccggtccggaattcccgggtcgacatcatcatcatgatcgctcgacatcgatacgactttgttttttttttttttttttttttgcgtgtttctaaagtacaaattcagtttattcatctgtttatgacacagtacacaggaggcaaagtgtttcacatcatagacttcactttcaactccttggaatgttcatttctttggcttacaggagagacttgacaggaaggccaggcaatgcttaggcaactaaaatgaggttgggggtaatgctaacgtcaccctcacagggatggccacggggactgttatttgcaagctggttttctagacctgttagctggaagcatggtgagcaccatttttggacgctcaggccgtgtcgggcttcagtcatctccaccacacaggtacagcagcgctttctggtagtcgcccttagtgtcttgctggatataatagtacagggacttgccgtactttctcttgaattcagacctaattttcaacatgtccacttcactgcgggagaccatgattctgatcaggaccttatctcgcgtccccttgcccttctgtcgtcttctcgcagccgtatagtagtagtaggcggccgctctagaggatccaagcttacgtacgcgtgcatgcgacgtcatagctct

SEQ ID NO: 88450 - DNA, 716 bp, Oryza sativa
tgttttcctgaaaaggaagtggaaatccaatgagcacatggatcacacctacatggaactgaaaacgttaacatatagtgatgtaagcaaagcaacaaataatttttcagcagccaacatagttggctctgggcattttgggacagtctatagaggtatactgcatacagaagacactatggtcgctgttaaggtgttcaagctcgatcaatgtggtgcattggacagctttatggcagagtgcaaagcactgaagaacatccgtcaccgaaatcttgtcaaggttataactgcatgctcaacttatgatccgatgggcagtgagttcaaggctctagtatttgaatatatggctaatggtagccttgagagccggcttcacacaaagtttgatcgatgtggtgatttgagtttgggagaaaggattagcatagcatttgatattgcttctgctctagagtaccttcacaaccaatgcattccacctgttgttcactgcgatttgaagccaagcaatgtacttttcaacaatgatgatgttgcatgcgtctgcgactttggtctggcaaggtcaattcgtgtttattcatctggaactcaaagcatatcaacaagtatggctgggccaagggggttattgggtacattgctcctggtgagtaggttttctgagcatactgcagagtatcatacaatataaagaaattactattata

SEQ ID NO: 88451 - DNA, 2060 bp, Oryza sativa
gcgtatggatagagtcgtaggaagacaattgtatctatcaattaggatatttcatgtaatttccttagagatatgtttgggcaaagtctgccgcaaagacatggtatcttagagttgttagagataagagtcatgtccgatatggacatattttgtaatctcgggtataaatagaccccgagccccatgtaatcaaacgaacacacgttcaatacaatctcggcgcatcgccacccttttactttcgttttgttcgacgatttcttactctcgggttgagctgcatcggtttcgatcttcaacaagaggtaaaacttattatggtggcttacgttctcgggattagtgcttccatctttatgatactctaatcttatttatgtaattcgtcgagttatcatatatcttacataatctccagcaatatcgctatctaaccttcaatcggctgacgtctgctactagaaggcagccgattaggttaaataccaacgttgacttagattatataggatatctaccactttatgaaacatccaacgtcttgattgtctagatattgtccatcttttcatacttatagttgcatcagttgagtttgatcttatgagtcgtgattagaatctcaatctctagcctgtctttggttgccgattagggtagcatcggggtttcagccgatcttatctgatttaactacatttatcttatatgcttgattgatatgttaaatctaccttttatgttaagatcttgtcgcatttaaggtatattagactttctgtttggtatattctatttgtattaatatcttaatatagagtggtatcggagtattagccgatacatgctagatttatctgatcggctatgctataaacatatatagtcttgttgtagtatatatttcgatctaagtgatttataatgtctcggcatagtgaccgatctatctcaatcacttgatttaagtatatatcgacataagaattatatattgttaatatctacagccgatcgagtagatttagttctttcttacttattcatgaccgccaatcgattcacatatgacatcggcttaaagataaatgatatgtcatcggcaactagccgattggctatcatttatggatttaaccacggtttctttgtctttgtttcttgttgattgcaggatcaaatcaactggcacgctcatatatctgaaggcaagcttttggacctgcactggagttaagcatatctctcaggcttcgtgtttttacatcaacatgctgcctgatgttggcgccgcccggccgcctccacccagcgtcccctacagccggatctggacgaggggaggccacccggccatatgccgcctcccattgcaccgctgcccgcaacctcatgtgtggccgcggcccgccgtcagaggagggggtagggggaggagagggggatgggccggaggaaggggaggagaaaattagaggggagaaggagaggatgagatgggaggaggtgaggacgaggggatcgaataaggatgagctaggcagtgcgcgcaggctcgggaggatttttcgcaatttttttaatttaggtcccggctggtataaacaaccgggactaaagatccagcgttagtcatggttggtgttaccggccgggactaaagataatagtggtctgatatgtttttgaaccaggactaaaaatgatatttagtcctggttggtatcactaaccgggactaaaatcagaaaaacaaagtacctgtgggttttcacagcaggactaaagatattagtagtgtcagtttttactcaaatcggaactaatcaatacgctggatcatgtcatgttgacaggcccaaaccttcacctttgacaggtttggcaacgggttgtaacctacgacacgtcactgatgacaaagcaagaaatacaatttttgaattttaaacgcaacaaaaaaaacctcaaaaagatattttgaattttacaagccgtcctatatacatggttacacatcactacctacaaattcacaatttttcgcgtaatataga

SEQ ID NO: 88452 - DNA, 638 bp, Oryza sativa
cacttgcaattgcaacgtactaggagtactccacacacgaggatgatggggagtatgaacgctagtactactacgccgatgcttgagcttgccaatcagggtgggtccgtgcttgctggcgactgacaagggcgtgccctacactacagtcgagccggcggtacaccgcattgtagtactagtattgttgaacgcacactaggacgtgacgagtcgcgacaggacggggatttgtgtgtacagtagtgtttattgttaccagggagacgacgtcgcgggcggccatggcgaggatgtccgcgcaggagaccttgccggcgcagccggggagcgcctcgaccgccgccttggccttgttgatcgcctccaccgcgtccggcgacagcgtggcgtccgcgccgctgtggctctcgtcgtcgccgttcggcgccatcagcatcaccgacgcgtcacacccctgcaaacgcaaacgccgagaagatgaacacccaaaacgccgagagaccgagaccgagagagaggacgtaccctgacgaagcagtcgtggaagaagaggcggagggtgcccgggccgacggcgaagctctgctggaggtgctgcgagatgacggaccggacggtggactccgcgttggggc

SEQ ID NO: 88453 - DNA, 505 bp, Oryza sativa
gccatgcacgcacgactgacaccgacgtggacttgacttcgctgtcccggaattacttacgcatcccatttcacatccatatgattaatcgttgcaacaaatagtaaaaattacagttaattctactgtttcactgaactttgctttttttttttgctggtgtgttgcagggtgccgtgcgtgaagaagggcgggatcaggttcaccatcaacgggcactcctacttcaacctggttcttgtgaccaacgtggccggcccaggcgacgtgcagtccgtgtcgatcaaggggtccagcaccgggtggcagcccatgtcccgcaactggggccagaactggcagagcaactcctacctcgacggccagagcctctccttccaggtcgccgtcagcgacggccgcaccgtcaccagcaacaacgtcgtgccggccggctggcagttcggccagaccttcgagggcggccagttctgatcgagtactcggctaattccgtttttcagtt

SEQ ID NO: 88454 - DNA, 2271 bp, Oryza sativa
gtcgtggctctggccaccgcggcgtcggcgcagctgtcggcgacgttctacgacacgtcgtgccccagagccatgtccatcatcaagagcgccgtgaccgccgccgtgaacagcgaaccccgcatgggcgcgtcgctgctcaggctgcacttccatgactgttttgtccaagcaagttccacacataaccagcgcctttgttccattttgacttaaacgttactgcagtatatctctagtcaagcaacttgagtgatatttgaattgaactagaaaagttaaatatatattgtacatgtgtgcatgcagttagatgacatgttcagacaaataaccatatattgtacatgtgtgcatgcagttagatgacaattgacaagcaagacaaataaccatacattcttcctgtttgactaactgtacagggttgtgacgcgtctgttctgttgtcgggaaacgagcaggatgctcctccaaacaaggattctcttagaggctacggcgtcatcgacagcatcaaggcgcagatagaggccgtgtgcaatcagaccgtctcatgcgccgacatccttaccgtcgccgcccgtgactccgtcgtcgctgtaagatcactttccctgcatgcatagcctgcacgcttggtctcgaactctcctctcgatcgattcctgtatggttgtacgtgggaaacggatcctctaacgtgaacttcttcctaacgtgatcactaacagtaacaggtgagcccgtcagtggtggaactcatatatcagttatcacgttcctctggttttacgtcagatgatcccgatccatatatatgacattattaggcttcggcttttgtacttaaccaatggagtaataatcatatgaacgcgcatgcagctgggagggccaacgtggactgtcccgctggggagaagggactctacaggtgcaagcgcggcgctcgcgatcagcgacctccctccttttaccgctagcctccaagaactcgtagacgcattcgccaagaagggccttagagtaaccgacatggttgctctctcaggtaaagatccaccatatatgctcacaaaccatcaaaccaagcaagcttaattttctgcactcctatttcatgcgcgcacacgatcgggcaggcgcagtgctcaaccttcaggggcaggatctacaacgagaccaacatcgactcggccttcgcgacgcaacgccaggccaactgcccacggacatccggcgacatgaacctggcgccgctggacacgacgacggcgaacgcgttcgacaacgcctactacaccaacctgctgtcgaacaagggcctcctgcactcggaccaggtgctcttcaacaacggcagcacggacaacacggtgaggaacttcgcgtccaacgcggcggagttcagcagcgccttcgcgacggccatggtgaacatggggaacatcgcgcccaagacgggaacaaacggccagatcaggctcagctgctccaaggtgaactcgtaagcgagtaccctgcagacactgcagtaagtagtaacaacgtttgtagcagtatatgcagttatgcacgtataagacgatggagtgcgtgaaaaaataaggacccccacaaccactacgactgaatgaatagcaatgtgtacgtggagatgtggtacatgcagatttgccttgctctgtttcttgttccatctgtatgtgcatggaatacagaggacagaggggcatatgcatggcgtatatgtaacgaaatttctggtgcaaaggcacggaggattatactatactcatcttctaaatattattcctacaagctactagtattccacacgagagaccgagagacccatcagaagggatcagaatgcgtgtggctgggctgctgggtcatctccacatgagacattttttattgggccgtgaactttctcgttcgtaacatgtcggtgcttctatgaaaaagcccagtataactgggtcacgtcccattaaggaagtagctcattcacactagtactcctgtgtccaccgtcggatccgagtttcaaaaataaaagggaaaggtctgaacagatattaaatttttggttgaaatggaacataattttcaaaacaattcaaatacaagagcaggccatcacaaaatcagaagtacatgcaagcacacccttcaagaaatcagcagctaccacaggtgccatgcaaattcgtggcgatgactcgtgtcgtgtgtcgcttgaccacaccaggatcgatcgat

SEQ ID NO: 88455 - DNA, 589 bp, Oryza sativa
ctcgtttgccttcgagcgcccctagcttcggagcagtgcgacctacagcaccggtttcgcacggtacagttcagcccagagattagttcatttttgtttcagcttttgcacgaatatgtcaccatgttttaactgcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacaaggtactttactttttattaatactattaaatacatgtatgaaactgatggtccttgtccagtaggatttgcagccgggatcttcggtactggggcctcttcgtctcacgccggtaggactggtcctactagccagttctacgacgacgacttgcacggtgcacatcaccacgacgtactaggctcctctcagcttggaggagctccagaggcgcacactcaggagcagccagaggtcacacctgtacaggcaggacgggttggccgtgccgtacccccggaccgactcacgtactcccaggggca

SEQ ID NO: 88456 - DNA, 2205 bp, Oryza sativa
ctgtgcgtcatcttccttagtatgagtatcctcttagtgtgactgcagctcgccctcttcagttatatgctcttcttctccatcatgttcagtaagcttatcctactcttcttcagccagcttctcttcttcttcttcaagcgacatcatcgtcaggtggcacaggtggacgcctgacaatcccctctcctttgaaatggcttgtccacgagccattgctttaggaaactttgccttcagctcctccagatcttcccaggtggcttgttcagatgcagtacctgatcattgaattagcacttgcataatggttgaattattcttcctggtcaacctgtgatccagcacatgtaaaggatattgaggagtagaggagacataagataagtgagtttgcactggcttgtcaaatcccttggctggctttagcaatgagacatgaaaaagctgggtgaactctgcttccaacagggagaagaagcttgtaagcaactgtgccaatttttgagatgatctgatatggtccatagtacttgaaagctagtttgtgattagaacgaggggctactgagctttgcacataaggctgtagcttgaggtaaacccagtcacccactgcaaactccctgaaacttctctttttgtcagcaaagtatttcatttgttgttgtgctctattgagatgttgctgggccagttgttgtattgtggctctgtctttgagccaaacaaccaaatcaggaatggcacaatctctgaacccaatgttaaaatggcttggggggtagccatagaggatctcaaaaggtgtcttgttcagagaagaatgataagagcaattataccagaattcagtcaaatgtagccatgtggaccatttagtgggggcagaatgagtgaaacatctgagataaatttccaaatattgattgactctctcaatttgcccatctgactgaggatgatatgcagaagtaaagtgtagttttgtatcagacctgagaaaaagttgttcccacagaagactggtgaaaattttgtctttgtcagagacaatagtagtaggaagaccatgcaacttgaagatattagtcatgaatgctttagctaccataatagcagtaaaaggatggtggagtggaatgaaatgggcatatttggaatatctatccactaccaccagaatgctggtgtaagaatatgatcttggtagaccttcaataaagtccatggaaataacttaccaggcgcctgagggtacaggaagtggttgcaacaagccaggatacttggccctgtccggtttttcttgcaagcagatttgacacttctgcaattcttttaatcattttcttcatgccttggcaagcaaacagctgcttaatcctcctgtaagtaactgggaaaccagagtggcctcccactgggctggagtgcaattcagatataattttaagctgcaagggatagttagaaccaatccaaattctgttcttgtatttcaggagtccattctgcagagaatagtgttgtttggctgcagggttaagagttagagcagcaatcaactgagaagtaaaactgtcttgagtatacccttgttctacctcttgctgccaactgggtacacaagttgatacagcattaatttcttcttcagtgtcctgaaacttcctggacagggcattagctgcattgttggaactaccctttctgtagcaaatcttgtaactgaggccaagcaatttggtcaatgccctgtgttgccatggggtgtgcagtctttgatctgataaatgcatcaggctatgatgatcaatgagaatgacaaactccccatgctgcaaataggatctccagtgatctactgctaagagtatagccatgcactccttctcataagtcgatagccctctagttcttggacctaatgccttgcttagataagctatgggatgcccattttgagtcagcactgcaccaataccagaatcactggcgtcagtctccacagtgaagggtaattgaaaatttggtagggctaaaacaggtgcagaggagagtgccttcttgaggtcttgaaaagcttgttctgtctcagatgtccacttaaaagaaacatgcttcctgagtagctgagtaaggggtttagaaattaaaccaaaattcttcacaaatttgcggtaatatccagtgagtccaaga

SEQ ID NO: 88457 - DNA, 607 bp, Oryza sativa
tcagtacatgcaccaaacatgtccaaaagagagttgtaatagttctatatctatatataaaggtgcgggactgtgattaagagaccataccaacatggggctattagaggcttcgttgttagcatcaaattcagaaagaacatcaaaagcatgaagcttccaatctagagtttgagtaacaactactctcgtcacgcatacattcccgtgaacctgaaattgatgatgacaatttcaaattttatgaccaaagaacttccaacatacattgttttcgtgtgtcattacatgactttgcacaaataagaacatgcatttatattgactattgttcattatccgccattaacaaaataagagtaaaacatcatatcaacaaagttatacaagtacaaattctgaaatcaaatggtcaagaagaaatgacacagtataagctggctgattgtgatacttttctcatctggataaaaaagaatttggcatgtaaacaagaagatcctgacgataatttggttgtgcaatctaattccaagggtaacttatactaaatataaattgatatttttaaaattttaaaaatgagcaaattatgcccaccagaaat

SEQ ID NO: 88458 - DNA, 719 bp, Oryza sativa
actatagggcgaattcgagctcggtaccctcctatctgacaggcatgtgaggaagatgtaaccatttaaggatgggcagagtaggttgatccatggtggccatcggtctctcgtggtccactcacatgttgcatcatggcactgcgatgcaaagttcagttccatcttcccccgtgtacttggatggacaaatgctatttattcgccgaaagcttgcagagccatcaacagatcaactccctctagccccctggccggcaagaggcgtctccgccgtctagctccgtacgtacgtctccgatctttcagccggtgagctactaaaatcatttatgatctgcgtggttggttggcagtattgttgagactgcaacatcgacagagcgatctatcataagctcagcttaggctgtgttaaagagctccataagatgcttgttcttgaattgcttgtaaaaatttgcacccatgtgacgcatgcaccaccgacttcgaacatcgggccacttaactggaagtcccttctcatcccaaccgttctgcaagtagtcaatagcccgcaacatacccccatgaagaacatgtataaagcaaacgttgggcctcatacccaccactgcaatgtgcactctctctaggaaccagtaccagctttcaggggtctcactctctacaatgcaaaagccataagtagaaactggtttgttcccattacaccc

SEQ ID NO: 88459 - DNA, 604 bp, Oryza sativa
tgaataggcttcaatcgaaatcaaacacaagtactattcaaattaccaaaatattggtagggcatgtttttggtagcaatctaaataggcccttagtcttacgcatacaaaaaatcaccaccataattaaacattgtaatgataagatagataagaagtgccatcgatacacggtacaaatttgtcgatcccgacgaatcaagcatgcggtaacctatcggcaccttctaggtcggtcagaatgcattgcattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcaacaaaggatgtagccacctgccagcgatctctgcacccacactttggacgcttggaccatttaggtaaccctaatggattgttcctccagtct

SEQ ID NO: 88460 - DNA, 1051 bp, Oryza sativa
ccaaattcttcaccagtagtctctgcaggagcaggccccattctcgaagcgatggaaccggctcgcgtccctgacgagaaacgctctatttgtcaactccgagatcgtcttcagaaacgagtggcagtccccgcacacccgcaggttcttgatcaccacgatctcacttcccgcctccgtgttcagcaacccgaacgccaccgccagcttctcgctgtggaaccccaccaatggcacggccgccgcctccgctaccgccttctcagcgcgctcctcaaccacatcgccacccgtcttctccttcaccatccgctccagctcgaccacgagctcgtagatcctcctcgcctgcgggtgcgagtggtcgtcggccatgaacaggtggaccttccccttgtgctcgacgtagctacacccgggctccttcctgagcccgcgccgcctcatcgccgcccgcaccttcgccacgccgtcgagctgcccggcgtcggcgtagatgttcgccatgagcacgtagtaccccacgttggccggctcgaggctgacgacgcgctcgaaggcctcttctcccatctccacgttcttgtgtatcttgcaggctccgagcagcgcgccccagaccgcgccgtcggccgccatcggcatcgacgcgatgagctcccgtgcttcgtcgagacggccggctcgtccgaggaggtccaccatgcaggtgtagtgctccagtttgggccggaggcagtaatcgcgctccattgttgagaagtacttgcgcccttcgtcgtacatgccggcgtggctgcacgccgacagaaggccgaccatggccacgctgtccggcgcggttgcttccgacaccatcgtctcgaagaggtcgacggcgatgtcgccctgtccgtgcatgccgtacccgatgatcagcgtcgtccacgagacgacgctcctctcgggcatttcgtcgaacagctcctgcgcctgggccaagctgccgcagcgcgcgtggaagttgatgagcgcgttgcagagcggcaggttgtcgcggaagcccgggatt

SEQ ID NO: 88461 - DNA, 606 bp, Oryza sativa
agtgaatatttattttacctagttatatagtacattggttgatggtttttgaccttgtggtttaaactcttattcatatgttattttttttacaggccatgtacaatgacttctcaacctcaaacatccaaattgacaaagatttcactgcaaagctatcaggatatggatgtgttggattcaataccgaggaggaaatatcaaatgcatctgtggtaagttatgttttgaaaatattttagaagatatagttatcagagcccaactcatttgcctgatctctttctgtaaattcaagtagtgtgttttggcatggttaatactctgttcgtttgtatggattctgtgttgcacgccattgatattatttagtcccaaacatcctaatattttgatgtgtttttactttacttgtttgcattatatccatagtggtcaatgccattgtttaccgtggatgctattctttgttaggctgctgcaaacctctcagtggaaaccttggagaaaggtgtactgactcccaagagcaacgtatggtgctttggagttgtcctgctggagctaataacaggaaggaagaaccttgatgtccgttcctcaaaa

SEQ ID NO: 88462 - DNA, 693 bp, Oryza sativa
ttgtaagtctctgtcatacaagaaatctgacctaattgtgggaaccagaccccaacgaccaatctcttcttctaacaatagaacactcagtatcaccaattctgaagataggagaggaactgatgcagctagggcaagagatgacaagttggcagctcttaaagcatataggagatctaaggggttgtgttttacttgtggtgaaagatggggaaaagaacataaatgtgccaccaccattcagttgcatgtagtagaagaacttctggaagctgtgtcagtagaagctgtgtttgaaactgatgatgaaaatgacaccaaggagacacttatggctatatctcagcaagctatgtgggggatagaatccagtaaatcaatcaaattaagggggtggattcagggttttgaattattgatgttaattgattctggcagcactcattcctttgtggatgctagcataggacagaagttatctgggctcaagcaacttgataatcctgttgctgttaagattgctgatggagggactatgcaatgtacacaggaaattcctaactgtaactggtggatgcaaggatacaatttcatcagcaatttcagattgctgtatttggggggttatgatattattctgggaatggactggctagaatcatacagtcccatgcacattgattgggtacacaa

SEQ ID NO: 88463 - DNA, 1518 bp, Oryza sativa
cctggaaaacctggcgggcaagggaggcgccgccgccgccgccgcgcgcgtagacagacacgaggcagttggccacggaagtgttcgcggcgagccccgatcgcgccgcgagggcgtggagctgcggcacgatgcccaggggagcaacggggacgagcgccagcagcgtgacggcgtcgaagcggacgccggcggccacgcgcatgcggcggaagagggagaagcagccggccgggaccccgtggagcgcgcacccggagatgagggagttgaacgcggtgcgcgccgtggcgggcggcgtggacgcgaggggcaattcgtcgaggagctggcgggcgagcgggaggaggcggaggcgggagtaggaggagagcagcgcggagaggaggtaggcgtcggaggacgggaggaggccgcgcttggccgcgagcgcgtgtatctgggcgacgcccgaggcgagatgcagcttggcgcaggagatcaccgccgccgggagcgccagggcgtgcggcggcggcgaggggtcgccgtggcggaggagggcaagggcctccctgtgccggccgaggcgcgtcagggtgcgcacccgcgcgctccatggctcgagggagtcgtcgccgccggcgacggcggcgggggaggctggtgcggaggtggaaggctcggtggccattgccgcccaagagagcgagacgcagacgccacgggtccgcgaccttggagaagcaggcgcgcttgcgcgggcccaacgaatcacatttcggcccaattaaaattaccgcaaccccgtgcctcactttcgtcaaattcctggcccatttggcagagaatgacacaacaacaacccgatccttgattgttctgaatagatatggtagattatctgattattatgtgtgacattgaagtataagcaaattaattaaatactattacaaagtaaaaagcctgtttcaaaatgttttctaagaacttatatatacacacgaacgtactttaggtgatttaggaacttgggaagcatatgctcctgatgatctataatagtatgtacatggtgaaatgtgatagggttaactggatctgcgccaaatgtgatagagagtacagctgtacattttgaaccaacacaaaaaatcgccatgttaacaccatacaattgtatgaatcaaacaaacacactgaaacacacacaaaaagaatgaagaatcgtttacaatttttacaatgcaattgtgtatcaaaattgcaatgccatctgataaaaaggacagggaattaaaaaaaaaatcaaatcaaaagaatgctcagctcagtgttgctctccgtaccgccggctccggaaaaccgagctcaccgtgctgtacccgagcatgcggtggagcggcccttcggccggcgacgccggccatcgctggtcgccgctcaagttgctcctcgcggacgcgtgctcctcccccgcgtcgtcgtcatccagccggcgaacggcgggctgcggcgcggagaatatcttcttgg

SEQ ID NO: 88464 - DNA, 3310 bp, Oryza sativa
gccggaaaaggaaaggagcggccggattggaaagcgggggcggcggcgactaaactagggtttcggccggaggaggacgacgatcccgacaggtgggacccacctgtcagcgaccgaacgcgcgcgcgcgcggctgcggactgggccggctgggccgaggagagagagaagggttttgggccgactttcggcccaaagccaaaagaagactttttaaaacctttttcaatttaaattatttcttaaatgcaattccatttattaaaaatactttcttagctcaaataaatcccagaaaaatctaggaattatagaattaagcaaagtatttaatgaaattttatctggccccattttatattggaatttattaattaaacttagatcttctcttcaagacttttaaaataaattctagaaattccaattaaacaacaatttatatattttgaattttcagggtgtgacaaacctacccccttaaacagaatctcgtcctcgagattcggaagaactggcgaacagatgcggatgagctgacttcaattcatcttctcgttcccaagttgactcttcttccgagtgattactccactggactttgcaaaaacggaaaactcgattcctggttcttctctcatttgtttccaagatacggattggtttttcaacataggtcagatcctcttggacttctatctgttcaagattagcttcttcggtaggtacccttaaacacttcttcaattgcgacacatggaacacattatggactcctgccaaagattgaggtaactccaactgataagcaacctctcctcttctactgacaatcttataaggtcccacaaaacgcggtgccaattttcctttggtgtggaaacgatgaacacctcgaaaaggcgtgacacgaagatacacgtaatctccttcttcaaaactcaaatctctacggcgattatcggcataactcttatgacgagattgagccactcgcaatctttcttgaatgatctttaccttttcttctgcttcccttaggatatccgtcccgaaaatctgacgttctcccgtttgatcccacaaaagcggagtgcggcacttccgaccatacagtgcttcgtaaggagccatctgaagactagcttgataactgttattgtacgaaaattctgcatagggtaaattcttatcccaacttccaccgaagtctaaagcacaagctctcaacatgtcttccaaaatctgattcaccctttcggtttgtccgtctatctgcggatgataagcagtactaaaattcagcttagaacccatctcttcctgaagtttcttccaaaaatttgaagtaaactaactgcctcgatcagacactatcttcttaggaacgccatgcaaacacacaatccttgccatatacaattccgccaagcgacttccagaataggttgtttttaccggaataaaatgagccactttggtaagtctgtcgactatcacccaaatagaatcatggcctgatgatgttctgggtaaaccagtgataaaatccataccaatttcttcccatttccattcaggaatcttcaaaggctgcaacaaaccggcaggtttctgatgttctgccttgactcgctgacaaacatcacatactgctacgtattctgcgatttcacgcttcatacttgcccaccaaaatctttccttgagatcctggtacatcttagtactaccagggtgaatggagtataaagtatcatgagcttctttcagaattgcatcttttaaatctttgttgtcggggacacaaattctctcacccaaccatacagttccttgctcatcttccaagaaaccgatagcttttcctcttctcatattcttcttgatctattgaatatcaggatcattaatttgggcttctctaacttgatcaattagagtgggcttcgcttctaaggctgcaacgaaacctctactgacaattcccaaatttaatctttcaaattccttgcataattccaatggcaactgtcgtccgtctgtagcattgcaatagccttttctgctaagagcgtctgctacaacattagcctttcctgggtgataatgaattcccatgtcataatccttaattaattccaaccatctccgttgtctcatgttcagatccggctgagtaaagatatactttaaactcttgtgatcggtgtacacctctgtacgagtaccgaaaagataatgacgccaaattttcaacgcatgaactactgcagctaactcaagatcatgagtagggtagttcttctcatgcggacgtaactgacgagatgcataggcaaccaccttcccatcttgcatcagaacacaacctaacccaagtttggatgcatcgcaatacacctggaaacccttctttggatcaggtaaaatcaaaataggagctgatattaagcgactcttcaactcttgaaaactctgctcacattcttccgaccacttgtacttcacatctttctgaagcaatcgtgtcatgggcttagcaatcttagagaaattctctataaaccttcgataatatcctgcgaggcctaggaaactgcgaatctctgaaactgtctttggttgcttccaattagttacggattccacattactaggatcgacggcaactcctcctgctgagatgacgtgaccaaggaatttcacttcagacaaccaaaattcacacttgctaaacttagcatacagttgatgttctcgtagcttctccaatgcaaggcgaagatgttcttcatgctcttctttggttcgagagtagataagaatatcatcaataaagaccaccacaaacttgtctaggtattccataaacaccttattcatcaaattcatgaagaaagcaggggcattggtaagtccaaaagacataacagtacattcgaacaacccatacctagtggtaaaagctgtcttagatatatcttcctctttgattctcaactggtgataccctgatcgaagatctatcttggagaaaacagtggcacctttaagctgatcaaacaaatcatcaattctgggtagcggatacttattcttgatagtcacatcatttaatgcacgataatccacacacattctctgggtatggtctttcttttccacaaaaataactggagctccccatggtgacgaacttggtctgatgtatcctttctgtagcaaatcatctacttgcctcttgacttctgccaactcattggctgccattctataaggtctcttatggatcggagttgggctgcag

SEQ ID NO: 88465 - DNA, 997 bp, Oryza sativa
cataggatggacgattcacagggagtgtttaaagagatcattgacaaggacgttgttgcttacacttcgatgatcactggttattcagaaattgtggattcagttgcatggaatgcatttgatattgccattgatatgctgcagggcaacttggaagtaaaccgtgtgactatgataagcttactgcaaatagctgggaatttgggagcacttaaagagggcaaatcactccattgctattccataaggagagcacttgttgtctcagattatattctagagacctgcattgtgaacttgtatactcgatgtggagcttatcaatcagcagttgctactttacagaattcaaagggaactgcagcttcatggaatgctatgctttctggtcttactagagctggacagagttttgatgcaatccactatttgtctgtgatgctgcatgagcataaaataactccagattctgtcaccttcgcaaacgtgatttctgcttgtgttgaggtatgctatttcggctatgctgctagtattcatacctacttaataagaagatatatacctctggatgttgttttggcgactgctcttgttaaggtgtactccaaatgcaaaaaaatcacgatatcaagacatctctttaatcaactgattgttaaagatgcagtctcctataatgcaatgatgtacggttacctacataacggcatggccaatgaggccacctccttactcaattacatgatggcagaaggtattgttccagattttgcaactgttcttagtctgcttgctgcttttgctgatcaaagagatttagtgagagggaggtggatccatggatttgggattaggcatgggttttgttcggatggtgacgttgaaaatcatattctttatatgtactcagtttgcggaaaacctgcagcagcaagggttatatttgatttactggaacagaaaagcttggtttcatggacagggctgcaggaat

SEQ ID NO: 88466 - DNA, 597 bp, Oryza sativa
atgacgaaatccaccaatcatgaagatgaggaagatagtcggcgacgacaaacgtaaccgacagtaatgatgataagcatcaacagagatgatcaaatatgatgacgaagttgcctatcaatagcagtagagtaagctatataaagagggttgaccggatggtgatgaaaaagaccatggcggggatccaatcaatagcgggggaatagccgatgattatgaccaaaacccttattcccgtttggatagtagggcaaccgtgaagggggaataacaaggtggcgaagtcttaatcattcattaacaacgggggaatggcagaaccgatgaaacaaatgtgctggtgaccaaggcagtgaccataattcattaaactggtggagatgcttcacttggaggaaaggatatgctggtggtcaacttattggatctgatatgagttgattgggtgatgacttccaacttccagacatgtaaatttaatcttgacctactggtttgaagcgaagacaaaattgatgacttccaaaggtgacttggtggctgaataaatgaatggttcattttggcataaagcttggcaaattttgaaccctg

SEQ ID NO: 88467 - DNA, 621 bp, Oryza sativa
atgcctgtatactcctctacagcccatccgccgcctactctttattatcattgagattctaaaaatcgaacatatctatcattggaattcattttttattttctagaagtcttgccaaccattagtggctctgcaactacactcctatacaccccacgctctgtttctcctttttattgtcattaagaatttaaaaatcaattataattatcaatgggatttatttttttactttctagaagttccagcaaccgccttgcccgtcagctttacggcctgcctgtcgttcctcattttaatcgtcattaggattctatttgatgttttattaacagtttttatatgttgtatcaaccgccaccacactactcctttataggcctgttacttattttatctcatcatgtgttttagatggtctttttttttcaatagtctatttcttatcaccaattttagttatttataaattgtattcctaattgaaatctattttatttttctaatttcagaatttattttttatttttgaatttaagttgtttcaaaattgtattcctacttgaactctcttttaatttttttactttctagaagttccagcaaccgtcttgcccgtca

SEQ ID NO: 88468 - DNA, 5669 bp, Oryza sativa
aaaaaaaaccagccaaatgcttctttccagctgggcaaattgcatttcgccccttgccgctctctgtaagggcggcaaggaccaaagcgcaaaatgcgcacacggcgccgtcgagccgtcgtctgccatgtcagcttgccgccctccactagagcggcagggtctatttttgtaaatttttacgatgatagattatttctctaaatattttttttaaaaaaattaaaattgaaaaaaattcacgactcgtgctcgagagcagcaaaaaggcccaaggagataaaagaggagcacacacgtgttctcctcacatcagtttcggcccatacgagttggttttgggcctgattgttctcacagttcatattgccttctcaatataaattcatgtgtccacgtagacgtgacaacgaacatcgacacacaggagtagggtattacacctctggatgacttgaacctatataaattcatgtgtccctctctacgcgaggtggtcgggcctggtgaaccttctctgattacagtttgtccgtacctcactgcaaaccctctggtcagatctttactctcggggaggggtctccactcctatggtccccggtaccttgcaaatgcagatgctcacgacgggtgcatactcacccctataaactcacattcacatgcataaacagtaaatatgagcacgagtgcaagtctaggatttaaaatcggatggattggtttcactaaaaaaaaactaattagttaagctagttaagctaagttcactttgctaaaagtggtttgttgaaggcttgatattaatgattttttttcaagtctaaccatgatttagacagctgtatgtctggaaaaatgggtttgatttgtaagggagatggacaagtggtttccctgctaagctgtccatctcatgtgtgaatcacatgcatgtccacatggattgtggtatccacaacttttacagttggtcgtttcagtgcgtgcatccacaagctcgcaatgtgagatgagatctgaaagcttaattggcatgttggataattacaagagaaattgaaacccctgatttcaagtttcaaccggttgcaaggtaatttaattagttatgttcctcgaagaagagattaagagtgtgcgtggaatctcaaaatattatttcagagaaaattaacataattatcagtacggattcatactccgtaattctgtatggattattagcatgaaaatataaattgcacaccgtcacgttgatttagtacctgcaaggatgtctggtggctggagggagagaatatacccacacccactattcatatttcacttttaatcacttgttttaatttcaaaaaaatataataaatatttaaaaaggcacataaacataaagttcccctctccgaatctaaccatttaataccaattatttgagaatggaagttggaatatatattactccatccgtttcaggttataagtcgttttgactttggtcaaactcaaagtcaaactgttttaaatttaactaagtttatagaaaaaagtagtaacaattttaacccaaaataaatttgttatgaatatatattcaattattaatttgatgaaactaatttagtattataaatattactatattttcctataaacttagttaaacttaaaacaatttgacttttaccaaagttaaaacgccttataatctgaaacagagggagtacgaaacactgagcgtattaaatttttttacaaactttttataaacactggtgtgtcacagtgtcgttgaatctggttgaatctcgactttttataacttccagttaaagatttttgttaataaaaagttggtaagaattatttttagtacgtgtagtgaggagcatttcttgccacctttattcgattccaccacttgacacatccatcgatcactcctccccctaccaacgatcagctcagcttcagcttctcctcggcatgtccgccgccgccgccatcgcgtcgccgatcccggcggcgatcgccgtcgtgcagcagcagaggcgggggaggagccgcggcggcggctccggcgctgccgccgtccgctgctccgcggtggccccgacgtccgcgatcgcgcccatccttgccgacctgaggctgcggtgcgccgccccgctccccgtgctgcggcgcgtggcggacgccatggcctccgggatgcgcgccgggctggccgacgacggcgccggcgagctcaagatgatccccagccacgtctactcactccccactgggtaaccaacctacttaaacagttaaacatacacttaactagctctaattacagattagctagctggtgttgctaatacatcgtcagctactgcaggcaatgttaatgcatcagcagttcataaagttattgttactttgttagtggatcatgtggtattttaattgttcagctggatctttgtgtgaactgaacttctgaactgcaacacagtgggcttgtgaatttctgattattttttcttttttgtattgtgtttagagtggagattgatcagctagtatatctttgcaacttgagctcaggaaattaatcttggttaattatttatctggttaattttgtgtttcatgattgttgtgctgaaggaatgaaacaggactgttttatgctctggaccttggaggcaccaactttagagtgctgagggtacaattgggaggaaaagataagcgcattatagataccgagtttgagcaagtctcgatcccaagagaaatcatgcatggtataaccgaggtttgttaatttttcacaagctgtgttcttctgagcttactctattatgtagtctgtgaaatgtgatgcattcatcagaatagctgcagggacatgtatatctgaatgcctgacaacattgttgtgtcaaagcaggatttgtttgatttcatcgcgagtggcctgtcgagatttgtagcaacggagggtgataagtttcatttgccacaagggagaaagagagagttaggcttcacattctcctttccggtgaatcagacttctattgattctggcattctgatcaagtggacaaaaggttttgctgtctctggaactgtaagactttatttcataatgcattttttatgtatagtttccatgattctttgattcatgatgtatggcactacaaattcttatcttgtcccgtttttatcctagtaggatatcctgtatatgacattttccatattggtctgaaactcatccgttctagaattcacgagaaaaaaaaactgattcatttgtagaatttctgatgccaagagttacaagttacaacagtgaaaaatcccttctagaacaaagaacactacttttactcactttccagatgatggtttatgaattagcaagttagtttctttgtcagttaaatctttgttttggacaggctgggaaagatgttgttgcttgtctgaatgctgcaatggagaggcaaggccttgatatgcgtgtctctgccttggtaagcaaaaagcctatgagaataccatggttatgggctagaaatgttcgtggaaagatatcctcttcacaatacatttataaccaaactattggaattccacttaacaggtaaatgatactgtgggaaccttagctggagcacgttattgggacgatgacgtaatggtcgcggtgattttgggcactggcaccaatgcatgctacattcaacgaactgaagctattccaaaattgcaacaccttaagcttgaaacaggaaacacggtatgccataacatagacaaattctctattaagttattgcaaatggaaagtgttacgaagttaaggaatttttcttgatggaagtctctgtactgcagattattaacactgagtggggagctttctcagatggacttccattgactgaatttgacagagaaatggatgatgagagcataaatcctggtgaacaggtgaaaaaaaatgctttcaatttttattttctaagataagcagaggaaggtcctactgtgcatactatatactgacaaaagtaaaacatagtttacttatatagaagaacgacagagtctcagggaaaggaggaaacatagtagaaaatttaagcaagattatttagccagtcttgactctgagggatatatttcttcttgctcttgaaaacataatcttgatatcctggtgtgcttgcaaattgcaatatgcgcagatattcgagaagacgatttccgggatgtatctaggtgaaattgtccgtagggtgctggtcaagatggctgaagtatctgatctctttggtcattccttccccaagaaacttgctgaaccatttgttctaaggtcagttctcatgctctagcatcacaattaaattaaagtattatgctaaggtgaaaaactccaaattacaggacaccacatctatgcgctatgcaacaagacacctctgacaatcttggagaagttgagtccatcttgagtgatgtcatcggcgtaagatacttactcctcatgtttcagtcacatcacaaagggcatctagctagcacatccaaacatgcaaaatttacccccaaaattcacatccacaggtgtcccaagcttctctgctggcacggagagtcactgtagaagtctccgactgcatcatcaggagaggaggccggttggccggggcaggaatcgtagggatccttgagaagatggagaatgactccagagggcacattttcggacgaagaacagtggtcgcgatggacggtggtctatatgagaagtaccctcagtacaggaggtacatgaaggaggctgtggctgagctactgggacccgagcgatcgaatcgtatcgccatcgagcacacgaaagacggatcagggatcggcgctgcgctgttggcagctgcaaactcaaagtatgctgctgctcaaatctctacaaggtgatcgcaattgttataattgttgagttactgggccgaattaattctctacaaggtgatctcaattgttatcattgttgagctactgggacctgaacaatccaagcatatcatcatatggtggcctcttatctgaagtatggaggggcttcatatatgctattcttctgtactactagtctactatactatataacgcatttgaggaaaagaaacaccagaaatttatcaacttatgttttgtataattcatcaacttatgtgtttgtatagttacagttcaccagaaattcatcagcttatgtatttgtatagttaaagtttatcctcaattttgtgtggcctgatgtttcattgcttagctggattgtatattttgcaaatttctccaaaacatcttaccgctgagactagcaattgcccgagttgttaatgcttgctcaggagcaattttgcagcattcaggcatttgcaggattttttttaaaaaaaatacaacttatggcacaatgccaccacaaatgctaaatttgacctcacctgcaagatttaaaatccagtggtctgaattctaacacctgagttcaaaacaagattggctgtcctttacccttctcgttttcaagtcaattgatcgataaagtattatggagcaaaactaagattaactgtatcttcctg

SEQ ID NO: 88469 - DNA, 1232 bp, Oryza sativa
ccatccctcttgtttatagacctcgacttttgatgtgcggtggtgtgagtgttggactggtagggcccctcatcctcttttacatagatatatcaccattttgtgtcctttcatatcattaatgtattttacgcttagcaggatcatgttgggccagctgttttgcacgaacttgagaaattttctgttcactccttggggttgccgtctcttctgtctgatccaagtgcaaagacacctgaagaagctcttgtgcacatttttggggaagctaggagaacaaccccgtcaatactgtacttgcctcagtttcatctttggtgggatacggttagtaagctccaagctgtatataatttagtgttgaaatgattgttggtaaatattgaataattgattatattcttcatctttgatgtaacaggcacatgaacagcttagggctgtgctattgactttgttgaatgagctgccatccaaccttccagttttgttgctaggaacctcgtcagtggcctttggtgaccttgaagaagagtgtgcttccatattttcttctcgtaatgtgtaagttcctggtcagatgctgttttgcttgacttggttcttctcaattgccaaggtctaaattatcctccaatattggtcttgtctttcattgagaaaatctgtttgtttgatagatatgaagtggatcaaccaagtgatgatgatagaatgagatacctgcatgcactgtttgagtcattgctctcatttcaaatggaagagtctaggagtaagtctaaagaccagaagtcttctgttgatcttcccaaagcaccaaaggaagtggatggtcccaaactttcagagctaaaagcgaaggcagaagccgaacaacatgctgttcgacggatgagaatgtgtcttcgagatatttgtaaccggtctgcaattcactcctttgttgagttccatatatgttcaaattttgtttctctgttctcaccattcattgctgttagcactgtggttagtttttacagttctgctaaagaacagtatagtttcatttatattctacaaaaacaccgcctagtttacacccatgaccatttttagcctatgcctatctatgctattcccgtctcagctccatatttattcagttgaaggaatgttccagatggggatttggttgcgttctaaaaatcaggagtatgcatttgcttgataaagcttgcatgcct

SEQ ID NO: 88470 - DNA, 2041 bp, Oryza sativa
aacaacaaaaacaacgacggcggcggaggcggatgcgacggcggcgagcaccagaaggggaagtcgtggaggaggtggcagtacaggagatgcggcggcggtggcggtggcgggggcgggaggaagaacgccatcctcggggacgcggccgacgtgaagacggcggcggggttcgcggagaggtacaggctgggggcggagctggggcgcggggagttcggggtgacgcggcggtgctccgacgcggccaccggggaggccctggcctgcaagacgatccgccggaagcggctgcgccggtgccgcggcgacgccgaggacgtgcggcgggaggtggagatcctccgccgcatctccgccctcggcgccggcgccgactccgtggtgcgactccgcgacgcctgcgaggactccgacggcgtccacctcgtcatggagctctgcgagggcggcgagctcttcgaccgcatcttgcccgcggccactacaccgagcgcgccgccgccagctcgcccgcaccatcgtcggcgtcgtccaggcacctccttaaccccccacccgccattgccattgcatcgaatgctctgccattgattcttgcatcctgttcaaccatcaacatcgccattgattcttgcatcctgttcaaccatcaacgtcacttggtgtagtgcatgaatcaatgcatgttgcatgcagctgtgccacgagaacggggtgatgcacagagacctgaagccggagaacttcctgttcgccaacaagtcggaggactcacctctcaaggccatcgatttcggcctctcggtgttcttcaagccaggtaggaaggaactcactactcaacaacacaattatactatgtgatcacgcactggacatgcagcaaagaacgcaaagaaaatcaaatccgaacgaacttaagtctcaaatctcaattacctggctcttggctgcaggagaaagattcacccaggtggttgggagcacatactacatggcaccagaggttctcaacagaagctatggcccagaagcagatgtctggagcgccggcgtcatcctctacatcctgctctgcggagttcctcctttctggggaggtgaatcgaaccatccatgctttctctgcttgttcttcaccacaatagctagcagaatgtgttagataaaaggatacttctctgataattactggtgctgatcgatcgctgatgcctcctcctttgccaacgatgtgcagacaatgatgagaaaacggtgacggcgatactccagggtgggatcaacttccagagggagccatggcccaaggtgtccccgcatgcaaaggaccttgtcagcaagatgcttgaccccgatccttctacccggttgacagcaaaggaagtccttgtaaaaacaaccttcatccagttcagattcttttttttaaaaaaacgaatctcattcagttcaaattcaagttcatagccatatcgaaatctagaattttgccatgtctttgacattattgcaaaaagggggaagtttaataatgtacagtaagtagtgttacattacatgctcagttgagattgtttctcctcctgcaaaaaacagagcatccttggctcaagaatgccgatagggctccaaacgtttcgctcggagagattgttcgatccagactgatgcaattctcagccatgaataagttcaaaaagaaggcacttggagtaagttgcagagaacctgctgctactattcttattttcttcaaatgtggtgtacttcttcactgtgaagcatttgccgatgaaggtcgttgccaagaatttaccggtggaggagatggataaatatactcagatgttccacaagatggacaaagacaacagcggtaatttgacgcttgaggatctgaagttgggcctccagataaatggtcatcctgttccagagacagagatcgaaatgctgttagaagctgtgagtgctttattatatccattcccatagcactatatttcgttattcttttataatttagagtttagaa

SEQ ID NO: 88471 - DNA, 501 bp, Oryza sativa
agtgtcctgaccagcccatctctccccgtcaaaaatttaaatacacggccattgtacttttcatctttgtgactgccagccaagttctattgtatgggatccaacaccaacctcgaaccattgagcctgatccattacattggctgcatctgattctggcgtcaagccgtagtactctcttgtcgcacgggatcgtcgctattctagtacctgaggttctggtgaagatctgggtgtacctaaagatcataactctcgataccagtgcacctgaaactggtgttcttatgtaagtgctgattctgctcacctccaattaatctaacggcaatattgcatatggagagatggaatggtgacagtcgatctgctatgctttgatcggtttcataaagaaatgaatattcttttgggtggtgaaattttgtaaacaacaaattgcaatttttgtttgctaattggggcctttatttatgaaattcaggaatagagcacaaaggt

SEQ ID NO: 88472 - DNA, 590 bp, Oryza sativa
aggaaagaacaatgcaggttgcagcagagaaggggaaatcataccaatgtcgcactccgtcccaatggcgaggaccgtggccaggtacttggtgtcggagccgcgcttcttaagcttgacctgggtgtagtgctccacggagtgggcgtttgtgaggacgcccggcctccgatgatgaagccgctgctgctggagctgtactgccgcttcctctgccacggcagggagaagttgggctccgtgtgcacgcagaacaccttcaccacggcgtccatggacggcaccaccctcgcgacctcgtcccagcccacgggtccccccgcctccaccaccgcgtcccctcctccattcgccacgggcttcgcctccccgcggcggggcggggacggcggccgcgacccgtccgcgtcggccggggcctcgtggcgccgcgacttgcggccccggcggcccgcggcggccggcgcggggttgtcggcggcggtggaggccacgggggacgcgggcgcgtggttttcggcggccgccttgtgcttgcggccgcgcttgcgcttgcccttggaggtggaggagggatcgtccatggaggc

SEQ ID NO: 88473 - DNA, 782 bp, Oryza sativa
cgatcgatacacctctccgtgggttgttgatcttgccggtgcagatcaaccttattcctgcaagcaaatcgaagaaacaagcaagaacaagatagaagcaatctgaattgcaaataggaatgaatacacaagataagttggggttccgaagaacaagcagatggacggtctagccgacacgcgcgctgcaaggaagtagcaatggctaaactttcatctaaacaaaacccaagaaactctaaaggggtacctaactatttaaggaggtgggaggacgacctaaggggaccctagggtcgtgctccacctggttggggcgcaccccacatgggccccacttgggccggggttccagacgaagttacaagcccataggcccattataggtgacgcagcaccttctttttgtgatttcggccgactgggatggaatttggcgatgaagctggatccattggaaagatgactctgagagctttccatcaagtactcatggacctaaaatggagctcgcatgcatatttggtggccgtttgaagttgacactgtagcaggtggccgaactagattgcagaacttggacggcttgatcttgatgtggacgacggttgtatctatagtagccatggtcacatcatcagtcggtgttgagtgtggctgggcccgacgtcgaggttactcaatgaagcttgggcagcctgtgtggtcgtcggatggcgccgtcagtcttgctccgccgctcggtggagtccggtcattgtgcagatggtgtgaatagtgca

SEQ ID NO: 88474 - DNA, 683 bp, Oryza sativa
ctactacctctcctcttctctcctccatcgtcgttggcatttatccgtgacgtttgatcattttttttattattagaaagaattatgtacatataatttattttgttgtgatttttcattagtaaatatttgaatataacatgttttcatagttacgattgtcagggttatggataccacatatctaatagtagttaactaaatctcggcaggatccactacataccatgtcttatacggaaactgacctcgagggagttccggataaggaaagacaaccagagttctacatggaaacgacaaggactactcggattgtatccatattggtttctctagttctacttggacaagtggacacctatgggtataaatacaggccccctacgaggagaagggggacaagacaatcaacacccaacgggatcaacacccgacacgatcaacacccaacacaatcaacaaagaagcctacatacgccaagacacgccgccggatatcgacttcaggaataagcacggctagtaccctacggtgtctccggatactgtcaggagagatgaaagcgctatctctgacctcgctgggcacggattcgaggaggaaggctaccctgttgtcgactacgagtcagatcgtcagaccgccatgtcgacaacagttagataggctaccccaaata

SEQ ID NO: 88475 - DNA, 957 bp, Oryza sativa
ttttcatgtgactaaaaagcgcagtaaagaatggcttgtttgtgtcatggctatatttcagctggcagttgctgtgcagtgggctaaacaatggatgccaagcacactccagagcaaatagacacttctcaacagcatctgctgacgattgatgttctccagaatatttgaaaagttcagcaaatgttaacaatgattctgggtgataagggtactttgctaatatagctgcaatagcattgagatcatttgcagatttggcaacttcaaacaagtcttgcacatgactgacagaaggatcatatatgtacctgcacgacatgaagagtttgattatagagaaagttaaggaaaagcacaggcccattgggagttaattctgaaatcttacatcaccttaaagtttagaaaaaaatatactgagaaataagattgtgaggaaaagcagtacagtgaacacaatatacaatataactaatggtcatagttgtaagctgtaaccaaacaaaatagtgatgtgcagagatgataaacagggatacatgatgcacaaaaaatacgaaatggcctcacctgaaatagttgaaaccactctttgtctccacaatatccattgacattgatttatcccatggtggccagtagctagatggagtaacaagaagggtttttcttggattgtgggcaacgcgcctaacacctcgtagccttgatgttgaactgctaggcacattccgttgattttcaagtgaatccactacttttgatccaaaaatgcgcctcatctcattttcagcttttagatgtttgggatcaattgagagaatagatgatgtcccaggagtggtttcatctatctcaatctccttcccagatgctctttcattttgattaactctttgctgcatgggcttcttttcaatagataaatcttccagaattgaatccagtgacttt

SEQ ID NO: 88476 - DNA, 3094 bp, Oryza sativa
attcctgcagcccttccacttgccatattcttccaaggcttctatattgtactgcctgtcaggacacggcgtaattttcaagcctactgccacatcaagctctcacatttcttgtatgggcctgttgtcttgcaccgtttactgctcccacttccttatgttgcctcaaaggtgcttgcctacactattacactttataatgtgatactactaacactgctgaggcttcctatgtaaaacatgctaactctgttttttgggttgcaggtgctgtacaagaaatacagtggaaacacactagtgaatttgcttggcaagtgggatggattgaaccattttggacagtctatccctgttggagggatagtgtactacctaagaacgccccctatgtgagtgcacatacttgtggaaattatattgcccacatttctgatttcaatttaaaagtatgacttgatacctaagtcctaagtgttgcctttttttttgctttgccttatgtttcccttttctctcctgcagcttggctgatttgcacagggacccgttccatgcatttatatatgtcgcattcgtgcttatttcatgtgtgtttatctcaatgggtcttatggtctgtgcatcttcaaaaggagttttcaacgggtttgttgtgttaaatgtatgtatgaaaagaaactctgcgcagcattgttgttttaccctcttcccctgttacatattagcaagttaatccgtttactttgattgattcaatgcagatgcaggaggaacgaagactgaggcttgcccagcccgactcaatacatgcgaacgaaattcggcgtcatgtcatgagggcagcttgtgttggtggtttctgtgccggtgtactaataattttcgcagatctcattggggtgttttgttctgggactggaattatgcttgctgtgactgcttcatatccttatgttgatggcagagctagtgaggtcgggtcctttggcttctgactgatcgagatatctactcctaaataaagatgagatacagaaagcggctacttgtaacgagagttaaatccatggatatttatttattatgtagtctgcaagaagctaatttttttttctttttacaatgtatatatttgttatttgctgaaaaccggtgtttcagtgaaacacactaatctgttttggtcgcaacgatcagggttaacaattccgacgaaaaccggtcgaattctgcgaaatttcgaggtttcgacgaggctcgaaagtagaagccgttcgatgagtttaatccaaattcaaatttgaattgataaaaaaggaaaaaatcaaaaaaatcttataaacaatatgatattcatataatctattgggatataaattttcgaaaaaattgatgtattccgtatatttactgaaatttacagtagaaaagaaaagtaacgaattaaaaaaggaaaaaaaaatcagtttacctctttttctagttaccgattgaaatttcaatgatttcgcttggaattttgccaaagccgaccggttttcgtgagcttatcggtaaactcaggaaatttgttttcgcgggtttatgaaatttgttcgaaatctaccggttttccaccaaatttcatgaaaaccgtcattccgccagagcccgaaacagaaggccatctcggaatcgtaaacacgggcaacaatgttggaaatttggaactaatgaagtcaaggtcctgaaaaaatccccaacagctactgataaaccaatggaaatccccaacagagtcaggtcctaataaaaggtcctgaaaaaatccccaacagagtcaggtcctaataacaggtactgatagaccatactgatccaacacggtaataagtcctgaaaaattatccccaacagagtcaagtcctaataacagctactgatagaccatgctgatccagcgtaatccccaacatagtcaggtcctaagagcacccgccagatataggcccagatgggtaatatcatgcggagaccgagtcactgctcgtacggctggaactggatccttctcacctgataatgtaacacagaacattttagcatgcaaacactcaaaaagcattgcatgcgcaaacaacattcatttcggcttagaatttgcagagaattaacacttacccccaacgaggccgatgataagggccacccagaacacggcgaatacgctgccgacggcccatctgagtataccagatccggcgccggcgccgtgatccacctctacgaatccggcggcgtcgcgtgcagcaatatccacctgcatctgcgtgacgagctgattgaagcgaccatgcgcctctagctctctagcggcctcggggactcccccaaggaacgtataagtctctgcaagtacacgcttgatcagtgcactcggtggaagccgacagacaaatgtacaagatgtgattgcgaagacaatgttcaaagatctagatagttttatatacaccataaattacattaacaaatgagaaacattaatatctactaacacattaatttctgaaacatatatatagatactatgtgctagacaaaaaagcaagattaaattacttgcatgtaatgtttggcattgacactacagacttcgagtattgggaaataattgagctagatttcagaattctattattctattattgataaggaaaatgcacttgattctaacaaacgaaccacaagttctgcaaaacgcaacaaacatttaaccaaagatcacagaacaaaaaataaaaagaggggacaagaattatccttcttcgctgctaagaaatctggtgctgaaggaactaaagaaatttcctaaatctatcttgtaacttttttcctcatatatgatctttgaaattaacaaatcacaaattcacaaagatcagtgtgatttaagaattttcaactgtaaaagaataggagttaccagatggaatggggagacacagcaggatggctagcggaagaagataatgccatcgaaccatcgctgagcggcggcggcgggcgagtgcagggtacacggatcgcgctcggccaggctgcatccgga

SEQ ID NO: 88477 - DNA, 629 bp, Oryza sativa
agccatccgccgcggcggccgacgcctccggcctccttgagaggctcatctccgcgctgttttctaagatcaccgccaatccggagacgcccgtcgccgcgggggcagtcgggacgccgaaccgctcgtcgtcgtcgtgctcgtcgtcgccggacacgctcgggttcggccggtcgtcgtccaccaagacgcccgagtcgatgaagccgtgcttcgccagggagtggtggttcgacgacatgacgtcgctgtgcccgcagaccatcgagaaggcgatgagggtgctcggctgctacggcatcgagaacaagaacctgatcctgacgcggttcctgctgcactacctccgagccgccacgcgcaggccggcgctgtgcagggagggcggcggcggactcgccggactcggcgacacggccgtgcacggcgtggcgctcgtcggcggcaccgcgttctcgtgccggggcctcttctgggtgctccggatcgtgtcgtccgtggggctgagcaaggagtgcaggcacaaactggagaggctcatggggctgatgctggaccaggccacgctcgacgacctcctcgtctccggcgacgacggtggcgtgtacgacgtgaacctggtcatgcgg

SEQ ID NO: 88478 - DNA, 517 bp, Oryza sativa
tgcgcgcgtcgagccgcgtgttgatgctgtccagcacggcgccgctcatcggcacggcgaagtgcatctcgtacatcgccggcacgttcggcaggagcacggacacctgactcaatccagcttagcttagcaacacgaggaaggtgttcgacgaaatgaccgtggaaggaaaaaggatcgatggatgctcacgacgtcgccgcgggagatgccgagggaggagacgagcgcggaggcgaggcggaggcagcgccggtgggtctgcgaccacgtgaagacggtgtcgtggtagacgacggacgggcagtcgccgaacacggtggcggcgcgctccaggaagcccagcggcgtgagcgcgcacgagttggccgggttggcgccgagcttgtccatggccgccgcgtcgatcgccggagcacgagctgtcgcctgtgtgaacgccggtgactccagctatcgcggggtggttggagtggaggcgaggaaagagcgagtgaggaggctgcggtgatataaa

SEQ ID NO: 88479 - DNA, 830 bp, Oryza sativa
aatgcatagatgaaatcagtttgttagtccaattacatgaaagatatgctcacacatatacatctccctgcaaaaaaggctcaacagatggaggccaggaataaattcataaacttcacaacattcctgttgaagcacacctctgtgtgagtgaacgtgaacaccaggatttaaaccctagtgggtcaagtcttgcagtcacaactcaaccaacacacaaaaggtgcttccctagacgaaggtagtaactattactgaagttgagattctacagaaaatgctatctgaatttaccttcggtgattctttcattttaacactttttgctttgatgtcaacaataccggaatcaagctgtccttcacttcgtgcattctgaatgactatgtcaagtatacttgtgaaaagatcaaatagcctgataaatgaagtacacattaataaggtatcaactgaacaggtataaatataacaaaataaatttgttctaaaaaaaaacttgcctgttctgaatgtctggagccaagcctagaatgcgattgaggaaacggcctatgtcatgcagatcagaatcaaaaatcctaccagtaagctttcctccattttttccattgcctatgtgcacaataaacaaataataagatttgaattctacacttgaaactacatatagtagagcatcttgttctgcaagcatgacctgctgcatgcattttgcaaacatagttttcattcctaaaacattaatcagcacttcctttatcaaaaaaaaaaattgatcagcaataaatggataactgtatacaaaaagatgcataactctattactt

SEQ ID NO: 88480 - DNA, 3473 bp, Oryza sativa
tgcagctgctgatgtattggacgccatggctgacatgcacaacgacatcggaagctcctagcggaatgtgttgttgctgctacagattgagtccgccgtcattgttcacatttgtggacaccctcgccacatcaatggacttgagtagggacaacgcttcatccaccgtgattctgtttagtgtggtgtgccacggctccagcgcatcgtcctgccttaccctggtgagcttgggtttgatccggtggatgcgcatgcatggcggtgtcggcgaactactgatgatcatgttcgggggacgggggaggggtgatgagatgaacacgagtgaaggaaacggagaaagaaagggtaatttggtccaaattttctaataaatgcagtgaagggatatgtactttgtagtggcatatctcgaatttctgtagaattgtaatgacatggtttgaaatagttgaatagtaatggtatatttcaaaatcataaaatttataatggcatagatccaattaaccatatatatatagctatcttctcattctcccatgtcagggatggttatcattcgagaaattctcttctagtattcacattttgatgcaatggggtttacctatcactagcatgagtatggtgagtaaaaataaaacattttttgtgttttcacatttaaaatgttaacataatcttatacactgaccaatggaacctggtttgattttgcattctaaggttgcatctgatcatttaatttgaataaggctggatcattttgcgtattcttgaggtttatgtacacacacattctttattacttgaaagctatacaacgccagtgaaatcacagagagaaagtgagtcaaaatggcccttatgcctaatgcacctctaatttgtcaatactagtgtgtatcccggtaatattttgtggtttcttaagtagtagttagttatggttgcatggcttgcagcagatgagctatggtatttcttactaattcctgaagtacttattgatatctcctgtaaaatgtcacagcagagtcagaccatgaatcaacagagtctgaagaggaattcaatatgtgtcagatctgcaacactgaggaggtgatttgcaatgttccaataaatgcttcattgttttaaccttattgtgatgtgtttattttgactggaaattgtgtggtttaaattgggcctgacatttttacctgccatttttttactaaatcccaacacattataagaaataaaagcattaacattttattccttgttttgcttttgttgtctcaatgtcatcctccttttttttagacatggctgaatgatttaccttcataaattcattgttgtacttggggatagagtgctagaaacctacaggcctacacaacctacaaaaagattcttaccttttcatatgcacggatgcaccacagctactcctttcgcaactctttttgctggtttttataatacttcagttgaatgccattttaggagaagacgatgttgctccattgtactggttgcgccgcacatgttcaccctggttgtctgattcctccttggactggtatgctagcagatgattggtcatgttattcatgcaaggagaaagtagagagttacttcaaagagagagatgcttacataactgaactctccaagaggtgcctaatatatcaataaccatttactaactaatagttatgctcatatggccgagttaatattcatttaccctggtaaattaatgcaggtatgacactgcagtggaaagaaagtcgaatattttgcagattattcgttccttggatttgcctaacaatcctctagatgatatcattgatcaggtaactgatttgtttctaatttggatttaggagtggtgaattcacttgttacaaattttttattgaacttataagagctagcctcagaataggcattattttaaagttgttacctggagcttgcagctggtatatcttaatttgtgcattattcaaaattctaacagagtactttcaagtttcaaacacatataactatatttcatccccactaagtgtatttagagccatgtctctcctctcttatcgagctacatcgcttcaattatttttagcccttggatgcttaatctacggtctgaattgtgtctcttctttttcttctgatgaagtcacattaccttagtttttacctttggacaatcattctatatttgatctaaattgtcataaagcacatcatcttaattgtttatggcttattttgatgattgatcacagatgcaaattatataacgttgcgtcatttagctacaaaacaaatgcgtcatttagctacaaacaaattcatctcatactttatttctaccttcttcatataatattcctgtagcaacatgttgggtttcatctagttaatttagagcagtcccttttattcaatatcagcaatagtttacccgatctagttagcgtctagtatatggcacatgatattatggacaaaggtgccaaactgctatacaccatcgtcatgttgaatacaacagatagtataacttaaatattttactttcttcagttcttggtaggcttgtttattcagttcttatgtatcattgcattaagaagagaaatatacgtacacgaagtcttactgcattaccaacgcaaatcttttgatagtgggatgggaatcacaatataagccatggaaatatggaacaagcgattgtgtaaatcaagatggattgcccactttccctcaagaaaagatggattgcctaccccactggaaggtggaactgtattataaatttataactgtaaaataatttgagggatttaaaagatttcggtatcttttaatttgttgtctaattcatccagtttttactgaacggccaagcttgcaagttttatttttttgtgatatgataaaatcaatcttttaatttgtcccatctagaactgccaggatagcataaacagaaacagtttcgctaaaggtattagctgattattttaagcatcaatgccttgagccattctgtctgttttatatttgtagctaggtggtccttacaatgttgcagaaataactggacgtcgtggtatgctagtaagagcatcagatggaaaaggtgttgtttatcaaacacggaacaagtaagagatttttccccttaagagtaaatttcaaagaaccaaatgttttatggttatatttgcatgaaaccctaggttccttggccagtggcacttaacccttgtttattgtcattatgtttcacaaaaccccaggcttaactaaatctcgactcgttagccttggaatgaattgctggagatctgtcaaagatagcaaagactgcttgaagcaggaatagattttgttatatggggttgtttagtgaaacctaggaccataaaaacctgggcttaactgat

SEQ ID NO: 88481 - DNA, 628 bp, Oryza sativa
atgcatagtgaaagacactatgttcagcagacttgtttttacagaatgagtgcacttctgaaaatgcgtggtaaaattctagcatcatttacttctgaaaatacatggtaaaactctagcaccaattttaccatgtattttcattaattgaacactgcacagtgcactcattccataataatgagcctgctgaacataatttctttttctatgcatttcttttgacctgaattttaagctctagcatgtgagtgaacattattttgaacaggcattatccatgttgtgctgttggattgaaaatcccaattcagatgcattcaagcgtcatttggctagagtagctgattttctatgggttggcgaagatggcatgaaagttcgggtaaatataagatcagttcattttatacatctacatcggattgcaataatttgtgcgccaaaattggtaaacacaaaccattgtccattcaaaggtctgtgcgggtcaattatgggatgttgctttcgcagtccaagcgatattagcgtgtagcatcgcagaagaatttggaagtacccttaagaaagcacatggtttcataaaaacttcccaggtatttttggccagaagggctgcaggaat

SEQ ID NO: 88482 - DNA, 681 bp, Oryza sativa
ccaattttgagttcaaatggccaagttatggccatttgaagtttatatgctgtttaatgaatatttgcgaattcattcatttaaattttaatttaaaaagggtttattgcgtcagccgagggggaggggcgcgcggaccgggtccacgggagtggggcccacgcggcagcctcacggtccacggtggaccgggtgcacccgggctcacatcggacagcgccgtgggccccacacatcagccgcacccgagggcgcgggcggctgatggccgggccccacgcggcagccactcagcacgcccgaaggcggccatgccagcgcggtcggcggtagcggcggcgcccacgccccgatggtcgccgccggcgaccaccggctcggcggagcggcggtcgagagagggaagggaagggggaaaggaggcgacggtccacggctcaccccggggcgacggcggcgacgggggaggctgtggcgcggctcgggtcgacgaggacgacggtgctccggcggtcggcgaccgaaacagagaggtggacgaggtcggcgaggatgcggcgaagccgaaggagtcggcgccgaggtggaaggcggtccggggcgacgatggcggcggaccggagctcggcggcgacggtggagagagagagcgatgtcgcgagctcgaatccggtgaggatg

SEQ ID NO: 88483 - DNA, 1140 bp, Oryza sativa
gatttccaaggtttgagccgatcattgatgatgatggagaaaagatcaccacatgccgatgcatgtccttcggagaagcagcatcggtcagcattgcatccaaactatcggctaagcccttcagcgagtggttcaacaatttttatgacggggttccccagaaacaccaggatctggtttgcatacgaaggatctgctggttttgagctgccaggtgattttcggtttgaagagatcaattccgaaaaatatgacaaatctatagaagtatactcaacagccatcagcccttgcatccttcctgttggcatccaccaaggcaaaaacattcagatgacctacgagttctatcatccgataagtgctgcaaggcaattgggcatgggtcaactgccaattagcctattctttgccgataagatccaaagtagaggagagatcacatcaacactcatgatggatcggctgctgaacatagcaggaccacctttgggtagtatcaacaatatcaagctaaggatgttgagaagtgcagcctttgaccgatggtgggtagaatggaagaaacatttatctcaccaatcggcttcaatgtatctgacagatctgtttcctgaagctgttcctcaagtaagtatttagccccttgtcaattctattaaccacaagccgatgcattaatcttaatctcatgtaaattctttctttctctgcagacaatagaatcttctcctcctcatcacagcaatagtggtatggagattcaatatgctccaggacttctgcccaatggtggtgggcgatctcctccagtcatcggctataatgcccccaagacctcaacactgctgcacggcctgccccgtgtgccgatagcccctgatgctggtaggaagaagagagcaaagtcggctgctgcaccatcggctgcaaagaagaaacctaagaagcaaaagaccactgccgatgaattgccagccatagatccagatgtaacggaattcctggaggatgaagcaacggtagaagatgtagatgaagcggctgaacacattagtgaaacaagggaacaaactactccagctgatccacctgctcctcaaagaacaccatcaccttcagtacgtcccacatacaaac

SEQ ID NO: 88484 - DNA, 1585 bp, Oryza sativa
aacagttactcggctatagaaaggtcatagtcagttataattgatggccattcatcatgggaaccagctcaaggaactaaattaacagccagaattcaaatacatgattctttttcttttcttttctttttttacttttgttgtccctggaggggacaatattcatcgctgaacaggtgctcagcaaaccactgttgtatacttgtatgttattacttaacagtgtgtggagtgattagagttgcatactccctaattgtatcaatcgacacttctgagacaatgagctgtgcgatgaccgtggtctatttcatttatttcatttgccctgtccgagaattttatgttcactttgtttaatccatcaaatttctgatactaaatcagggaatgctgaagatgaatttgagttttgagatgaaatatcattggacacatgacgttctggttatagggcagtagacgactagggctctccaggcttctgtccgttcaacagcatcgttacactaaacatggttttctttggatattttatgtaatttctcacaaaataatctatacacgaaactcatctggaagagagaatctgcagatgaatttcacatggcatactcttaaccatcaaatcagcatacattgatccgacataggctagtctggatcagcacattgtggcatatgacaacatggattggaatattggaaacactctatgctagtcacatgctaacatcaacaagtttagagcaacttgtaggagtttgtcatttttactccccccaattccagcagcctcttacagctcagaagaaacctgcatggtaggaaccaatcatttcaattagccaaaaaataaaggaaaatacttacaaattgatatttcactcgccaaatatttccaatatccagcccacatgtcttcatcattactaactgaagaaataaaaaatcaaaatcaagaacaccatggtcattcagcttgatctactactctactaaaaagacgcgaatattaggaatgacctaatatcaaataattagaaggggtgagtcttcaaacccaaatcatctagcccaccactttgcggagctagctggaagacccccgtgtgtttctcgatctactactctacttattactaccagaatcctgatccctgaaggctatttttttcaaaggtaaaatcatcaccaacatggcctagttagcatcgtctgctgttcactaacctgaccagaaatgagcctgctgacacggcggcgcctgaggctgccgctgccggagctgaacctcgacgtccatcggcgccgcggcggcggcttggtctgctctgagtggcggcgtttctgaagatgacatctcatatgcagtgttcatagtgtcatggatagtctcttggccctgagttggtagcatccatgataaggccatggttggcacagtaggatcaggttgaacacctgctgatggtttctcttcctccatcgtgtttggaatctcaccatcctgatgacagcaagaagagatgaaacattagagctcatggattaaatgtttcaattgccctcaaaacatgaactg

SEQ ID NO: 88485 - DNA, 2542 bp, Oryza sativa
gcggactgcgtctactacctccgcacgggggcttgcggctacggggagaactgccgctacaaccacccgcgcgatcgcgccgccgcagcagtggtgagcaccaattccccctctcgctgctctactcctctttttttttttttcacctcctgactttagctacggtgacaatgaccgccctattggattacgtccggttgattttgaggtggggggcttcaagctgaaacctctcgccgagaattaattctacttatggcctgtgggatcttatcttgtgagcatagaagtgaaagttgattgcgcctttgctggtagcgatggtttgcttgattagtttggtgtctcggtcttatggttgatgtggacaattctgagctccacatgcaggcctagccacttgtctggtcctttttttttctgttggcaaacgcttccccttttcttttttaatctatgttttgcttatggatcaagtagatggaccatgtgctttgaactggtggtaaagattagagccttaggtagagtgtaatgattgtgaattcatgacaatggattgaaatcgaggtattttatcctgcttttgatttaaacattcatattgttatttgtttattagttaaatggaggtgggaagaccacacattcggcagagtatccagaacggccggggcaaccagtttgtgaggtaatttatctgattctcattttgtgcaagctctcactcatatgatcatatcaaacccaaaaaaatgtgcctatagaagtgggcaacctatttaggctacagatgatttttttttttgtgtgtgtcatgtgctggatactcttcgggttaacattttgtgataaaaaatgcagtactatatgaagaatggaacttgtaagtttggctctaattgcaagtatgatcacccaagggaaggctctgtgcaagcagtcatgttaaattccagtggataccctctacgctcagtgagataattcattcgatcaattcttattaaagtagtggcctgcctttttcattttctgatgaaatttcttatgtgcagggtgagaaagattgtacctactatgtcaaaactggccattgcaaatttggatctacatgtaaattccatcacccagaaattggtggagtttcagagacacctaacatgtatccaccagttcagcctcagcctatctcttcctctcatccatatcaacatcttgctggctggcaaatggggaggcctcctgttttgccaggatcatttttatcaggctcatatccaccaatgatgcttccgtccacagtcgtaccaatgcagggatggaacccttacattgtaagtttgtcatcattttcttctttgtaccacatgtagtggatcatcgagcaagggtgttattattatctctactactttaaaagcacaatcgtttacctttccttccctatcccaccctccacataaaaaaaacgtaccattccctataaaaccgcttccatccccacctataaaaaaacgttgtagaaaaggaccgagaaaaaacagggccacctatgttacgatcaaactaaaccatgtttcttagatcccattgcgacacagggggcatatgactagtaaattattaaatagatcttctaatctagtacaaactatctagaaagaaatttattttttcttattaaggatgtactttgaacatttatagtcatcacaataaaataagagaattggctggtaagagaattggctacagagtgacccagaaaatttaacgtgattcatactttgttgtaagaacaattcaggatgacttcttaattttgtgctacaaataatgctgatgtaagtgtcagaaaaagaaaaaaaaaagctgtattgacctctttactatgttttatgttcttagtcacctgtgaaccaagttgcgtcagctggggggcatcaaactgttcaagcagggccgttttatggcttatcgcaccaagggccttctgctgcagtcacttatggcagtcagtatgcaccgttatcttcttcaaccatgccttcaagtagcagtaaacaagaacctgcctttcctgcgcgacctgggcaacctgaatgccagtattatctgaagacagggagttgtaaatttggatctgcatgcaaatatcatcatcctcagtatttgaatacacctaagtctaactgtatgctgagtcctcttggtcttcctcttcggccggtgagtagctccaacacatatctgcttttatatgcttaaactatgtgtagcacgctgttgccaggatagtcagtccaaatgtatatcgcttgagtctggattagtatttgatatgttgtcccagataagtttgccatatagtttattgtattgagagaaccaaattgacgggtgagttttggtgtacacatgtaggctgtggttgttccagccggttcccaacaggaacagtacgcacggaaaacagaccggtccattagcgcgtgattaattaagtaaaatggatcaatatgattttttaagcaacttt

SEQ ID NO: 88486 - DNA, 923 bp, Oryza sativa
ctctccctctctaatcttttccttttcgttctttaggtcgtcccggtccccgtccgccgcttgtcgacctccctccgccgctcctcgtcgccggtcgtcgtcgtcccctccggtgaggactccctcccctttcctctccttccccgattccccgtgtgccgccgccacccacgctcgtcgtcgccttcggtcgccgtcaccgccggggcgccgtccgctaccgccgcccgcgccgccgcttcctgtcgccggtggatgtgcgcgtgccgccacccttgccatggccggccggccggctttgtgccaagccgagccgagccaggccgccgccgcaccgtccgatcggccccgggctgatccgggccgtcgatcccgtggaccggcggtggaccacccgcgtggtcccggtccacggtagaccgaccactcgtgcgccgctgccgagtggggcccgcttgccggcgccccttttccctctctcccgagccgctgaccggtggggcccgcttgccggcgccgcgcccccccttgattacgtcagctctgggatttattgcgcaataaatgatttaaggactttttgttatagtaataaacacagtgaatcttctaaaattcataactaattcatccgagctccgtttaagcccattcaagtctcagtaaatcaagaaaaatgtgtagaatctattaaaaatggttttgttccctgtttcagtagtcttatagcctgtttgcaatgtttgccttgtatgtcgctagattccggttcctccgacgctccggtgtacttcgaaatagtcgccgaggttcctccagcagcagagcaaggcaagtcatgcttgtcacttgaacatgttgatcctatattgcaaatgctctattgtttttcttcaaatattgcattgttttataatgttact

SEQ ID NO: 88487 - DNA, 799 bp, Oryza sativa
gaagatagcatcagttggcgttataacaggccggccgggcaggcggtgacaccagtcagcggcggatgcggcggccggtcggtgaagacgtagacgcccaacaacggcagcataataggccagccgtgcaggtggaaacatcagtcggcggcggtcgaggcggccgatcggtgaagacgtagatgcccaacaacggcggcataaaggccagccgtgcaggcggaaacaccagtcggcagcggcgaaggcaagccggtcggtgaagacgtagacgcccaacaacggcggcataaaggctagccgtgcaggcggaaacaccagtcggcggcggcgaaggcaagccagtcggtgaagacgtagacgcccaacaacggcggcataaaggccagccgtgcaggcggaaacaccagtcggcggcggcgaaggcaagccggtcggtgaagacgtagatgcccaacaacggcggcataaaggccagccgtgcaggcggaaacaccagtcggcggcggcgaaggcaagccggtcggtgaagacgtagacgcccaacaacggtggcataataggccagccgtgcaggcggaaacaccagtcggcggcggcgaaggcaagccagtcggtgaagacgtagatgcccaacaacggcggtcataataggccagccgtgcaggcgaggacaccagtcggcggcggcgaaggcaagccggtcggtgaagacgtagacgcccaacaacggcggcataaaggccagccgtgcaggcggaaacaccattcggcggcggcgaatgcaagccggtcggtg

SEQ ID NO: 88488 - DNA, 1005 bp, Oryza sativa
acatgtcgatgagcccgacgggcgcgaacggaccacgaagagggaggtgacgctggcgatgcggaagcggcacatcttcccgggcaccacggcgaacaccgccggcgcgcagtccgggtgcgccatgttgcgcgacgccgccaccgtcgctggcaaggacgagcagttcatgaaccggctgcgcccgttaatgagcagcgactgcggctcgccaacccagaccatgggcacggaggcgagccccgccgcctgctcatacgtgctccggtgccaccagtcgttgagcagcacggtgtgctgggcagcctcaacggcgatcatgcctttgagacccgccgagcgctacatccgtagtgggcgtggtacatgtacgtcccgggacggtcgacgatgaaggtgtaggtgaaggtgtcgccagggaggatggggcactgggtgacgccctgtcacgcccagaaattcccgaatagaattccaagcagaatgtgcattaaaatccccgtccaggaccggccggggtacacaaacgacaatgttgacattcagatccacgtcttacaaacatcataaaagtcttacataaatgcagcgaaaaaaatgaaagacaacaggagctaagccttgactagaactgcagcgggaacaccactccacaggcatcctcgacggcacggacgaagcctactcctcagagaaacctccatctgacacacactcgtactctggggttgggaaaaaaagagcaagactgagtactacccactgtacttagcaagttataccggaataggggtatgatgcagggaattatcaaaggagagctagagtggttcatttgcataaagcgagcatttataaacagaagttggaagatttaaaccgttgtaataattaatcaatattaatcatccactgtccaacgctatgccacgttgcgacaggcccaaccatccacctatactatccaaattctaaagattacactagggtgagactaatcacggt

SEQ ID NO: 88489 - DNA, 1139 bp, Oryza sativa
gcggcgacggaggcaggccgcgggtgaagtcgtagacgcccaacagcggcggcataataggccagccgtgtaggcggagacaccaatcggcggcgacggaggcaggccggtggtgaagacgtggacgcccatgaacggtggtgtgaccaaccaaccgtataggcgaggacaccagtcggcggcgacggaggcaggccggtggtgaagacgtagacgcccaacagcagcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaccccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatccgccgagtgtgtattgatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatttattacatattccataga

SEQ ID NO: 88490 - DNA, 637 bp, Oryza sativa
tgtactaataaatactgtgaatggttccctatgtggtatgagatgcttaagcattagataagttgaattccatctaacatccatgtccaaaccaaacatacgaggacgataacccgcagcaatgcaaacatttttatatgtagcaatgcgctgattagatgcattcaagaatgaaatggcagctctaatgtatttagcatgggcttgaacttgtcaagtccagccttaacaatcaaattgatgatatgacatgcacagcgttgtgcaaaaataaatcaccaatataaccaaacagagcaggagtaagggtgatcatagctttagaattagcagaagcattgtctaatgtaatagagaaaaccttatcagtaataccatattcttcagcaacagcaatcacacgctcagcaatattagcaccagtatgtgactcatcaataagcctaagacccaagaccctcttttctaattgccaatcagaattaacaaagtgagctacaacactcaaataatcttccttagcatgaccagaccatatatcagatgtcaaagcaatagagctagcagaattgagacgatcaataataacagaacgacgatccttaaacaacttataaaaatctctggtagtagtttg

SEQ ID NO: 88491 - DNA, 814 bp, Oryza sativa
ccaacaacggcggcataataggccagccgtgtaggcggaggcaccactcggcggcgacggaggcacgccggcggtgaagtcgtagacgcccaacagcggcggcataataggccagccgtgtaggcggaggcaccactcggcggcgacggaagcaagccggcggtgaagtcgtagacgcccaacagcggcggcataataggccagccgtgcaggcggaggcaccactcggcggcgacggaggcaggccggcggtgaagtcgtagacgcccaacagcggcggcataataggccagccgtgtaggcggaggcaccactcggcggccacggaggcaggccggcggtgaagtcgtagatgcccaacagcggcggcataataggccagccgtgtaggcggaggcaccactcggcggcggcgaaggcaggccggtcggtgaagacgtagacgcccaacaacggcggcataaaggccagccgtgcaggcggaaacaccggtcggcggcggcgaaggcaagccggttggtgaagacgtagacgcccaacagcggcggcataataggccagccgtgtagacggaggcaccaatcggcggcgacggaggcaggccggcggtgaagacgtagacgcccaacagcagcggcataataggccagccgtgtaggcggaggcaccactcggcggcgacggaggcaagccggcggtgaagtcgtagacgcccaacagcggcggcataataggccagccgtgtagacggaggcaccaatcggcggcgacggaggcaggccggcggtgaagacgtagacgcccaacagcagcg

SEQ ID NO: 88492 - DNA, 4522 bp, Oryza sativa
aggtccgccacggccacctcctccactagccacctagcaccttcgctggccgatgccgacacgcctcctcgcgtgcgcctccattggccatcgggtcctctttgcccgccagccgcagccttcggcccgtcgcgcctcccgcctccaccgggctgccgttgcagcgagcaccgccgctgtcggggtcggggtcgaccattcctagccatcggccaccaggggtggggggggggcgcagatccactccctagggggagcggatccatcgccccgccccgtcgaccgccacggccaccgcctctcgaccggcgcacgccgcttcgcctcccacaccaaggaggagctccaccgtcggcttgctctccccgtcgccgccttctcggccggctgcgcggttttcggcgatgagctccagcggtggctaggcggctagtggggagggaaggtggcggcacgagcagctagggttttgccccccgagccgcttgcgtgagagcggcacgaggacgagtttggttgttatcctccctaagactggatatgagatattataatacaatgaatttagataggagcctatccaaatacgttgtactatgatatatcacatccagtcttaagtttgttttttgtgggacggagagagtactcccttagcaaattctagcttgtgtaaagtatgagtaaatggtttggataatgattgccgtaccgttactagagtatactcccttagcaatttcttattattccattgtcataataaaccttattattagttattaataaagtgaaagatcggcaatgtcaaaaatgtcaaattttaataatgtcaaaaatgtaaatgtagtgtttggtttgatttcttaccaattgctggtgtgttttgttagtggaagattccgaaattaccaaattttggtagagtttggtaagatcacaatggtaaaatcttgtttaatttgttaacgtactaaaatttgataatgccaaaaatcgataaggtttgttttggcattgaagtgaacaagctctcaatatagtatataaaatatattctcctgttctaaaatatagtaaatttctaaaacattctaaatttagcctaaaacgtagtagtaacagcttcgctacatattttcttatctcaacgagtatagattctttagagcaagtttaatatcatctactcatcatcacaaagttcgtgtgtttcattccactccaagctcctgagagtactagatttgcgcgaaagccaaattacggagctccctcaatcggttggtaaaaatgaaacatttgatatttctacaaacgctaagggtacaattgtataaagaaaacatatcctatccacacaagccttcgcatacacataccgtgcacaccaactaacaaatatcaaaaaaatatagaaaatttttatatatatactttggtagtattatatttatatgtaaagttttaccttcaaattcattatacatatgaagaaaaaaacaaaattatgatagatttatactcttaaaactatcagaatttttatactttttacagctaaaatataataaatttgaggataagactttatatataagtgaaatatatgaaaagtaaatatataaattttttttctatttttttatatttattagttggcgtgtatacgaaaagcttaaaactatcagaatttttatactttttacagctaaaatataataaatttgaggataagactttatatataagtgaaatatatgaaaagtaaatatataatttttttttctattttttttatatttattagttggcgtgtatacgaaaagcttgtatgtatagagtatgttccccttaataaaatgtgaaatggttgaaagtccgccattcgcttgtagggctggaaatcgaccagagacgaggctgtgtatcacaacccaggcacaaaaaaaaaatcatgtctgactaagctccaggctgtgttaggcggtaagggatggggactaattcctcccaaacgaaaaacggagcggtccattagcgcatgattaattaagtattagattttttttttgaaaaatcgatcaatatgttttttaagcaacttttgtatagattttttttttcaaaaaacataccatttaaccgtttgaaaagcgtgcgtgtggaaaaagaattatgtgggtcgcaactttaggtgccgaaggcagacttagtgcctgaattttgtacacaacttgtccattctctcaaggcggccgaactgtaaaaatgtgcttcatttttatacgtcagctgcactccagttacattgttaagggtcaagtgatggccagttacatacttacatattgtcaattgtgcactcattgaaccaccacaaaaaaaaattgcacactaattacatttccaatctttccctgcatatttttttactatagttctcactcctacagagctacagacactgacaatcaactcctgtctatatagacataaaaattagaataaaatatctgttcattgactataatctccgactcactagataaaccattcaaggacaatgcatgatgggaacaaattgagtagaggataacttcagcataatcagatgaacttgcaactcaccaggactttttttttgtttaattgatcaacagaagttgcatagttatctgtcacgagattacgatgtttgggatatgacagatcttgaaccaatccttgcctgtatctttcctgcagttttcgttcaactcagagctacaggcagtgacagttaactcctccagagcagtcaaatgttgcaaaccttttgggatcgagaccaactttgggcagcaacttatttgaagagattcaagtgctacaagatcaccaatccattctggaagcgcgtccaattcagtgcaattgctgatcttcagctttcgcagagtggtaaggtacctgatgggttctgcaagaacacgtagcatttcgcagtattcgatggttagttcctcaagttttggcctgtgctgcaacaatttccactcactggatgatacatcggactttctgatccacaatctcctcagaagtgatgcggatgtggaagatgatgatccaaacatcttcctgactgacaatatctcgctgctgtcggagattgacaaatctgttatagcatctggaaggcatggtttcggcctgagctttgggcatcctgttgcggttacagttttaagaacaggaaacatggatccttctggctgagtagctctgtcatctgtcgctgctgaagttggccaggtctctaggttaggcatgtcttcaaaatggagttccttcagtgactggtacagcacacatttctgtcttttcacaagaatttcagagctcatgctatggacaccggccatgtatcggagatgaagcgattggagataagggatgtgtctgaggggtggtaggcagctacagttaggaatgttgcttaaatctaatgagacaagatttgggagccatgattccatgctcttcatcatccaactgggaaatctagtgcccatgtaaccatctatttcaaggacctcaagattttcgggtggcacaagaacttcaagaaatgtttcaacattttcaaaatcatccgcagaacaaggaatggtccacaacaaggtcaacttgcttagttttttcttatttctccagtttgctcttttggcagcagttgtcagatccatcttgtgtgaccaacattcaatcctgagctcaccagttagattgtttagatctttcagctccgtgatactgctatgcttgtcacctatcatgagtaaggacaatgtttcaagtttagtccatcgcccaaatccattaggtagttgttttaaagatcgacattggtcatttcttaaatgtttcagattggtgatccttgtcatgccatcaggtaacttagctaggttttcacagccaacaaagttcaaactctctaacatcatgaggttggttatagactcaggcagcttacgtagactccagcactggaacaagatcagggtcttcaaactatgaagattgccaattgattcaggcaattcctctagactaagattccatgagagatctaaagtctgcaagtttgggagatgactagttgatacaggcaatgccaaactgcttgcatggtgtgataaaatgagtatctgaagttcatgaagaccaccaatggatcctggtaactctgacagactactacagtgagacagatccagaatatgcaagctcttaatgcgacctattgaggttgggattgattcaagatcagtgcattgtgataaattcaggtgcaacaaatttgaaaggttaccaatatttttgggcagtgcttggagaacaccacatcgtgaaaggttcaagaaatgtaaattttgcaggctgcatatagtgtcaggtagaatttcaaggttgccacatcccttcaagttcagcaaatgcaaactttggagtgtaccaatagagctaggtaatg

SEQ ID NO: 88493 - DNA, 1022 bp, Oryza sativa
ctatagaatctggcaagctatggaagttgcaagctgaaagattcaagatttctaggttctcaagggcacatactgacatgggcagcacattgagatttatgcaattgtataaatgaagagtttgcaaattgtggagactactgatgcaattgggcagagtactgataagggatgaagaaaggtccaagtatctcaaatgcttcaatttaccaaccgattgagggagctccataatttggctgccgcgcaaatctagtactctcaagaacctggagtgaagaaataaattaatgtcaagactacggccccaggaatgaaacgcacggactttgcgaagcatgctccaaagaacatcggtcgaccccatatcatcatgcaatgatgcatagcggcaagcttctgtcctcccattgactcgcttagcgcttatgatctgaacttcatccccggcaacagactgagcaaggtcatgcaccaagtcgtgaattttgtacttaactcttccatcaacctctaatcctttctttgacaaatcatgttggtctacctcttgaaggaatgacatccacaacaagtgctcaaaacagtcgtccgctttatcagaaaccggctggcaaccatactttgagggttcaacaaagccaagagcaacccattgctgaataagcttacccttgtcaatctcatggtttcgaggaaacaccgagcaatacgcgaagcattgcttcagaacgggtggcatttgatcatagctgagtttgagagatggcaagatggtctcctccttatccagctgccaaatctcactgtccctgacagcaatccatgattcctcattcctcttgaacctcagcatgctcccaagggccttcgccgccagcggcacgccgccgcatttggggacaatctccttccctatcctgaccaattttgggtacaattcctcatctgcttcctcaaaggccttcctcttgaacagctcccagcaatcctcatcagagaggctcttgagcatcaatggc

SEQ ID NO: 88494 - DNA, 688 bp, Oryza sativa
tcaccaccggcctgcctccgtcgccgccgattggtgtctccgcctacacggctggcctattatgccgccgctgttgggcgtctacgacttcaccgccggcctgcctccgtcgccgccgagtggtgcctccgcctacacggctggcctattatgccgctgctgttgggcgtctacgtcttcaccgccggcctgcctccgtcgccgccgagtggatcctccgcctacacggctggcctattatgccgccgctgttgggcgtctacgacttcaccgccggcctgcctccgtcgccgccgagtggtgcctccgcctacacggctggcctattatgccgctgctgttgggcgtctacgtcttcaccgccggcctgcctccgtcgccgccgattggtgcctccgtctacacggctggcctattatgccgccgctgttgggcgtctacgacttcaccgccggcttgcctccgtcgccgccgagtggtgcctccgcctacacggctggcctattatgccgctgctgttgggcgtctacgtcttcaccgccggcctgcctccgtcgccgccgattggtgcctccgtctacacggctggcctattatgccgccgctgttgggcgtctacgtcttcaccaaccggcttgccttcgccgccgccgaccggtgtttccgcctgcacggctggcctattatg

SEQ ID NO: 88495 - DNA, 4111 bp, Oryza sativa
gtcccatatggttatgattatgtgacaattatgtggatttggtctaaacctaatgtgactgatgtacccatttttagtgttttaagataaaatttaagctctcttggatagattagtttttttactccctattttcagcttattaaaccaaaaacaaattctaaaggagagattatacgtaatctcttgttgatacctgtttggattaatgtcaaaatgtgcccatatgtagcttataaatagtaaatgtgttagtttgatttgaagccaaatgattggtaatgcccatgcttaaattggcaataattctagaactctattcacagtaatatatatatgggttaattagatacatgccatgaaaattttgccggttttgaaatatgccattactatttacgtatttggaatgatgccattgctatttgttgtaatcttagtggtgccgctaagatacgtattttgcatgtattggacgaaaatgccctcatcttctacctctctccctcttctctcatcttctagctctttccccgctgcttctactctggcgccgtcaccgccgctgttgctgtcgctgccgctcgccgctccgccgccgccgctcgctccaccgctgctgctcgctgttgctgccgctccgccaccgccgccgcagctcgcgccgctcgccgccgccgccggtcgcttcgccgccgccgctcgcgccacttcgccgccgccgctcgctccaccgccgccgctcgcgccgctcgccgttgccgccgattgctccgctcgttgttgccgccgctccgccgccgcgccgctcgctccaccgctgcagccgcttgctccgctcgctgctgccgccgctccgccgccaccagttctctgagctgtggaagaaaggagggggagaaaaagaaggaaagaagggtaatttggtccaaattttttcataaatggttggtagtggcatatcttaaatatttgtaaaattgcaatggtatggttccaaatacgcgaacactgatagcatatttcaaatccggcaaatttttaatggcatatatctaattaaccctatatatattgtctcccaataacatcaatgcaaacacattcacctttaatactaccctaccaaaacattagtagtgtcaaaatttgcttaaattttggtacggtactaagccaaacaagcccataatcttccacatcttccctgatttgaacgtgcttatcgtaaaaaaaaaaccatgattaaattattgaactatggaggactggaggctataaattataatctaatttgagtttaattccaaaagaatattacgagcccttagcccggtcaaaatatcgggcgtggaaagccgccattctatatcagcttcatgctagagcacctctgctgttgattcagtaattcacttctaaatttctaggacaaaatttctatgtttcctttcctaaataatatgtggagctccagagtccagattccggccattggatcaagccatccgagcaccgtatagcggcattagccatgcacgatctctaaacttccggcaggaatatcacggattcactatataagtgcgtattcacatagcttattcgcgtcctgtcatggtcccatcagtgaccttcacagctattagtcagcctctcggcatgtgcttataccctatgattgtcgtgaaattaaggtaaatacatggactctgtcaaactactgctatggggaattagatgtaggactccagtactggaaatgcatactccctccatcccaaaataaatcaacctaaggcgggatgtaacatgacctagtacgatgaatctgggctagggcatatccggattcgttgtactaagtagtgtcacatcatagcatagattagctagaaactaaggtgtcccattagtgcacaaacaggacaagcttacatctgtatgcaaattagttgttggtggttaacgattgtctttgctttgattaaaacaagggtgccaaaaaagtacataacttctcttatgttatttccaaagaactcgtaaagacaaaagttttacatgctagtatgctgttctgcggaataaatggagtctgctacaaagagatcgagcacataccttcccaataaaactcacaaccaaaggcccagatcttgagatccgataacaacctgcacgtcaaaaacattaaccaccagatcagaaattttgcaaaatcatttcccacaaagaaaataatgggagcatcaaatcatacctatgtatacatcagaaaaatctatgcatagttttgcaaccactggggcaattttaacctgaaaaagaacacagtaaaagtttatcagatactgagatacataatgaagtacttctccaaaagtaaaagttccaattaacttgctagttaattggagaaaattttctccaagaagtgagaaaattccctacaggattttccaagaagttttttttttctttttgagaattaatggataaggtggatactaaacgtaaaaatggaattaacaagtgtgcaatatttatccaatagttgccaggaaagtaacatctaggattgaaggaaggtaaagacaaatagtgaaatataaacagctacacaaagaaacaatcgcgaggcatagcatttggtcaaaatcaagattattgagatactacatcaataggggtcatattacattgttctatcttaatgaattgataagtgaaattatttaagaccaaacatactataatgatctattttggaactgacagggataaaatatgaaggaactgattctgataacgcaactagaataagaacaaagctaattctgactgagtcgaagagacatacatctaatagcgacgtgcagagatgctttgacacaaaagatttagccatcactaaaccgctctcttgtgtgtctagaagacaaccccactccgtttcaagctcatccacattagttgcagcgagaatgaccacatttttgcatttgatctgcataagaaaccagttatctataagacaaatgaaaaaaaaaggaagcaatttccgactctcttttcatagtttacagtaggcattttcgtcacttcctaattggatgtcaggcttttcattcaggcatacttactaaactttggatatatgttaatacctctgtcccgaaatataagggattttggtatgcgacttaataaatgtgcatggaccttgttactacatcagattatatcattggcacatgctaactttggagaaattacaccccttgtaaagccaaaaatatgttcaccaaatatgtatttcagaagtaattcaaagaaatgcattaaaacaacataacgtaccaatggcaacggtagcattttgtgatgcaataattccgtaataccttctggcaacaaagccatctgaaagagatgtggagttaaatgataatactgcagcttgcactatgctagaataaacatgcacagcactagatattcaagaatttaattgtatttgcgaaccagattacctcatttcgatcaccagtgtaattgtctcctatcagttgactaaggtattcttcaaactcttcatcaggagcctatgaaaattcaaattaaacatgttgataacagtaaatggcatttgtgatttgttcagtcaaattcatgaagcaaccatttagtgtatgacaacagttcaaggctatgcacatttttccaacagaaccagcaagagagctgaaagctatgcacactgaggactttctatatttcaaagggctgtcataagaatattttcatgtgaaactgcaaccaatagagcaacaagctttcgatttgtcatctgaaataagaaatgcagcaaatgcacaaaacaatactaggaacaatgattttatacaaagacaaacatgaatgaccactctaataagacattgctgaattacttgtatcactagaagcaagatgattttagaataaaggaacactgaagagcagaagctcagcacaaagtagaggcacagcagaactagagcagaaggataaaggtgatcatgactaacaattaggctgggaacctactataacaaatcctacagcg

SEQ ID NO: 88496 - DNA, 2063 bp, Oryza sativa
tttctgggcatatataggtattggatcttcatcctctgcaaatgatggatacatggggagaaaatacttctgagagatcttttccaggtcagatactgtttgctcattagacgtcaatgaagagtcactgaagatcacaatcatcacatcggacagtatctttaaacataggaatctggcatcaccatctttattgcccttgtacaagacggataagcttggaaggattcgacttgtgaatattttgtgttcattaagtataacagaaggctcctccgtggctgcctcaagaaccctcaatagtgtcatttgaaaatcatcccgagcctggatgtataagacacgtaaataatcagataaggtcaagatatgttaaaaaatacagtagtaatgcaaaactgttaaggcaagagccacagcgcagcatcaaaacaaaggatgggattgatttgacacttaagtgcagttacaaaatgaatgtggtcgtcatgttttttcatcatggcataaccgtgcgtgaagttcttagatcatacctgaaatggtgcttccaaaattttcataagatttgccaactgaagcaatacatggctcgtcacaactctgtgattgaatgaaacactcccaagaagatgaaggataacaggaaacaaatgaattatgctctttggatgagctcgtccagttaaagcagtagcagctccatgacgcttgcctcccataacctgttgtatatcactagagacagtgtcaaggatgcctgggaccaatgaagcaaccaactgcacaaatgcttctgtgcattgatgaatgaagccttccttctcctttcccaatctatcaactgctgatagtagttttgcattgcaaaagaaatgaggaagccatcttcgactgttcttgcaaagaagagcaacaaatagaagggttttgccacgcagaacatcagttccctgttcaataagagagatgagtccaggaaccaactgcttctcttctgttaacgactgaatgtagcggttcatggttggtatgatttggctgttaactagtgctgaattcagaagattcaaactgatctgctgctcacgtgaattgcctttaatgagtgtgcatgcgatatccttgaaggccagcctctccagtattaaatgaatacaagatgagctgaagcgagctaagcgtgccaaacaagatcctgcaataagtcttgtattctcctgcttaccagttgctctatagatgtagcacaggtgactgattacatcttgggaagcgaaacgtgaagtccaatctgtcccttggctacagatgttatcaatggttcgtaaagcataaagctgggctagatcatcttcacctttacgcaagattgatgacaccagcgcaattacagaacttggaacctgcacaacttgcaaagtaaaatcattaataaaacacaataattaatgtcatagttgtgaatcaagataaaaggattcctcacatgtatgtatatatatatgatatatatactacttgaccagtaagatatgaaagtaaaggtctcattaattcattaacactattacatagctgacctatatatggttccacaaatacaagaatatagtcattaaaaggaaagcaggttaaaacacttgaaagaaaattggtatggaattatgtcccttaagttcatcaggccctttggagaggcaaagttcaacctataggtgagagcaaggttatcaagttgcagaaacagaaattgacaaagagatccaccctcaattcatggacatacaatcactaaaactaacggatagatgtaatttgaatcactcctgattaggctagccattgaacaggattggtatgtggttttctgtaaaatcatacaggtttgactaacaataaacatgtgcatagacacaaaatcaaagaaaagagcatgtatataaacataatttagtccatatattatagtaatagttatgaaggtgggcagtgtgattatgtggttatgtgaaaaattcaataatgcagtatatactttcaactgaaagaagcttccactt

SEQ ID NO: 88497 - DNA, 4012 bp, Oryza sativa
ctctaactagtatatgtattttcacagttaaatttgttatttttgttacaatttgtagaatacaaattcgaattcgcatgtttgtctagcgatgtattaaatattaatttatcttctcattatttttcataactatttaggtcacctgagtgcttaaatactaagtatttcatccatccaaaatatcttatattttgggacagagggagtatgtctgatataggcctagtccttttcttcaactacaattacaacttccttatttaccgttagcacgcttttcaagctgttaaatgatatgcttttttgcaaaaactttttatataaaagtttctctaaaaataaaaaaactaattttaaatgtatgaagttaatacttaattaatcatgtgttaatgagctttctcgcggttgaaaagcttctccaacgtgagcaaaggaactgggccttagacttggaattgtgtgaggatttcgaggtaggaggcgcttgttcacatatatcatgtcgcttacagcaagtttaataatgtagccaactattatctttaaaaattagatgtcattcatgatctatggatgaaatagttacgtatgaatatgaactatatcatcattaatatcttacccaactctcataaatacacaatgtttcgagacagtattgtagctccctcttgtcttctattctcctcttatttatctaaacatatgatgtgatgattttaaaagcacgtttacatcacttattatacttgctttttttgaaaatgctggggatcgggcgcccgatgcggcgtaaaaaaaatcaggcactccccacgcgcgcctccgcctcgcctcccaggcgtaaagaaaatgctgggaatttctttcgctatttgctgaaacattgttttatatatggtgaaacggcgtcctattttttggaaactgttctttcatacgttgtagcaaaatgtttcatgaggtgatttggttgtgtttcagctttttacgaaattgaaacatttctgatctacttagtgaaatatgttcgatctacttggtgaaactatttttgaaatttgtaagcgcctcgatgccttctccattatttggcttgtgcgtgtgcggagtaattaccttttttttttatctataaacacccataactttctgcttaaataacagataaccttaactatgagcttaaatatgctttgggaaaaaaagagttcttgctatgaggaaacgctatccataaataaaaaaatttctaggaaatttattcataaaggaactaaattcaaactcaggactttccatcattttcttttttggcaaggatccatcactattagccttttgtaatctaaacactaatcagcctacatatcgtcatcagcaacaacgaacgaccccaacttgcggcccatcgaaatcaaaaatccacactccaggagtacgactcccggcctggcccgcccagctgcatgccgatctccagctgcgccacgcccatcctttgctccgccgccatgagccgaagcagatcctccggcacgcccgccgcctcgctcgtcgcgtccaccgccaccgtcaaggcctccctcgccccgagccggaagctgggtatgctcccgtacgccagtgggacgccggcgtaggagaccttgacgctgccgccctctcggtgccggtcgaggatgtggtcgttgtcgatgcgcacgagtagattgaacgccggccgcgaggcaactcctggacctggagccagggccagcaccggcaccagcccgctgacgccgacaagctcgatggagctctcgatcggcttgtcgatgttaacaacagcgccgaatgcgccgaacgcctggtagattatccaaaaaccaagaaaaaaccagaagctaagcaggaagtaattggacgggaacagcaccgccatggctacctcgtaccatagactcggctcgcattcgtccaccccatgagatgtatcagctgcgtcgtggtccttagccgccatggcaacagatcggggaacttgataaccgaacaaaacggtgtagggcttattactgtctgttctaataacatgcagtttcctttattaaggccaacttttgagatggattcggcccagaactccgtcagatcacacgcgtaaggttccataacaccgtgtatctctctgatagggagatagggagatttacgctgatactacgagacctacgactacgaggaatctatccaatattcatcggttctcttacagcaggtacaatagcagattataagccagctgcaaacatacttagagcaggtacaatagcaggctataagccagctgcaaacatattttaatgagataaataagaagagagaagggcagcgggctacagatttgtagccagctgtagcaaggactccaaaacgcagcgtgtgtatgacaggtgggaccagatattaatagtatagtatgtaactattgtataaatgagctattagattggctataaatgaattggagctagtagttggctatactattaaacttgctcttagagcagatacaatagcagattataagccagctgcaaacatatttaaaggagataaatgagaagagagaagggcagcgggctacaaatttgtagccagctgtagcacagactccaagacgcagcgtgtgtatgacaggtgggaccggatattaatagtgtagtatgtaaatattgcttgaatgagctattagattgtttatagataaattggagctagtagttggctatgctattaaacttgctcttatgttcgctggatgagtactccattcttcatcctggaagggagcatctcgggagtaaattgtcgacaagatgagaaaagtttcaggtgatcttgattcaactacgacggtactgaacaaataaataaatttcataaaactacaaatactttgataaaactatcacaaagctgctatgtattaatgtggtttattgcaaggcaagcagacacacaagcagacaagcggagactctgccagatctgtctacatatttacgtttcgaaagtgaccagtagaaaaattgccatcacgttgtgcattacacaaaatctgtatagaacctatgatgttaatcaagctattctctttctggactggacaacatacatcgggtctgttcgtccaggattaggagatatatcaacagcctgtaaagaaaacaaaaaccgttcatgccatggctctagtttatgcgcagagaatcagcaattatagaactataaatacggttgatggtttatctatcattgaaatgtgaatgcttaacttggtttgcaatgcttagctggccatttcagttcttgctacgaacacacttgttgaaaggacaagtaaatataaggagtacttttggatgcccttttaactattcaagtgtggaaaaatgatttcagtaagtaaatgctttacctcaggaggttcaaaatctccagcataatggaagtaagccccaactatccaagcgtgatcagcatcactggttgacgtccatatagatatagcctttgtccaaaagcagcgatttgaaaaactacacccgaagttaaaaaaaagttcaggattgtttcatataaacatctagtaaagaggattatataaaagaaacaagggatactagtaaatcacattaatcatgataatgaagttactatatgtattacctcattatggccaatccacttggtttaagtattcgtctcatttccttgaaaacatcaattggttttgtcaagtagtctacactaacctataacccacacacacaaactatgctgtcagatcatagaagcaatccgataggcgccaaaatataatattagttggctacttgtgccatatgggctatagcattttgaaataataaaaaattgttcatttatcaaggctgaacttatcatgtaaaagaaatagtaccacgttggttataacatcaaatgtgttatcctcaaaagg

SEQ ID NO: 88498 - DNA, 679 bp, Oryza sativa
ttttgttttgcttgaaggtcaatagttcagaccaaatcagtagtggtttgaagaggacaaactttcaaccaaaatatggaggaataaaggatgtttttcgaggtgtttattcagaaggtggagtgcgagctctctatcgtggagtaggtatgtatatccgactcatatatgtctaaatggctattcaatcaccataaaactctctcttgaactgaaaacgtcggatgtatatattcctgcttcacttttgacgagtatcagttttttcagtaccttcattactgtagtagttttgctgctgaggactcttatctatttgtgttcaggtccaacgctcatgggaatacttccttatgctggtcttaaattctacatatacgaaggactgaaggcacatgtacctgaagattacaaaaattctgtcacattgaagttgtcctgtggtgctgctgctggattatttgggcagactctaacttacccactagatgttgtaagaaggcagatgcaggtattccattttctcatataatccttcctcttctagcatatccttttttatttttctgaaagactatgttcctcaactatttatcatatttgcgtctgcttccattttgtaggttcagagtcaacaatatcacgataaatttggtgggccacagataaggggaacatt

SEQ ID NO: 88499 - DNA, 525 bp, Oryza sativa
gaatcgacgctcacgccgatgatacggccgggcatgaggcgcttgtactcctggatactgcgaggaacacggcgtacggacaaccgtacaccatgggcacccagaaccgctgcgcggagccgacgacgaagacggcgccgatctcaccgggcgggcgcagcgaggtgagcgcgagcaggtcggtggccatgaccaccttgacgccgtgcgcgtgcgcgtccttgacgaactccgcgtagtccagcacctccccctccgtgccggggtactgcacgagcactccgcacacatcaccgctgctgtagtcgaagtccttggcgtccgcgacgatgacgttgaggtcgaacccagcggcgcgcgtctggcagacgtcgatggtctgcgggtggcagttggaggcgatgaggaaggtcttcttcttggatttcaggatgccgttgcacatggccatggcctcggcggcggcggtggcctcgtcagcagcgaggcgttgacatgggcaggccggtgaggtcggcgaccatg

SEQ ID NO: 88500 - DNA, 502 bp, Oryza sativa
acatcttattggaacatgacttcacccccaaggtgtcagactttggcctagcaagaacagccataggtgaggggaatgagcatatttcaactcgtgttatgggaactttcgggtaagttttgatctgaaattattatcttactacctgtagttggttaacatcctcaccttaaaaagattatgaactctttttaggtatgttgctcctgaatacgcaatgactgggcatcttctagtaaagagtgatgtctacagctatggtgtcgtcctccttgagcttcttaccggaaggaaaccggtggatattttgagacctccagggcaagaaaatttagttgcatgggcttgtccttttcttactagcagagatggcttggaaacaataattgatccatcacttggaaatagcatcctattcgatagcattgcaaaagtagcagctattgcttctatgtgcgtgcagcctgaggtggatcagcgcccatttatgggtgaagttgtt

SEQ ID NO: 88501 - DNA, 2139 bp, Oryza sativa
aaatgctaccgaagagcttaccagttagcacggtcgggtgagggagctgcttgcttacctttgggtgagagaggaaagacactgcccatcaccatggcgacgcgaccaggccctttgaccgaatggccatggcaatggatggggggctacaaggtatgccaagaatttgccagcatgtcctactccttccatacaggatgtcttgttcgagaaatatattaaaccaactccaatccatttaccaattaacatgctattagaggattgcacaaaccatcatcgtttagttttcgatttttcatgaatatattgatggatgaattagtcgtcgtcgttcttgtttctttagtacccttagtagttcctataccggtcatatttcttgggttatttacaagcggtattcaagtaatgcgtgatcataataatgtctagttgaaggagatcaagagaattaatcaatattagttgaaatattatcaaggaaaaactaatcattaccagaatgatggcttgaacatgaatttgagccacacggggttctgaaacaatggaaggtctccatgcattgtcaattagggattgcagcaaatttgatttccatagggtcaacaattggaccatgctcaagcatatcctaacaagttattggaaccgcatacgttgcatagatatagatcagaagctgtctttctcgtgttcgtgcatttttggcccgcagattattttcaaattgtgtagttacctcacttagccatgatatgatttcttgttagtccaacaatatattccatctccacacccagaaaaaaaatgcttcaagaaaacgatggaagtaaaccatggtgccaatcattcgcccaaaatatatggcaggtttctttgcttgcatgatctgatcaatactgacagtaccatcgtccaacatgtgcccaatctcctctgttgacgtctcagattctttggctcaataagttgcacaatcgccaaatgacataagtaccagccgtctaaatatggcagtagctgtacatttcaagcagtttcatgattcaactgaactgacactgtaaactgcaaatccacggtgataaacttgatgacgatcaactgaaaaacctttcaaagacaagatgtcattccaacataatttgttcccaccacccagtacttgaccgaatgctttctgtccatgcacagtacctggtcctggctcctgtggccatgcacacggcacacaggttggccaccaaggggtggggagactttgacccagcgtacactttcatgttgccaactctgctgctgaggatgatccacaaccagatctggatcagtttgtctcgataccagactgctcgcaggaagcacctcattgttgatcgcagtctcgacttcgagcaggtggaccgagtattatacttggcatgggcacgggcaggtatgcgatgcccaagtaatccttgcgttggtgggaaatatctccactgcaggcaaatctactcgtgttaattgaaatgatgattgatccttgctattatgtgcagggatgatcagatcatcttgaacggacttctgttctacctgggctacgcaatcatcccgaactttcgcctaatgccagtgtggagaaccaatggagccctcatcactatcttgcttcacatgggacctgtcgagttcctctactactggtttcacagggcactgcaccaccattttctctactcgcgttaccactcgcaccaccacgcatccatcgtcactgagcccataacctgtaagtaacgacactaaaaacaacaagaatcaacacaatgatatatccaacttattctctaaggtggtgtttgggaagaagggactaaactttatagtccctctcacaaaagtataagtccctcctatagggattaaaatttttgtactttagtccctccttcccaaacaccacctaaatctacaactagatgcacaaacaacgatgcctcaagaacatagttattatccaagagctttaaataggaataaataatggcaacatgaaatggcgaacatggaactgatcttcttgtttattgattgtttcagaaaaagcgcggtaaggttttagaacatttttacagggctgcaggaatt

SEQ ID NO: 88502 - DNA, 8452 bp, Oryza sativa
caggctagctaggttggtgttagtttagatctgcgtaatactgccggatctgaacttgtttaccataataagacgtcaaatgaaaatattttgattgctgatatttccggtcttctcatggcattgtcttttgctcggcagcctgaagttgctcaacgcgcctaccatgctgccatgttaccacacttcctgcaggttatttacaaatacctgaactgatatgaattgtattttgatctacgcatctggtcttgtgactaatttgttgaatcctttcagcaagtgtgctactacacggaccatggacggttacagctgcgcgatttgcaaatcagcttatcgttctcaaggtgacatcatgccagactgaaatgttacaagcatcagaccaatgctttgattctttatctgaccttaacatggcttgcagacctaaggcctgcctctcacctcgaggcaatagtgaacatccacaggagcctaagctctacagtcagcagcatggtcactcagcaggaggctcaagctgatattcctggtacatactctgccagttatttgccccctaaattcacagaatatctacatcggaaacaaaatacttcgcactgatagttgtataaggtcgaatgctgattacgctggtaaaatatttcttctgttcagttgcaaagacatcatttcaaggaactccagaatcgggaaacagaaatggagcagagaaatctgatcaggtgaaatcatacaccccggttgcttctaaactggcatataaccagtcaactgggcttgcatatggaaatgtgcacggcgtgaaagaaagaaatcctgcattggagactagaggtggggctgatgtgactgctatgccacaattcttgtgcagaagggaccctgccgatctcaatcttctgatggccctagggatctggattgcgacagcaatgaccttgaaggagagctggtaatattctatctaagcaactccattgctaaaaaaaccttgtctttgggcattcattaattgaattcggatgtctgaatcttggagctgaactagttcaagtctaatgaatgttctgaaaattttcctttgcatgtgctaacttatttttaaatctcacgcatgatgcatgtatcattctgatagataacaagcagatcatctcctcaaagtgtcttgaaaagagaaccaaatacagcgaatgatgataatagagaattaaaaaggcaaaagtccactgatcaggatgatagtaagtcttcttttcaaactgctctcctttctgattagttagaattgcaaggtcactaatgcatatgcaatcgttgatacaggacaaccagctgttgctggtgcttggaaatgtgaattttgtcactcttccaaaaccactgaggtaagtcaaatggcaaaacctgaacattgtctttttcactattcaggacatgccttggattgcttttctatttcaagaatctaatataaagttggaattaacagagtactggccctctgtcccattatctgcatggtgagccattagaggataaccaagcatggaaaccaaacgttttacatgttcatgagaagtgcattgaatggtatgctccatccagcttatgagcttatttttcctaaatgaatacataattttatttgagttgtaaaccgataaaattaagtttgtatttttatatgcttttttagactgaagcatgtttatctagctagaatatcacctataattccttatactttttaatattgaagttactgataccaatgtagggcccctcaagcgttctttactggtgacattgcaaataacttggagcctgagttggcccgtgcttctaagatcaaatgcagtgtttgtggactaaaaggtgcagcccttggctgccttgtcaagagctgccgcaagagctttcatgttccatgtgcccatgggatatcaggctgccgatgggatgatgtaaatatttctttaaccttgcactgtccattctttttacagtctgaatgcatgtctttatttgtggcacaaaattatgtgaataagtgaattcatctcatcaaatgtactgtgttttaggagaactttgttatgctgtgtccttctcattcctcgaagaagttgccatgtgagagatcaaagtcaaaaaataagaagaccagcttgcagcggtttgttctctagtcctgttcattgtaactgcattttgctataccttcatggctgcacatatccttaagttgaaccttttccctttcttgatttgccagatcatcttccgatacaatgcttgatgacctgaactcaccatctacaatccatatggatggactttggactgcttcaccttttctcactagtgaatgggttatatgtggatctgctctctctagtcaggagaaggtgattaataggtatctcttatctaattacaattttaacaggctattgcatgattaggttgtttcaaaaatgtaaactttctttgtttggaacttgacaggaaatcttggaccagtttgagcaccaaactggcatcactgtaactaacggttggaggtcgaatgtgactcatgtgattgctaatacggatgaatgtggggcatgtgccaggacactcaaggttctcatggccatactagctgggaaatgggttctgaatataaactgtaagttcaatgcctctgaaaattaagacctgggtttacctggggataatggtttctgctcttgtgcttttctaacacatccttgtcatcttttagaaattagacaatagctgatggattttgtcacttcttacatgtagttctcttttcatacgcttaaaataagttgagcatgcttaccacatgaatatttttatgcttgcatttacaatggttgctccattgtaaataccctcttctgctaggaagtttctctgattcatgttattgtgtaatatttagggctgaaagcttgtatggaggctaaagaaccagtcccagaagagccttatgagatcagttctgatgttcatggctcctttgatggccctcgcatgggaagactacgagcaatgcaaaatgtgtgtataaattcactgagtaaataagtcaaagtacaagttcaatcttcatggagtattgatcccatgtgtttcttgttttctaggcaccacatctgtttgcaggattgaccttttacttcagtggccatttcatgcccaattacaaggttcaccttgaagatttgatcactgcagctgggggatcaatcttggacaaggctgatctctctagcacatccttgataatttacagcatggagccaccacaaggaagtgatcctgatacccttaatgaggtcatcagaaagaggaaggctgaggctgaagaattggcggcaacgattggctccagggctgttcctcatacatgtgttctggattctattgcatcatgcacagtgcaattgaccatgtgatgctgtatcttaggttaggagttaggatgttactgatatgttcttgagtgaaaatatcttctagatgttgtaagttgtaacgtgagcaagcaatttaattcaaataatattgatatgtctctttccattttcttgtcggtgtcgtcatttcatatgtttcacctaccggctaccgccgggcgcagttggtctaatatttattttgcaaaaaaggtgagccttgcaggcagggttactcccaaatctgcttgagttgattggggaaacacctacttgccgttctttttctttttaccaaaaaaacaaaaaaaaacttcttggcggatttgaatcacatcagtgcttcggtgctactagtattcaagagttcctctgttcagctatggagtttaattattcactgctacagggatgatgggcaaaggcgtcaaatgattgtggagtgcatttgaaacaaagcaaggaattgaaatggctgagctcagctggttgcttcagatgtttaccaacaacagtagaggtccccttcaggctttcaagtctcaccagtcagacggtcaccggtgtccccttgctgctgttggtgtcccatgattttgttcttttcaccagaccctcgtcctcgtgcagtgatgtagaagcacttctgcatcttctcttctcccaccactaggcccctctataataaggagccagcaattgatgctatgcggtaacagtgctagctccatggcgttcttcagcagcggatcgcgggcgctggtggaaatcctgacgggattgcagaggtgcgttgctgttggttaatctttccttctctttctttgccagtgaaagcggaaatcttttttcgataattgaattcaatccagtctctacattgaggtgaaagcagaaaagttgtctgtgtgcaaaggttggctgcctgagttgtgccgctcctacatacatacatggattggttgacgcaatgtgatcagaaaactatgtttctcttgatctttgcagtgttgaacgacctatgcctgttgatcataccttgtttgagtttggatcaatccgttaccatttacaggtaattttgctccaaacacctttgatgcattatcttgcaatttgaaacaaataatgtagggcatggaaaatgatcatataatacgcatcaagtatcaaccaaacagaacatctcggcacttacaatttgcataattgttcaggcttctattacagattcagagaacatatacttgtcaatatcaacaccatctctttcttatgaggcttcgccatccagcggcttgcctgaaatcacattacaggagacaaggaaaatgtatcacaagtttgcagagatcatcgagcctgcaaaagaaggatacactttgacactgagactgaacttctctggccttactcgaccgaaaggtatgagcatcctcagtcctcacaccctgtttcagttgctgtatttggtgatagaaatattagccaaggcaactgcaggtctgcagcaaacaaggattcgatgtaagaacgattgctctttatgcagatcgcaccaaggcgatcaaccagatatcgttgctgcaatccgtcatccttagctcgcagctcaaggacatgctggcgagcctcggctcgtccggcacgatgaagctcgtgtacaaccaaagggaccctttcttcgtcagcaaaacggtactatcctaagctacgcagattaacaaaagcttcacaggtagagcaaagcatcagcacggctcgctgacgatgcggttcttggcctgcctgcagccggtgaagataagcgccatattccccatgcgtttcagggacgacacggacctggccatcgcgtcgtcgttcttccaggttgggccggcgccttctgtacgtacttttttgagttttctggttagctccgagacctgaagaaaaaaaacgacaggagctacaggacctcgggagcacgtcgtccttctccagggcgccgcggtgcagctggtcgccgatcccgccacccgagctgcgcggggagtacgtgcaccacctcaccaccaacggtggcttcgtgtccttcggtacgtagcagtagcacatatcgcacgcggcatccgcgtccgctcgctcgcttgccccgcaccgcaccaaccacgcatattctccgtttcgcccccacgcggccacgccacggcaccgtgccgacgcgcgcgttttgtgtgcgcccgcaccgcgcgatcgcgagaggccggcctccgttccgcggcgtcggtggcgactaccgacgcggccctcgcgaaacgaaacccgcgcgagcgggtgcgcggggcaaagtagccgatccggacggacgaggccgcggtgcccgcggcttgggccggcgcttcttgggttgggttgggttgggtacacttcgactttggacttttggagggttgacgcgtgcgggtttggaatttgcagacatcctggcgcggcacgtgaaggggaggagggcggctaggacggcgtggatcctgctcaatttccagtcctacgtgaaataccatatcaaggtaggatgcggcatcgcacgctggttttgtgtgctactacatgattatatcggcgttttaaatttactgggaatggtgtggttttactgacggcgagaaagttcgtgtgcgcagtgcacccgaagctacatccagagcaggatgagaaagcgtctggagatcatgacagaggtaacaactccataccatttaaaagaaacattgggtatcgaaggagtggcaattgctttaaaccgggctcgctgtgcttcaggtgatcgatgacgcgaagttcagaggaaacgatgagagcagcaagaagctgcaaggtattagtacctggatactgcaagctctcgatactggctcactggctgaccgatcttatgctcgcgaactctgatgtcgcagtgaggaagagaagcaagagaagatcaatcaaattcgcgagagccaaaaagctccaaaagggtttcaaagctgtcatcgacaagatcaagcggctgcggctgaggatcagagtgaaaggcctggaccggttcaggaggcactgccagtgcttcccagtgctcaaactgaccatggcacagaggaaggagcagaagtaccagaagctggagtgaatcctaatcaactttacgactaatcacttttttttttcacagcacaggcacaagcgtggtgatacatgcatgctgactcttatcctttttccatactgatcaagtatacaaatctggtgagtgatgaacatccattcagatggagggcactaccatagaaaaaggctaacaggaggacagacagtacacggttatttaaaaaccgttacatatatctaaaaaatatcatagacgactatattaggaattgtctatgataaaaagcatctagtgtgttttttttcttttgaaaagcacgaatgtgttttttgttattttcacttgtggccaatcgtgcattggattgtggaaaacatgcattttcacttgacgtacgtcaggcagtgacaatacctgttcgcaactgtggttgcctctacatgattattatgtaccttcagttccaagtgtactccctccgtcccataaaaaatcaatctttcgttgtattaaaatgtgtcacatccagtactaaaatatgtcacacagcaacattttcttaattattgtgtgctctgttaaaaatgaaaaggtactgagcaacatgaagcgtggatttcattaggcttctggagtgaaatatgccagcttaaatacatttaaaccttcctctcaaaattttagcataggcacctatataactctaggcagttgtgaatcataacaaaaggcatactctaatcaatgattcctaaatattgtggaaactttatctatccactggattttccgtagagagagaagaaaaaaaaacacccatctggacatcagtaactcatcacgtagaaactgaaaggtcctcacgagaattgagaagtaatcactaacagtttcctattcttattttttcaggcaaattccttcgaaataaactagtatttatgcataaatctcgatatatgattatccagatttactataaaagtttatttattttaagatggaggaagtatgcacttagtacaagcaggatgcaaagcttcttcatgtttacctaaccatcttcttagggcatgttctaaagtgtgtgtttgaagacggctgattagctgcaatgcaaaatgagaaatatgctacggctgattagctgccatgcaaaatgagaaacatgtagcatatgataattaagtattaattatcaaaacttaaaaaataaatttattttttaaaaacaacttctatataaaagttttcgcgcaaaacatattgcttagcaatttaaaaagcgtgttaacaaaaattgtgacacaatttagaacgggcccttacaagtaattgattgctccgattctaagccttcgttcacacagtattggagtagttctggctcaatcctaaaataaaccagcctcgtactaggatgtaggatgtgtctggtttattttgagatggaaggagtacatctaaggccgtgtttagttcaccccaactacccccgatttccaactttccatcacatcacatcacatctaaaactttcctacacacataaacttacaactttttttccaaacttccaactttccccaaactttcaactttctgtaggaactaaacacagcctaaactgtaaatttctttctgaactttgatttgactgcctgggggtttggattgcaagaattgcagataacatcacacccttgtttttattttttgtcttccatatcgcctcttttagtactatttcccttgcattcaacaagaggatctatcaagaagtactctacgatgcatcgaaataggaagcattcacctctcagaaggg

SEQ ID NO: 88503 - DNA, 8957 bp, Oryza sativa
tacattgtgaaacggaggaagtacaatattactaaaaaatgtataagccatgtgtcatctagttccctaggcatagaaattattatatgacagaatcgtgcttaatagttctgcttgtcagttaaacgattgctgctccagcttataccaagctttagtatgagaatggcattatgtataatccacattttagaacaccatgtttaacctaaaagccaaggtgcatcatcgaaattctgatcataaaatgtacaagctaatttgcgttctggatagactataaagaacttaaatatgagcatctactactctgggtaggccatgtatatattactgcacaaaggaaaggaaacagtacaggtaggacgtaagtttcatcgtaacacgtaaaggttattatttcacccttagagcaagtttaatagtatagcccactattagctccaatttatctatagtcaatctaatagccaattcatacaatagttgcttactatactactaatatatggtcccacctattatatacacattgcgtcttagagtccgtgctgtagctggctacaaatatgtttacagctggctaatagcctgctattgtacctgctataggctctctacaagacatccatgtcagcatattttcctacttggaagatattaaatgaagagagagagcaaaactatctactaacctagaaatagtctatagagaaaaacaatgcaatggattagagagttatatatacccatatagacataccattgaagtggtttactattaatctagcctattgctgagatgtacatgttttatagatagcaccttactttactattgcgggtgctctcagtaagaagatgaacttacttccgaaggtggcttggcccttcctctttacataacttgaattcaggaggtttccaataatttgcagcacatagttcaaaaaggaatgatcttgctgttttgtgtaccatgtcacctaccaagatgattgacagtgttaaggcatttcctctaaaattaaacaatcaaaactgtgaagtgtgaacccagtatttggtaaacacatagtttaaaatgatgttagtacaacgacacggttgccaatctcgtacattttagcacataaagttaaaaagagataacatatattatgtgtccacttgtgcggttgtgcccaacagaacaaaattaagttatttttcgcgtacacgcaacaaaattaagtcaaatgtacactacaaagttgaatggaatatgtaattgcttagtttgagctacaccacaatattgtaactgtaaatctgaatatgtaggtaactgtttagacttccaccaggtttcaaattttctaatggtagcactttaaagtaagaaattttagcataccatgatacacctttttattgcttttctctgttgcttcactaggcagacgaccactctgtgttgccaacttgggttgattgttccttccattattgacatcatgtttgccagaccctgctataatttgattgtggaatttagaactcctagtgaaagatgtttctgtattttgaaaaggtatgttctcttcatgtatatgtggactcttcatttttacagatatgtcagcctcaacatcgattggatcttcattatatcctatcagttctgattccctcttcctggcaacaatcaaaatctcctcaagggacttgtttctgtgcttataaccgtaattctgcataatttacaaaaggaccagtaagctggttgtggcatgcattttaagaaacagggtatttgaatggacagattaacacaaacaacaaagagatattgtgtaaatttggcaagttggactggaaagcaatgaacacaatgaatagtttctttccaatctattaaatcaatgatctttcacattcatgtcaacaattaagcaaaataaaatagatcgttgtaatggctgaggttctgatactcacattctaataataaaataaatagtgttcccgcaaaaaagtaaagcaaatggaaaaatcacaaaaaatatatcttctgtatagactacagagagtgcttcgtgcagctaactgaaagcaaagcattcgtgttgcatggtaattgcagaagaaaatgctaagggaacaaaattgtaccttcagtttagaaagtgtttcttgtgcagcaaactttctagcggcttttgaattccgatttgctgcagtacaaatgataattttgctctttatgttaacttctactttgacatggtactctccatcagctttcataggtttcggaaggcctaactcaaatccatgacactgacaaagctctcgaagttctctcatcggattagtgtgcatgttggcgaaggtcaatactggctttagaagcataagcattaccttccaaacatagttcaggttgaagcctgaatctaaaagcactgcgccaatacaagattcaacaatatcaccaagagcctgtattgttgtagataaaacttataagcttttgccataaaaaaaatcaatcaatcaattacatataactaattgcttacagaaaagatcacaatcatggtaatgagctatgattaataattctctaatacacttgcaattattgataacacttttgctcattttgtagaacttataaatctcccctatcatattgaatattaaacagtatccttgaggagtactccttccgtcccataaaaagccaacctagtattggatattgacacatcctagtactaggaatctagacagagacatgtccagatttgtagtactatgatgcatcaacatcaagtactaggttgagttttgtgggacagagggagcaaccacaagaccatggtctttcttcctctcggctaaaaaagggttactacaaaggtgcagatggaaaaaaatctctgcattaacgtcaataccttgggacatgctggttcttcaagcaagtctttctctgaattggagagcttcacatacatctcaaatttacttattgctgacgtgagatggtttgaatcctttataagatgcttatggatagatttctcaaccgccgcataagcaagcgaatcattaccaacagctaacgatcttagatctgttatttgaccaggttttatatccggataagtagagtagaggtacgaagttatcacatactccaaaacagcgtctccaagaaactccagtctctgaccagaaatgaaaagaacatagcaggtgagcaactatcaagaatcacagcacctgtgcaatcagagagagagagagagagagagagagagaggggcaactctgacctggtagcagcctccagaatgttgactaaatgaagggtgtacgaatgcttggagaagtagacccttatgtttgaacttgtaacctatcaattcttcaagcccggcaatgtcagtgtagtccataagagataaattgatggagcttgaatctaataccctatagagagctggattattaaaatcaacgtctattccaatccaatgcaggaaagcaaatgcagctttgaatccaccctcaacaagaaatgctccaataagcgattcgacaacatctgcaatcactttcctatgcagccaatgatgtgaccttgtacatctcaggttacagttttctctgttatctggatgaatatccatctggtgtagtctcacttccacgtcagtattgcaaacaactttacaaggccttcctggagcaaagaactgagtcggttcaaactgttgatcccgtatgtatacctaaatttcacgagaaagcattgctgattaagaattttgcaataaatacttgacaggaaagttgtatcttctacagcgataaaaggaatccatctaaaaataaacggaaagggaaccgttgtataaataagcagacaaaattaatagatcacaagtgtcacaaaatgtttgtcaatattgctactacctccgccccaaaatataagcatgtctagctctgaatctggacactagattcagagccagaaatgcttatattttggtaccgaggtagtagatcataatgaaagagccagatagtgcagaatatgatgattctggtagaattgtagatcatacaacttagcaataaaaaaatgggttcaaggttaactaacctgcaatttttttctgatcgataactcatataaatgtgaattgttcactacatcagaacgtctcctggtcaattgcccttcatcaagtccttcatatgtaataaacttgtgacgtccaactacgtacttcaagaaagcatcgcctaggacttcaaatcgctccaaagatatcctctccaaacatttctcagtagtaagcgcttcaagtatctgaaatgaacccgtctaagatcacaactattttcggcatggataagcaaattcaaactagatgttcaggatcaaaggtacaaaagatggtgcaacttacaccagaagcactaatttgagatgcctctggaaaagaagataacatcacatccttcaactcaatagccaccagcaaattctccaaacgatacattaaagaaggtaacaaggacagggaactgcccatatcttttgaaaacccaatgaccttcaaagagcataattctggaggtaactccacgaagtgctctagtaattcacggccctccgattcttaaaaataataataacaaaagatgtaacaacattagaagtactatacctggatcagaaccatgcaaagattcacagcagagtaagatattcaaaataggattcagtaatgcattgggtcccaagattataaatgtactactagtctactatagtaatcccagtatacaaaagccggagaaggaaataggaaaaataacagatccaactgattcccaagcagtttccaaactctaaagcaatccacaagcagttcaataattttgaaacaataaataatagaagtttacaaagcaacttctccgcgacatatatgtagttatataaaatttattatgctctttctgagctgtggtctaatggatgacaaaacattcttggtagcataatgatatactgattacattttttatcatgtcataataatcagaagtaatgaataaggtgtcttgttacggtgggacaacggaataacctgtggtctccggtaaccgattatgaagcaaatttcgcaggttgaagatctgtttagccttcaaaagtggctgttcaggatgtgatagctcaatacgaaacctaattaatgcataagttcatcaggacatgtataaagctcttaaacttgattgtgttgctatatctaccttaaagaatgctcaatagaggtattgcaatgttgtactttatttagtaaaatcccattaaaaaaacatgtaaaccaggaaggtgagcacggataataattgacttattacctttccttgaagtgttctgcataagttgcaccactgtgctcgctccaagcatttatttcgtccagaatgccatcaacaaagaaaaagatattgttgtggggactaaagactacactgccaactacatcggttttactgaagattccatcaagaagtctcagagactcatttgatgaatatgaggcatgcacagacacatctatagggtctttaaaaatcggtgatgataaacagcgctcaactgctggccagtcaatcataaatctatcaccataacacttttgcttgatgggaagcagaaggtaaaatgttgaattgatttctaatgtaacatcattgcccaatttaacatggggtgaagtaaactcagatctgtccaggagaatcttcagacacatctcttgaaacttgtgtgcaagcatcatctgaaaataaaagaatattaaataatatccaacaaacaatcatgtgttatcaattgaacagatgagcaggatgatgccttctctttctcaaatgctattttccccaaatgcttaattcctgctttcacaatcctgccacgagcaagatgcaaatcaacttgcaatgtttcagcttccacaggaaggggattgatcacaaagagaccaaacatctgatatcgcctatcttctggtatgggaataaatttaacatagtagaaatgcaagttcgataaagaatccaactttaatcccgaaggtttgagaactgcaggaattaacatctcatgaagctcttctcttagactatcatctgaaacaaggaaacaagagttaagccagagccagcattatgcgcttatggtactgtatgaacaagtgaaaataccttcaactttgttgtttgatgaattatttgttactgatactttattctttcttgaacctggacccggcagaagaaaatctgtcaaagcacccaatttatgaagttttacgcatgcctttaagcatgcatctctcttagcttcatcttttgacagacatggttgaccatctgcttgacggaaagcagcatttggtggaagaattagtctgcagattattccctcgatgccatcaatgtagaagaacactggggaaggagtaaaaaaccttcataaaaaggagttatattagcatcgcaaagaactaatcaataaatcattgtcatggcgagttggtgacagactgaagagcaaaaaaaaaaaatcttgacatacatatccctaggaaggttgtcgcagtagcaatgtagtagagatacactacaagcagtgctaatggaagcaccggtgttatccacttgataaatgttctcctcgaggcaatcaaacatatcatttgaagttcttgagtctatctcttcattcataatgctttcaccagcaatataaccattaagcaacttttcatgagactgattttctctggcatgtatcaaaatgagttaggtcttggaccataattaaggactaaaatacagttgaatcttacaatatgaataacacttatacgtaggggaaaaaaatcacctctctaggagaacaacgtatttagatttagtcatccgggcacgcccccttgattggataaaactagcaacagtttctggaagatcaaatcgcacaacaagacaacacgtctgaatatcaagtccctcttcacctacgcttgtagcaaccaaaagattcacctgcaaacatcagacgaattttgatgcaagaaatacaatatatgaacagcataatttagattcaagtggtcaccacaattactttaccagtatatttcttaaacatatgaaatataaaatgcagaactaaagaccttaggcccacacattcaaatgaaggattatttgtacactaactatgctatgaaatcaacgaccttaggcctgcttgaataaaatcaacgaccaaaacaaccttatgtaattattagtaaactaactatgctatgaaagtcaataatccatcccttttgctttgagacaataaggatgataacttaaactcagtaagaaaaaaaaatgaattaatgcaggctgtcacatattcaaaatacatagccaaagaagtgttagaagaaattgttaaaagaaaacaaaaaaagaggaaatatcatgaaaggaatggttattaattatacctcaccagaagaaaacctttgaacaatagcatccatcttattccttgacatgttctttgatcctgagtggcagcccacaagaaactcacatttccaaaattcaagacacttcaagttttggagaatgtttgatattgctcttgcaacagttattcttttcacaaaaacaatgcatttcatgttttcctgcaacctgtttacggaagtggtcaacgcagaagaaccagcatgatcagaaaagacacagaccaaaagtttctggaagctataagctaaaattgagatgaacaaactgtttggttctccctaacacttcaagtggaaacagctaaatcaatggaaaacctaaaaaataatggcattggtaggagaaggtatgttcaagaaagatatgataccaaacataattacacttacccgtatctcgaaagaacattgataagaacagaaaatttatttgagaagaaaggttcttcaagcttctcaaggtcaaatgaaccagcgtgggaacctaagaagcacttcttgtcagattcaatcattttttataaaaacaaatgtatatcagctgacaattatttcatcacaagtcctctgaagaaacaaaaaagaccatatccttacaattccaatactgaatgttgtttaaaaaattgagcagccctaaaagcagaccctgccaattctggtttttttcagatgaaatttcgcactttttccatacaactctcactctgattttcaacccccaaccacagtgtcaggtgctatctccaacgatagattctatgcgtccaaggcctggtgtaggcactctattacaatagaatgagcgatgccatgctgactgtagcaccatgacaattagttcccttggagataaatagattagtactatctatttccatatgatattaaatagtagtttggtacctaagtgtcagttaagaagtttatgggtacagttaggaagttagagatatggtttgttagggaagtttagattatattcttaaagggtaacgttactgttgatagaattttttttccagggaacaaactaaatatttgcatatcattgcattaagggaaagaatgttaggttacaacccctgcccagctgaaacagccagcaacaaccacaagacaatcacatgctgactcctcgcaaaagaatgagcgacctaaactcgctaagaacagtaggcaacctgatggaccaatctagatccagagacggaaacattacatgaggcactgtagcagcatccatgttatgtaacccaattaacattaagcaaagagatcaagagttgaactaaacccagtctctaccacatcagggagaagccctgccattag

SEQ ID NO: 88504 - DNA, 2535 bp, Oryza sativa
ctcatcaggagactgtactcatgaggttagctctaatggaaacaagtttcattcttgtgtgttccacccgggctacaccgatctccttgttattggaggctaccaggtaattattctaaaacatggatcttagtcatttattggcaaaacatagcctacttttattaggaagcagctgttgtaggaacaacttgccatgcactgtcatacttgtgtagtggcgtaatttctcagccacaaaaactgtttcattgccaaccattgggaaaagaaaggcttaataatctatggttcgcggcaaaatagaccacatgcaacaaaattaatgttagcttcgcttgtaatgatcaaatctagttatgttttaattcaaaacagcgcctccgatgactttgatctttgtcgcttatttatttctgatgaaaattgcaatgatgcagtctctggagctatggaacatggtaaagaaccagagcatgacagtgcaggctcatgaaggtctaatcgcggcgttggcgcaatcaccaattacagggatggtggcttccgcgagccacgacaactctgtcaagctgtggaagtaacaatggctgcacttcggtaacatagtttcttatagttagttgaaagtttcttcagccgaggcatagaatgggtcacagccgaaagatgctgttgttgttgtactgtatcgggaggcaataaaaggatgtcgaatttgaaccgttcagtgctcattgcagcgagattgtgggagttgcatttattatttatttatttatattaataggtgttggtgtcgcccaaaatgatcaaagaagaggaaaaggaacgaaggccatagtaggggctctgttttattttatttatttatgttatatgaaatgtaaatggtaacgtggtattcacaatatgtatggcgattgatgataacaccagagcctcgttgttctatacgcctcagcctcagactggaaatgtttagggcttgtttagttcgcgaaataaaaattttttagtatcacatcagatgtttgattggatatcggaaagggttttcaaacacgaattaaaaactaatttcataactcgcccttttaagtttaattaatccatcattagcacatgtggattactagttatggttaatcatggactaattagacttaaaagattcgtctcacgatttcccccctaactgtgtaattagtttttcttttaatcttatatttaatgctccatacaggtatccaaagatacgatatgatgtttttgggaaaaacttttagggaactaaacaggcccttagtgatgatcacaaacgaagttttctacgtctttggtaagattcaatcaatcaggtgtatgtggttgaagaaaatatttcatgcatccagcaaccatcagatcaataaactggtgggtatcatgcatgccacagttgatgctcagatatgatgctggtacagttgattataaccctatcttcaattgcaaaaatgatatccaacacccccaaaacttgtttcccaacagtaacaatgtagtgcctacaatgatgagtagttggacaacgttgtcatttagtccctttctttagctatcctcttctcctttctcttttgctctcgtgtacctatagaagaagaaagatcagaagaaattaatagataatgctgacagacagcggacatctatttaacatgtctactaaggtgctacaatctgcagtattacatgcaagccaaaccgtacggacatacaaagatttttgctgttcaacctctatttagagtaagcttcctaaagatgcatattcatcactcatcaggtagtttgcctgcttcctaaagaagaggggtagaagaaagcttacttttcttctctttttgcttctttcgcctccaattttcagcaagccttcgcttttctctttgcttgtcaatgctcacacacacctggaaaaatacaaaatcactaaatagataagcaacaccaaaatataccataccataaatcccaaaaatgatgctggccctgaacagaaataaataatcttgtagaaaaatctcatttgcacaaacctcttgcccagaattctgaagagcttgcaagggttctatttgatcctgaccaataacaacaaatcgggatcctttatttgcatttacactagcactgcccttaacattccttttggacaactcttccagttgcttttgaagtaacggtgaaacaccagcctgaataattgttttagtgattcaagtcagataagttgatataagatactatagcagttccagaaacaagagctgtgccagtaaactaaccccagctaaatagcgccgcgaaaaagtcttaggctgcaaggggcgttgcaagagctcactcaaatcctacatcaattcacagaaaaatatgttgaaatataggacaaactatgaatacctcataacaacttggttttcccaaaaactacactaattatataaccgaccctgctataatattgtaaatcattcaaacctgttg

SEQ ID NO: 88505 - DNA, 2524 bp, Oryza sativa
aaccggttttacggttcaaggatgattttataactcgatggcaagttgagggaccttcggtgtactttttccaagtatggcaggctaaggaaattcttggtccaaccgttcaggtgtgcattttgcagcccatggtcccatcgatgcctcgttaaggcagattagtcccaatagataggttggttggattaagttggatggaatttaataaacgtggaattgttttttataatccctctcaaaactattgagaaaaattaaccgaacaagagagaagagagaagaactctgggtagaaatatgagatatataatatacagagttacatgccaaggtaggggacatcccattttctttcaatttttaaggaaataataattatacaaaattagtgaatataacgcgctagacttacatgacactcatccgtattaaaatataaaggattatatcctttaattttatctcataattaacggattatatattcccgagataatttattcattgcatatatcatcttttgtacttttattccccacccacgatattttctactagaatatttccctaccagcttttgtactaatttattcttcaaccattacattttatacccataagttacttgaagtttgatattttacctcataaatcatttttgttgcaaatgcctacacacctacttagttctgttgcaaactgaataatacgtgggcatttacaacaaattgatacatgagatgaaatatcaaatttcaagtgatttattgggaggatttcgcaatttcccctttatactatgctttgtcctttttccactttctcacttttgaaaaaaaagggagcatactctcttctatcatccggtggagggagtactaatcaaaatacacatttagtaatgcttacctttacttcaatcacagaattttatatgtcaatcacactttcaggttacagacacatttcaataatcacatggatagtacataatgtatgttccaaccggtaaaccttatttccattgttttttcagatggacaaacatgatgtggctatagctatagtccacacaacaacacacacaagcaatcaagcacatcccaggtcccgggacgatgaaattaggaggctacttctgcttctcatgtgcctcccttctctgctgggcaatcgactcgaataggctcccatcgaagcagcggcgaacagcctccttcctgaggaatccttcctcatctttcgcaagcacgtagagcaatatccactcccccttactcgcgatcctgaacgcacacatgcatgtatttacaccagcaattcagcatgcagaggtaggaagcattcagagaacgaacggcaaagaaatcgctaggtaagtatcgttgctgcatatataggagtgttgatcagctgttctcacctcccaagcaagtcgagcgccaccctttggccttcggtcatccgccagatatcgccgaacgtgagcttgtccggcgccgtgcgggcgttcttgctgaagatgctctcgaaattgaccggcataaacctttcgtagtttcaggacaaaaaaggcaatgaaatgtcaccgtgtaagtactggattattacaagtctacaacaactagcagtgtgcaatgggtcgacgatggtttaccttccctcgttgtcgtacgtcgagctatcgctgccgtgcttagccctgtggatgttttttatgtgtatagggaacaggagagatggtatccagctctgcacggtcgatcaaattttcaatgtctagtgcagagaaatgtataccatcttggcatcttcttggtagaaaccccaaaaaaaaagttacttttggacttactggcagagttgggtagcttagaccaacgtttatggctatcgccaaaaagaacgaaacaatcacgttgaagcccaattcccgtagtcctgtgtaatttttacaccttttcatcaaaggttttgtacccctcaacaagtaatgttcggactaatattgtgaaggtgaaacggagataccgccgtgacaacaaaagagacgtatgaatactgtagaatatgattctatcgggctgaatgatcttccgatatatacaaatattttattcggctgaacaataatagccgtttaatttttttttccgcagcaacaatggagctatatgttttgtagtatgtacctccataagtttcccatggataaacgataccgtcgccatccaggtcgaagaaagccacatgctgctgcagcacactcatctgccggtggtcacgcccctcggttccttcaggatggtacacgtccggagcaaccagagctcgggccaaatctgcgatcagaatcgttgttcagccgaattcagaactagaactagatcgacagacaaaactaaagctgtaaccgatctcatcgaggcaaacagatactcacagggcttcggaatctgcacttccaagtccgctcggaccggccgttctctcgtcaccggcgcctccgccgccacggacg

SEQ ID NO: 88506 - DNA, 2746 bp, Oryza sativa
ggtgtccgtgccgcctgcgatgctgggttcccgggtccaatgcggcctaaatctaccggcggtcagcatcctgttcgcgttggtcaccacatatatatacctctcctcttcgtcgtagcagcccaccgcaggttcaccgaccccgcctcatcgctctcccctcatctagttagtctctgttcatctcccatctgcctcgtttgcaagttcaagacctatctactacctccgtcccaaaataagtgcagtcatggatatccgtgcccaacgttcgatcgtccgtcttatttgaaaattttgtgaaaaatttaaaaatatttagtcacacacataaagtactattcatgctttatcatctaataacaataaaaatactaatcataaaaaattttcaaataagacgaacgatcaaacgttgaacgtgaatagtgcaaaactgcacttattttgggacggagggagtagttattaagccgccgagccatcagccattgtggtccaccacccggtaattttgagcatctgggaatgggagtctaggggcataggggaatatgtctgctcatgcgattaattttctgaaaataccgtacattaatgcaataggcatcatatcttacaccaatatggtttgtgaattgggcgaggagtaacgtttatatttttttcagccatcatgttatgattcattgaacgaacttatagctagtattacacagatttaggggaaccacaaaggttgtaccgctgaaggacattaagctaacggccagtagagttcttagctcttcttctggggctatctgcactctcaagcatgaattgctaacctcgattcttggccatgaacgtagtttgactttttgcatctgaaaatcaatgatacatgatttggtagtatttatacctctcatccatagctgcatgtacataactgagtactgtctattgttattgacttgagtatatgatttttctatctgtttttccttccttttagggctcgaaaatacaaactctggttgacgaggcagtaaggatatccagcgttctttaacactgcactcaacattgcattgttgcagtagcatttaaaggtccgttccagaattcagagagcaaggttttgtcagaggtttgaatccatgcttaatagctgccgaccaagtcttctcaatggtcatcatatcatctccacattcatgcatttcccaaccttctaaagcatgcaatattccagcaatgcgccatgcactcatcacccttcttggcagccaattctgttcatacagccagtagtatactcatgtcaatgttggtaaatttaggcatggagaaatagttggtatataacatatgggcccattttgtttagctcaaaatacctcacaggtgtggacattctgcattgtctctgggatcttcattgctgggttactcaagtaagtgcagtccttgcgtgccttcttaagggggaactgtgacgtgggaataaatatagttccctttggtgccctcccttgtgcatcgtctatgctatctcctatccaaatctgttgcaatgggagtataatcatgaatataataagcttgcatgagtttttttttcttggttatctcttttatgaacctctgtccacaaggtatcctagctgttttttttttgagatattaaggatgaaaggaagagatgcatgtaccccctcattaatgatgacggatgttaggggagtgggagggtggtttgggggtaaaattgggtgaaaattaaatgactggtagttgggtgggagaagtagtactctaaggaccccttaggtcaatcctaacccaagacactagacatagtttccataaactccgcctcatcaagaactagtactagacactactatttcaatacaaacaccaatattccatacttaaatttaatgctacttatctcacatgatgtcttgggtgttgtgtagaaactatgtttcatgcaagacataattttcttctctttcctcatttattcacttgacacatcatttttcatcataggtgctagcttatttaatgctatggacatcatcctagtcattgggttgggaatggtcttaaagttgtggacaaattttgaaggagcattaaagtattactaatatacatcacccactaatttactcgtcatttgatgcaatcccaatagtggttatataatatagtgtcacacatatgggaactcgtgtgatagcatgatgcatgaataacttgtttgaattcttttaacaaggtttatagttgagatttttactagcctaccaagctccagtagtgtctatggtaccacagtactatttattcaccaatttatgcttcttgaggaaaactccctccttattttacctgtggtgtttcatcattagagaatttcagatagatagctctactctctggaactcgagacttgagcattccatattctttctcttgattcaggattacctgcacaaaaatatgtggaatagtctggattatagcaagatttataacccaagttttaatacattaagataatttaatataaaaaataatctactaaatgattataaaaatgtatcgaacataacaaagtgggaggctgctagatttacctggacacctctctgacataaagctatggctgttgcacgggtcaccttagaattacttccacagagaaaaacttgctttgtaccaaaaggtatgctattgagcacca

SEQ ID NO: 88507 - DNA, 1222 bp, Oryza sativa
ccgggactaaagatattttcccgctatttccaaattctttttaaacccggttagggttaagaaccgggattattgataagcgcactgaatattattttccattacatatgtgtttctaaaatagaagataatgcattaaaattatttaacgtacaaagattaatattaatgacaattacttcgaaaaattattgttgtctgtaataaattaagtggataaaatgtaataagcaaatatatgatttaaaattaataaaaaaatctaataatcatatatacttagacaagtccgagaatactgatctctttgacaaggtgacaaagcagatgcgtcattatattgaaaaatgaaggtggaaatatcaactcaaaactgacgagacattgcaccacatcattctgaagggcttctaatctatccggatcgatgaccttctgcgaaattgcattcatgaatacacatagctttgttattattgcccggacattgtctggaaggataccccttattacaactagtagcagttgtgtcatcaacacgtgacagtcatgagactttaggtttgtgaacttcttctccttcgtgcttattattcgcttgatattcgtggagtatccagacggtacctttatgctctccaagcattcaaacatactttcattctgtgccttgctaagagtgtagctggctggattcaagtaatggcttcctttctcctttggttccgggtgaaggtcgtcgcgttgttccatatgcttcagatcattacgtgcttccagtgtatctttcgactttccgtatacacctaggaagccaagaaggtttacgcaaaggttcttagtgaggtgcatcacgtcgattgcgtggcgcacgtccaagaattcccaatagggtaactcccaaaatatagagttctttttccacatcgccgcgtgaccatcttcgctctctataggctggcttccaggcccctttccgaacactactttaagatctttaaccatagcaaacactgttttcccgctgcgatgtttaggcttcgtacggtggtcagccttatgttcgaagtgcttgcctttcttccgtaccgggtggtttgctgcaaggaatcgacgatgacccatgtatataaccttcctacagtgcttaagatacgtattttctgtttcatccatacagtgagtgcaagccttgtaccccttgttggactgtccggatagg

SEQ ID NO: 88508 - DNA, 551 bp, Oryza sativa
ccaaagcatccaggacaaacacgagggaaaggggtgattccttggaagattgggttcatggaggacatccacacgtacaggagtcggatgaggagcaagagaggtactgaggcgaagattgcagatctagagttcagggtatcgagctacgagctcagcatgcaagaggaggtggcaaggaagatcgatgaacgcatggccgcacatcggtcccatgatccccagccgaccattcctcctgtaatggtgagcccgtcaggaaaccgtagcagctgcgcctcaacggggcaggtaggatcacagagcatggacgccatgcaaacccaggacgaatccacctgccccgttgatgacatcactcagcaggcaccatgtgagctgcatattcctttcaagaacttatcaataaaggtaagctcgtagtttatatattttagatttggtcattccgctagttgctgcttatatatgttgattactaataaataacctcccaacggacccttcaggtacttaccactacaggccgattccagcaggatactccaagg

SEQ ID NO: 88509 - DNA, 2746 bp, Oryza sativa
tatttggtctgatgaacctccagaaatcaaggtgtttgtagttctttcagtgttagaaatgattgtaggtcatatacaaatcgattgaagttgggctctttcagaaaatgaaatggtggttaactgattgtctgagaacaacagttatataatatatttaccagaaccgctaactttcttctcattgtaaacccccgaatattttcttcaacctcaatttgatgtattcagtaattttggaaaaaaaaacacttatagttgttcatcattttgtgggagatttcaggaatgagcaatgtaggcgactactgtcttgttgaaatgctaatgctaaccttatatgatcaaatctttacaggtgactgtgccacaaggctctctttgcaacctgaatctgaaatttaaggcaggattacctccagacgcagtttacaacattataattgatccagagaacaaaagagttttcaaaaacatcaaggtatgtataagcaagttcctgaatagggtaacaggaaacatgaaggctcattcatcatgatattgtggcacttgcttgatttccctgatttggttactgataccaaatgagcagaggaattgctctagtatcttaaccggccaagtactcgtgagaaagttcttgttccaattttcaggaagtaatatcacggaaagtcgtgcttgatgaaggacaaaggcaaatagttgaagtggagcaggcagcaatatggagatttctctggtggtctggtgtcttgtcagttcatgtttttgtcgaccagaacagaacaaatcacactgtaaagacttgaaacattgctactagtctttgagaaacagctaagatacattctctgatatgtggcttcatgcaacaactattggcaggtaaagttcaagcaaggaagaacaggttttatgaagaaatttgaaggttgctggaaaatagagcctctatttgttgacaaggaagcatgccatcctttagacccatgcacattagaaaagtatgattcctgcaccaatggcacaggaagagttggatcttcaattaccttggatcagcttattgaacctgatatggtacccccgcctccgttttcatggtatctgagagggattaccacgaggacaactgagatgctggtcaatgatctgatagcggaaactgctcggctgcgaggtttggcaaataatgctattgacaagcaatatgttgagggaaagtgtgatactagtagagatcatctaacagaagagtgcaatgatattaaggaaagatggcgtcagagaagaaaaacaggacggcatggaaactcccttagattaactgctcaaggataaactaggcattttcgcttctggacaggatgcattttagggccaatttacctgtactccaatggtaggtggttttcattgtagaatttgatgaattgcagggtattcatattgatattttgtagatggctaataacatcatgtgactagtttgtggactgtttcacacgactctttcgtacagtaataatgtaaaatggatgttcagctgtgtacaattgatgaggtgaataattgcccagttaaaatgtctgctactgaacactgctcttccatttctaccatttatctgaagcacagttttttttaacgaaccggccagcgccaatttgttcaaaagaaaaaatatatgtgcatcagactgaagcaaaattgaacttacttgaacctcacgacagttcaaacatgataagtatgcctgacacaacatttttatatgtgacaatatgaaatcacaattttggtacctcttttcacgaaaaaacatatgctaaatcggtgactgaaaactgaagctagatagaacaacagataccatttcctgagcctgaagtcctgaaccaaactgacggcaaactcaagttcagttgacaacacaaaccagttcatcctttctccaaagctgcaagccaagaaaagccccaaattccttacctttcttgacatgctcaaggcaacagcaaacaccttccttgcattgcatgagacttatgaacctaaaactctacatagcttcatggacagttcaaacaccttcgatcactcgatcgagctcgtcgaccccagccatgtccggccagcctccgccgccgccgtcaccggcgatgccgtcgcagccgcagccgtttcgcttctggctcccgtataggagcaatgtggcgtcatcctctcggcagcaaccgcggccatcgtcagggacggcgccggcgccgccgccaccaactccggcagatcgtccgccgagagcgtcaccggcgccggcgcgggcaatgggggaagatatctctgtccatggtgagtcgtccgatgaatcggacacgatccctgtccagagcgtggactcgccgcggtggcgcggagctaggcggcggccgtccgtgccggacatggagctgacgctctcgaggtcgccacgcgccggcgaggaacggaccccgcgcgccggcggcgaaggcggcgaaggcaacgacaccaagatctccatctccgggttcccgaggtcgcgcctgttcgacggcgcgcgcgcgccgtaccggcgggagatcgaggacgggctcaagagccttgccacccgcggccgcgaggcgccggcggcgagcgcggacggcgtccaggggtaccgcgtcatcacgctggccggccacaacgtcggcgcgagcatggttctcggcggcggcggcgg

SEQ ID NO: 88510 - DNA, 521 bp, Oryza sativa
aattcctatgttcttgtttggatgggctcagtttggcccatataaactgatgggccgagattgaagcccatcaagcaaggcctgggtggggtaaggcgtgtgtgcatacttgtacaactgcgtcgttgaacgtaacgctccccgacgacgtctcctcgacgattcggcgcctcagtgcggcgtttttggtgaacgcgtagacggcgagcggcctcggccgcgctctcacgaaggcgatgctgtcctctatcttcttcacctgtgagaaaggtagccgtttcatttgatctgtctagtggtactccgctctgcatagaggaggatgttaagaactttttaatttaccgtgatgatgggcaggagagggccgaaaatctcctctgtcatgatcgcggagtcgagtgggggattcagcagaatcgtgggctcgatgcacctgaaattttttcgtgagttggtcaactttgggttgtcttaccgacagattgatcaacgacacgcagttttgttcagaatttaca

SEQ ID NO: 88511 - DNA, 693 bp, Oryza sativa
atctagagcaacatattgaacttcagtttttatgacaacatatttttcccaaccaatatctccagaacctgacaaaaggagttggttgtgatgacaaggcctttacccatcgcatccatttcaaaccatttttttaaggatcatttgtatatcgtcacattctccgcagatttcatattactagtgtgaacaatgttgcaagttttccacatgtaaggatagaacaaaatagcacatttattttaaaatccattgcaaagcttttggtgatatgatatcacaagtatctaagtagtatgggagactcaatttaggcagcagtaaacttgggctttgattaaccttaccctgaacagctgctccaagtgcaacaacctcatcagggtttacagtcacattgggggtcctttccagtcattttcttcacaagatcctgcgcagctggaattttggtggagccaccgacagggatcacctcatctatgtctttaaatgacaactttgcatctctgagggcattgtccacaggggtcctcaacctagaagacagtggataaaacattagcagtgtatcattttttttctatttttgagttatcttaatagaactaattcatcatacatacagtagttgtcaagtgcatatacaaaaaaatacatgcatgcccttggttaaatgagcattaattagca

SEQ ID NO: 88512 - DNA, 611 bp, Oryza sativa
aagaaaaattatcaatttaatacactttacttctttcccaactactgttgagtgaccacgtctttcgacgtatgcggtagtcgtttcgacaacagctggcgccgaccatggggatttccgagcgaaaccactgagagcaaatgccaccgaaaagggtcgtgaaggagaaggttacaaggcgaaaggaaagcgaagccgaggtggagatggtcgccgaagagggagcagagccttcggcgccagttgccgaagatggaggagcattgtctgcctccgcacctgcaccatcactactgccttcggctcctgccacctctgcgcaggtgctgaatgcggctgacatggcgaaggcagtcgcggcggtaagggcactccagaccaggcggagatcctttcgacaagccaactgctggtgctccaagccgctccgtcgcagctggcagcagcctcgattgcgctcgccgctgtacaagcccaagtcaacccagaccccgaaacacaaatcgaagccgacatggaagccatgcgacagaacatgacacgacttccagacatgctttggcaaatgcaagaacagcatcaggcgtatcaggcggcgaggcggtccaagg

SEQ ID NO: 88513 - DNA, 647 bp, Oryza sativa
attcccacacggaaaggaataccatttaggttgtatttatcggctggtgaaaagtcaatcggctcagttctgattcaagaattggaagggaaggagcgagttgtgttttatcttaatcgacggctcttggatgctgagactcggtattcccctatggagaagttatgcttgtgcctttatttttcgtgtacgaggttgaggcattatctattatctaatgagtgcactgttatatgcaaagccgatgtagtcagatatatgctgtcgactccaatattaaagggatgaattggaaagtggatattttctttgactgagtttgatcttcggtatgaatcaccgaaggcgattaagggacaagctatagccgattttattgtggaacatcatgatgattcaatcggctcggttgagatagcaccgtggactttattctttgacggatcggtacgcactgatggttgtggcatcgacttagttataatttcccctaggggggcatgtttttgagtttgcttatactattaaaccatatgcgactaataatcaagctgaatgtgaggcagtgcttaaggggttgcaattactcaaggaagttgaagccgatactattgaaatcatgggggattctttgctagtaatcagcc

SEQ ID NO: 88514 - DNA, 578 bp, Oryza sativa
ttgatgctcctgggttctcattcaaatccaaagggaaatttcagtcatttccttttcatcttcaactatcatattgtgaagaataatacaagcttacattatgttgatagcatcacccctctgtcacatccgggctggacgacatacgatgttaaagtgagactgcaacacaccaaaggctcgctcaacatccttcctctcttcctcttgacgggctgcatataatatatcttcatctgtctgagaaagttgtattgtcttcacgaatgttttccactcaggataaattccatcagcaaggtagtaccccgtgttatattggttcccatttacagtaaactgcacacgaggagcttcccctatcaatgcatcaatgaacaacggtgacttgtttaacacattgatgtcgttattggatcctgtagtaccaaaaaaaagcatgctatatgcgaaggtctttcgatgctaccgcttagaggatcatggtaggaactcccttgtcaccacgagtaaattggccgcgccgagagaccgggcaattttttcatgcccaatgcatgcagtctatacttcctaac

SEQ ID NO: 88515 - DNA, 603 bp, Oryza sativa
gttcatgggttcggaagaaatgctattaacgtggagattgtggtagggagcatgctggtaagggagttttccttcctcggatacctctatgccttttagatgatgaaatgttcccgtttcactttaagagaaagttgtttccaattagactatgtttcgaattgacgatcaataaggcataaggacaaacaattccaaatgcaggcgtctacctcccggagccggtgttctctcatggtcagctctacgtcacgttgtctagagcaacttcaggaacaaacatcaagattctctcatgcaggacaaagagaggaagaaaaacaaacggtccaaacatactacaacgtgcacaaagaatattgtgtacaaggatgtcctcatagcatagacgaggtatatctagtgtgcacaaagaatattgtgtactaactaattatctttgcaatttttatattaactgttgaaatcattacctactggaatatcagtcaaacttatttcatatttcatttaccgtacacaatggtttatcacatgcagttaaacatgatagatccggcatgcatttatcacattctttttttttcaattattgttataact

SEQ ID NO: 88516 - DNA, 2488 bp, Oryza sativa
ccttgcccaccgaaagggggggacgactgagagaaaacctgaactctaggagaagaagggcaagagagctctccggagtgaagggatccttgtaacacttaatcataatcccaaacacaggagtagggtattacgctccacagcggcccgaacctgtataactcgattgtgtgtaagatagccaggagccttagtggcggatacgtgatttctgagaagcgagcctcttcccccggccaaactcacgaaagggggatctcacgacctcccgctatcgagggccttccctcgacacatagatttatcaatattgtacaaattgtgcctgcatcatcatcaaaatacaatgtcaatcagtcttttcatcattagagttattggatccagtcggcttgaggtcggtctcttggaatctctcgactacatcggtggctatcttgtcaggagctttttgtgatcactaatgaggtcgagggcggcttcttcacttgtcccgtctgcaaagccatcgacagcatcaatgtcaatctttgggtacaaggacttggtcatcgccaatgccagactcgcccccatacttccggcctctttgatgttcttaaaatatgtatccgaaccggttcttagcttgtcgaagatttcaacagcatcaaacgaactcggaccactgttattgaaaaacatggcttgaataagtggtgtagcggcattggcgacctcatctctagccccttcaagcttcttgattttgttgaccaagacgttgaattgagcctgggatttgattttgcgatctgcacaaatggtctatgtcgacgaatgaatgcaaagataagaaaggttttgaagtttcagctatatgtaccttcgacatctttcagagccgagtctctttgtttggctagttcgcccttgtctttttccagagctttgattcgtttttctagctcggatatcttggcagcttgcactgtgttgttttctactgtttaattacacataggtggcaacttcaaacaagtcagacaagagtaaggattacctttggatgaaccgcttagctcaatgttgaaatcttgaagctcggtgatccggtccctgagatcatgctcattttttttttggcaagctccttgactccatgaagctgggctctggttgcgtctagggttccgagatgggggaccagcttttcaagtgttgtggtttttgcttcattcctaaggtggattctctgcattataaattcatcttcattcagtaaagtggccgacaggatgggtaaagctatgagcaaagagactacatttacgagacgagtagcttggttaagcgttttggccagcaaagatatttcttcgtcttctttatgtttatgtatcacaattccttgtggctgcatttcatcatcccaccatttgactaatatgggtgggcgagagtcttcagccgaccgtatccgaaggacctcctcttcgtcgccaatcattgggccttatacattcatgaataatggtgaagcaattgaaaaaagtttgtcggatcaagacagatttggaggattagtttacctgttataatttccggtcggggacaagtaggtccttgcatcctgacaggagagttagttccagggtcagcaccaatgtccgtcctgtgagggctgttggcttgagtttccacttctgggatatttttattttgttttgtacccgactggtttccagtcgggggctcctgatcagcaccaacttcagcttcagccgactgattcccagtcgggggctcgttgctggtatctacattgccggatgccggttgattattacccggacggcagtcggcccagtttctgctgaaggaccagtctccgtgccaatcggcgtggggtcttttccagagggatctatgtcagatggtttcctacaaatttgagatatgctatcagctttgcttcaatagtgagtgactagcgaaacaggggaaattgttagatgacacatacctggatgacttccttatttttggcatgggatgactggatgttttcttcttcggattggcttgctttggctgtttctcagtcccctcttttttgcctgtcttttttgcgtcgtcaccttcatcgtcacttgaaaccaacttcctctcatgagaatctggctgattagttgacctcgaggggttgggttggacatccgactggatcttctgccctccactagcttggctagtgtgccggcgaggtgagcggcgttgaataatcggaggatcagatttcatcaaagcgaattcctgtgcacggtattccaagtttttcagtcgaccttacagaagatacaagtatgatttgagaaaggctgaggtgtataatacgtaccggtggaggagggttgaaggcgttgtatggcacaactggcattaagtgtgaatagctgaccacgatggcattcgagaagatcttgtgcattctctcctacatagtttt

SEQ ID NO: 88517 - DNA, 1331 bp, Oryza sativa
cctatttatgggattggaggcattggtaaaacaacgttggcacacatggtttttgatgacagccatttcacaaagtacgatttccatgcataggtccatgtgtctcagacctttgatttggataaaatagtgaacacaataatttcacatgttgcatatccagaaaaggagagctttatttcagatattcagttgatgagaaaacgccttgccggtctactagaaggccgaaggattttgattgttttagataacatatgggagagcgaccaatttaagctggacaatttgaagattatgttaaatgttggcaagaagggcagtgaggtggatgtcatagttaccacacgcacagaagaaattgccaaaagaatttgcacagtgaaaccatacaagctagaaccattgaacgatgacatatgttgggctatcattaaaatatacagtgcctttgaaggtagaggtgataaacagcaggtggaggttatagggcaagagattgcaaccaagtgtggaggtatgcccttagcagctcgagcacttgggtacactttgtattccaaagcagttgacagatggctagcactgaacaacagtgaaatatggaacgaatgttcctctgaagaagcatctttaccacatcacttggtgcttccatccttgaagttaaactactacaacatgcaatcttatttgaggatgtgctttgcctattgtgccatctttccaaaaggtggcaatatcacaaaatacaatttgattcaccaatggattgctcttggtttcatcgagccatccatcacattctctgctgcatagcttgctgaggactacatagagcatctcttgggaatgtccttccttcaacattctaaatcatattcggtaagtaatcagatgtgcacttctctataaagaaacaaacctagttctttttttttttgaaacagtagacggtaggagatctaccggatatattagaagaagagagttgaccctgtttataaggaaaaccaggcccgaaaaccatacaactgcacagtttgctaaagggaaaccggcaaaaaccttacacagaagacacgaaaaagcctgcgacaaaactacgaaccgcagtagtgaccgaggggagagcaagaccctcaaggcgaagcctccaaggaggtgaacaacgacagaagccgctgccgacgcccgcccaaagaactaggctgggttttcacccaaagggagagaaagtccataaggcaacacctccaaggaggaaacggcgcccgcagacgtcgatgttgccgatcctggaagaccagacaaggctttcgcctaagact

SEQ ID NO: 88518 - DNA, 1340 bp, Oryza sativa
catccctagcgagctccccgccccaaaatcggcccccgcgcgccgttgctcgcgtgcgcgcgcccgcgtggtcgccgcccgtgccgcgcctgcgccgtctacgccgcccggccccgctgccctgccgcgcagccgctcggccccgcgagccagcgcgcgtgcccgagccgcgccgctcaaaccgccgcgccgcccgctgcttcccgcgcgcgcgtgccgtggtggccgaccgcctggtcgccgccgccgtcagcctctgccgcgtctgcccgcgcctgccgcccatgtcgtcgccccgctccaaaccgcgccgccgtcaccgccgtcgtcatcgcccggcccccgccactccgcgcgcaagctgccaagggacggaggcagagctcctcctccccctgctgcgtcgcccccgctccctcctccttttcccaaagaggcaagggacaagcccccttttctctccctcttttcccctttttcctcccgccggcgtcatcctcctccctcgtccctgtcgccgctttggccgcgaccgccgagcgctagccctctcctttgaccgccttaggtcggttcccaaaccgacattgtcgcccctataaacccaagcttccctctttcccttcctctcccattcgcctccacgccattgtcgccgcctcccgtgctctgttcgccgtcgccgttcgtcgttgcgcgtgtcggaggagccggcacgagcaaggacgcggaaggggactccgggcgcgccctccccctcctcttcctcggcccgagccggagagattactcccgcgccgtcggcctctcgtcactgcgcccgcccgcacggtagtgcatctccccgttctccctcctcgctccatctcctccccttagacctgggtagtagcatgagtagcctccccgtagctagccggcgccgccccgaccgttgccgccgctcgccgtgtgctcgccgccgtcgccgcccgagctcggaagcgccgctcgtcgccggcctcgctcggcgcagctctgcccaatccaacgctagcatcggattcccatagccgcgtagatgctctcgccgccgggaatcggcccctcgtgacctcgtcgctgtttcccccttctcccgctgccggttgccgccgccgcaattcgccgccgtcaagctccctccggcgaatccaagccgttggctcgtaattgttatatcatgtccccttgtaaccatctagttgcgcctcgatattcgtgcaccctgtgcgagtatcgacggtcgccttcaaacttaaaatctgaaaaacttcttgggtaaaacttgggttttacaaaaggcttggaaaacccaacac

SEQ ID NO: 88519 - DNA, 3690 bp, Oryza sativa
ttcctgcagcccgctgagttagattgtaaataggaagaagccgggacaatggcagatgtgtgtcgattataccgacctcaacaaatcctatcccaaagatcccttcggattacctcgcattgaccaggtggttgattcaatggccggctgcgagttactcagctttttggattgctactcgggatatcatcagatccgactaaaggagtccgactgcttgaagacttcattcatcacacccttcggggcctactgctacatcaccatgccttttggattaaagaacgcaggagcgacttatcaacgcatgatccagagatgcttttcaagtcagattggtcgcaacgttgaagcttatgttgatgatgtagttgtcaagaccaagcagaaggataatctgattgcggatctagaagagacctttgcgagcatccgcgctttcaggatgaagatgaatcctgaaaaatgcatcttcggagtaccgtcagggaagctgcttggctttatggtatcccatagggcatacaagccaacccggagaagatcaacgccatccttaacatgaaatcgccgagttcccagaaagatttccaaaagctgactgggtgcatggcggcgctcacccggtttgtctcacgactcggcgagcgggggatgccttttttcaagctgttgaagaaaaacgacagcttccagtggggacccgaagtgcaaaaaagcctttgaagacttcaagaaacttctcactactccacaagttttggcttcaccgcatccacaagagctgctgttgttatacgtgtcggtaacttctcaggttgtgagcacggtcctggttgttgagtgtgaagaagatggccatgttcaaaaagtctaacgaccaatttatttcgtcagtgaagttttagccgactccaagaccagataccctcaggtacaaaagctgttatatggtgttctaattaccgttaggaaattatcttactattttcaaggtcactcggttacggtggtcacatcgttcccactcggagacatacttcataatcgtgaggcaaatggacgaatcgcaaagtgggccttagaattgatgcctttggatttctccttcaagccacgaacttcaatcaagtcccaagccttagcagattttgtcgccgagtggaccgagtgccaggaagacacgcctgcggaaaagatggaatactggactatgcattttgatgggtcaaaaaggctttcaggcaccggagcaggagtcgtcctgatttccccgactggagaaaggctgagctacatgttgtggatacatttttctgcgtcccatgacgtggcggattatgaggcgcttcttcatggattaaggatcgcgatttccttgggaattcgacgtctgatagttcgcggagattctcaattggttgttaatcaagtcatgaaagagtggtcctgctttgatgataatatgactgcctatcgacaagaggtacgcaaattagaagataagtttgatggccttgagctaactcatgttctccgacacaataatgaggcagccgaccgactagccaacttcggttcaaaacgagaagcagctccttccgatgtgttcgttgaacatctttatgagccgaccgtaccaagaaaagaaacgaccgaggccacagacactcaagaggtgaatatgctcgaagccgactagagagagcccttcatcaaatttttaaccaagcaagaactccctcaagataaagacgaagccgagcggatctccaagcgaatcaaactttacatcatgcatgaggttgaactgtacaagaaaagtccgtcagggattttgcaacgctgcgtgtctttggaggaagggaggcaattgctaacggacatacattcgggcatttgcggcaatcatgctgctgcgcgaaccattgttggcaaggcttattggcagagttttttctggcctaccgccgtatccgatgctgacaggattgtgcggacgtgtgagggttgtcaatttttcgcccgacagactcatctaccagctcaggagttgcagaccatcccgttatcctggccgttcgcggtttgggggctcgatatggtcagaccgttcaaaaaggctaccggtggttatactcatctctttgtggccatagataaattctccaagtggatcaaagccaaaccagtcatcacgatcacagcagacaaggctagagattttttcatcaacattgtgcacaggtttggagtacccaatcggatcatcaccgataatagtactcagttcactggcggagtatttaaagatttctgtgaagactttggtatcaagatctgttacgcctccgtagcgcatcccatgagcaatggacaagtcaaacgcgccactggtatggtactccaaggaataaaagcacgaattttcgaccgactgcgtccctacgctgtcaaacgggtggatcaactgccatctgtactttggtccttgcgcactacgcccggtcgggctacgggccagtcatcattctttctggtttatggtgcggaagcaatgttgccaagcgaggtagaattcgagtctttacgatttcgtaacttcagagaggagcgctacgaagaaaaccgagtggatgatctcaaccgattggaggaagcccgtgaaacagctttgatccagtcggctcggtatttacaagggatgcgacgttatcacaaccgcaacgttcaatcacgagcttttttagtcggagacctggttttaaggaaaattcaaactacacgagatcggcacaagttatctcctttatgggaaggaccgttcataatttctgaagttactcggccaggttcataccgactcaagcgtgaagatggtactcatgttgacaactcttggaatatcgagcattttcgtcgtttttatgcttaggcattatttcttgtattttcctctttgactgctaacaccaagcttttccttgaagttatcagtcgggggctactacaatattaatggagtgtgatttttatcaattcaatttgcttacttgatttatcattgccttgtttgattttttggcttagtcaataaggactgaaagtttttaacaacttttgcaggttctaggctcaataaggttcgacaaaaacttttaagaaatcaggagctgagtctaaatcatcaagcacagcatactgtcggagatatgggcccgggggtatgcgaagcatgagcaatccgccttcacatcctgccacgtgtccctgtgacttgctcctgccccccgccgtccacgaaccgcgggggcggctagggggttcggggcctcggggtgccacggcacgcccctcgggcccttgcgccgctttgccccgaggccctcgcccagccaccatgtggcgggaaaagcgagcgaggagggagcccaggatgatattacattaatgcgcacaacgccccaactgccccctgctacatttaatgcagtgaggcagacgtgcggcgtgcgggtctgacgcaccataatcgaagaatgaccggtctgtgaccggtcatgatgccggtcacgtctgactagaccgacgaccgagctcccacgtcgcgtttgcttctagcggagtgggggtagatatgacccatcccatcggagggtcattcggacggcggccaccacaagtcttcat

SEQ ID NO: 88520 - DNA, 532 bp, Oryza sativa
ggaatgctgacaagtgcaattaaggtactcactagtttaggccgttgttatttatcactgattattaatcagctgtgactcaaaggattaactctttctttttcatcaaaaagactaattactcatattttggttgtactatattgcagacaagggttaaaatggagaaggcagcacggggagggaatatggcactgcgatataagaaaatggatggggattatgattcagctgaccgggaatgcttttcatgtttttatgatctccatttgtcagctgtcagctgccaatgctccccaaatcgttttgcttgcttaaaccatgcaaacattctatgttcatgtgaaatggacagaaaaaccgcgttgttgcggtataccatagaggagctccatactcttgttgcagctctagagggtgatccaactgcggtctaccagtggggacagaatgatttaggtttagtctgcccatctggttctactcagtacaaaaagatggacttgggtgaaaacacggaatttccggattc

SEQ ID NO: 88521 - DNA, 712 bp, Oryza sativa
gacgatagatcggggatttgagatctgagaaggcacggacactagacaacaagcaaagaaacatatttcgcaaataggatttttaagagataattttttccgctaggtgccacgacggaacgggcgctacaagctcttatcggcaaattaggccgcaaacctcctagtacggtcaagcagatgtttgagaaagctaatgagtatgccaaggccgaagacgcggtcatcgcatccaagcagtcgggcaacacctggaagccaaagaaagatgcgccgactacggggggagtggaagtaccaatcacaaggatcgcaagcgtaagcccgaggaacttgtagcaactaccacaccatcgtcccaacaacgttcacgcgtcaacactttcgacaagatcatgaactcccaatgtccccatcacccaaattccaatcacgcggccaaagattgcttcgtctacaaacagttcgcagagcaatatgccaagagcgcacgcaagccgactgacgaagaccaaggcacgtcgaaaaagaaggacgatggagatgatgccccaactggttttcaggactcctgcaaggaacttaaccacatctttggcggacctctagcttacgaatccaagtggaagcaaaaactcaccgaacgagagatcaatgccgttcagcctgatacgccccagtaccttcggtggtcagagacagctatcaagtt

SEQ ID NO: 88522 - DNA, 638 bp, Oryza sativa
tccctctctctcctctcccccgcggcccatcggctcctccccgcgcgcgcgccgctgacaggcgggcccgcccgccgccctcgctgacgggtggggcccacctgtcatcgccttcctcccgccgctcccgccgctcgcccgtgccctagcgccgccgccgccgcggattccgccgcatcccgccgtccccgcgcgccataatgaggggggaatcattccccgcgattccctctcccgtttcccccgtttttccctctctctctccctcggattcgtccgatttcattcccgaaaccctcgccggcgcaatcaatggcggccgagatctccgcggccgattcctctctctccggccgctctctccccctcccggtgctatttaatccacccccgtgcctctctcctccgtttccaccgctcgccgctcgctctctccgtcggattcgtgctcgcgccgttgtcctctctctccgccgtcgccgccgagctccggttcgccgccgtcgtcgctccggacctcctcccgactcggcgccacctccgtcagcttcgccgcgtcatcgtcgacctcgtctacgcctccgtttcgcccgccgaccgtcggagcgccgtcgtcctcgtagtcccgaaccgcgccg

SEQ ID NO: 88523 - DNA, 694 bp, Oryza sativa
  unsure (1)..(694): unsure at all n locations
cagtgagcgcgcgtaatacgactcactatagcccgaattnnnnnnnnnnnnnnnnnnnnnnnnnnnnnnnnnnnnnnnnnnnnnnnnnnnnnnnnnnnnnnnnnaactaatacttaattaatcatgtgttaatgaactgttccgttttccgtgcggagggaaagagtttccatccatgatctccaaacaatactgccggtgcttacgtactcaccggacagcaaggagaggacgttggcgacgctctcgttggccaccggcgccggcgacgcgccgacggtggcgaccgggcacaccgccactaagctgatgccgttctcctccgccagcttgctcgcttccttctccgagagaaccttggcgatcgcgtaagcctgcagcgcaaacaccaccgctgtgctctcacgcaagcgactgtactatcaactctgactgaacatgtaaaattttgtaagtttgtgtgtacctgagcaggagatatcccgttggttgatctgaggtagtcgaggtcggaccaggacgactcgtccaggacatggctgctgccgttgccgtctccttgcagcggctggccggagacggcggccgccgacgatgtgaggatcacgcgcttaaccgtgccggctttcacgcacgacctcagaacgttcagagtgccttggacgccggcttccaacagttctttctgccatta

SEQ ID NO: 88524 - DNA, 601 bp, Oryza sativa
gccaaatagaccctacaatccgattcgtatccctcaaccgcaataccagatatcttaaccctaaactagtaaaaccacagcaaaattactccctcggtggtgtttgagggtggttttcgctgacgtggcatgttgacctagtccaccttgctaagtcatcatgtgggaccccgaatcagcgtccttctttcactatatcttttctctcttcccacttcctctccgacctatccatttgacgcagttgtgggcgccgcactcccttcctctgccccgggtcttcagccttagcttctgcggtggccatctcgcggtgccggagacgatgtgatgaaccctgagttcctgtcgacactcaagggctgttgttggaccgatcttttcgggagttgtaataactacgatttgggagaaacagtggacgatccgactacaaccgtacgagacgttgtgttgcgccttaacgatcgatacacctctccgtgggttgctgatcttgccggtgcagatcaaccctattcctgcaagcaaatcgaagaaacaagcaagaacaagataaaagcaatctgatattgcaaataggaatttaatacaaatgata

SEQ ID NO: 88525 - DNA, 1397 bp, Oryza sativa
ttttaatagattttttgagataatggaattttacatcccggcctttgctcaaaaagagctacagccaattattacattatagcaatctagaaaagagcgtagttcagctaaataggacaccccaaacaaaaacagaggaaaccaagtcaaaataaggagaacacatttattgaagtctatttgtgaacctccatccataattggcaaataattgcataaccattgactccaacttgcggcatgcaatctttaggaactccccatcatcctcacacctttgtagctgtgcccaaaaccggagctagtgcattgccctgaaaattacctgcatatatgaaatagatggtgatttattaaaaaccaaatcatttttactcaaccatagagcccaacaaatggcagaagctctaaccagtatcagtttactctttttcttatcaaccccccatagccacccatccaatatattagatatattaggtggaagattaaaacccaaaaaaactaaactgctctccatatgaattttgcataatgaccatttatgaaaaaatggtgaatagtttcattttttaatacaaaagcaccatcttaagctaccattccaattcgttttggcaaaataaccttgggttaacacactccctaagcaagtaccacataaagttcttatttttaaggggattcttaaattccaagtagatttgtttctctcaatataacagttgttaattaaagctagatacattgaccttactgagaacctatcattctgatgataattccatctaaaacagtcagaagaaagaatttaattgaatatgtccaatagaagccccacaattcatgccaatatacaagattttgaccaataaaagcttttttaaaagaaccattaaggggaccagatcccataccagtggcaatagtggatgatttacttcggattatagcatataaagatggaattttatccttgaaagccaagttaccaagccatttatcttcccaaaatctaatttgttccccatcattcacaatccaagagcctatatctaaaaaagtacttttgactttcataagccctgaccaaaaaagggaatcaccttgtttcttgtccacttgggttatagacttgttataaagatatttccttttcaataagttctgccaaacccctttctcatttattagcttgtacaaccacttactcaaaagacatttattttgtaattccaaattatgaatcccaccgttaaattttttttatcacgcgtttgatcattcgtcttattaaaaaaattacgtatttataatttattttgctgagggttgttttatcactcaaagtacttaaagcatgatttatatcatatatatttttgaataagacgaat

SEQ ID NO: 88526 - DNA, 591 bp, Oryza sativa
aattcgagctcggtacccggggatcaagttcaatatcatcgcctctctctatgactacaacccccaacctggcaacctacatgaagccagagatgtgggggaagtgcctgggctgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtatgccatcatcgagcgtgtgcagcgctacctggaggagaagggcactaccgaggaggtctgccgcatctacctgctgcgcatcctgcacacctactacaagcttgactacaaggcccattagcgacagctgaccccgcctgagggctcctcaaagtctgagcaagaccaagcagaaaatgagggcgaggactcggctgcgttgatggagagactgtgcaagtacatctacgccaaggaccgcacagacc

SEQ ID NO: 88527 - DNA, 683 bp, Oryza sativa
tttggagaatgaagctttaataaggattttctgaaaatgagattaaggaggctattttccaaatggaacataacaaaactccaggtccagatggatttcctgctgagttttaccaagtgttctggaatgtaattaaatttgactttttacaactttttaaggattttcattctgggagtttgcctttatattcacttaaccttggtactattattcttttgcctaaagtgtgctgaggcccatgaagattcaacagtatagacctatatgcctacttaatgtcagctttaaaatttttacccaaagttgctacaaatagattaatggattttgctcaaaaggtaattagtcctactcaacagcgttcattctgggagggaatattaggaaaggagtggttattttacaataaaccttgccataaataccttgccaaaaaaaaagtgggggtaatttttaaaatcgattttgaaaaagcttaagaccaagttaaaaggttttttttaccaccaaccttgaaaaagaaaagcctttttcctaaaaggggggaagggaaagccttctttggtccaagttggccaggtgggaaaaaagtaagaaccaaatgggaaatggtttccaaccttccaaagttttaagaaaagggaccccttaatccccaattctttttaaaatagaagctg

SEQ ID NO: 88528 - DNA, 705 bp, Oryza sativa
acatcagtacgctcatgctcaccatcatcagtaaccacaacaatttcatcatcggagtagatgccttcatcatcaacaccaacatgttcattttgtttaaatggatttgctaagtacttatcaacaagttgtgtgctactgctaggctgagatatagtagcctgagatggcactgcaagagatggagtggatggcacctcatgtatgtcagccgcattatgtactgtcccactagctatcttttcaggtgttggccaatcagcaagtggaagagctacaactggctcattgttgctatgaacttgaatcaacatagatatttccttggtggtggcattcttgacaaacatttctagcatacattggtctgagcacacttgaggatagtttttgtttactgaatcatagtagttcactgttataaattcattcaccccccatgggtacttctccctaatgtcatcaataaagtccttgaagtttgtcctgtcactgtctaccacctcctctgttttataggtgaagttctctctactatgatgcccttggagcctgattttcaacaaatatgttgtaccaggatccatcctatacacgatgcatgcaacaagattactgtatgccacaaaactacacctaaccagtgctaccaccatatgcaaaaatctgaacaatcacaagaaggggaaaaattgatacataccc

SEQ ID NO: 88529 - DNA, 610 bp, Oryza sativa
cctgaaactaatctttaaaagtatactgcacatatgattgacagccactttggcagggttaccgataaagtataccctctaaccttggatgtatgctatgcggaaatactatttaacggagcatatacggacgttatcgtggacacgctaaggaaatgcatcacggagtataccaatggaaaggctcctacccgtgtaggactgggacgttactatgtcacacagggctgatgtctccaagaccctacctggagaccgtctgaccggcgatataaaaggaaccccccgtgggaactaaggggatcgaatctcataacgtacacaacgaccacagcctacgaagccggagactacaagagccaatatgacgggtgatctagcctaatcaacatcgatacgatctcttctgtaccaccgagtacgataattccctttgcatctgaggctctctcattttaatcacacgtcaactgaattagggatactacctgctaaagggccggacccagcaaacactgtgggactcgtagcttgatgtcgtactacgtagatgcacgtaccagtgtacccgaataccctctatatgccgactactggtaccctccgtcga

SEQ ID NO: 88530 - DNA, 655 bp, Oryza sativa
tgcctgcaggtcgactctagaggatccccacaattggaggttgacaaccatcatgaagatatctccaaaaaaaaaatccccatagcattttcacaaatcaatagaatcacttcacaaaattgggaagaaaaaaatagaaaagttttaatttgcttactgtaatgcttttgctgcccccacagcgacttggaggcgagcattccatgataatcccttgtttgagtcatcaacataatgaagttcatcatgtagagtcatcttgctacagtgctcatatacaagtaatctctgatcaaactcagcacaatatccaacaagcccgagtatgttaggatgcgtcagttcggagatgttcacaactagctctagaaaggcatccgctggtattcttgagttagcagcatcaatcttcaaaacttccagtagctgatgcaaagcaaatatcacagttcagaagtgacgatggtataatcaacaaattcttgctaaagtaactactagaaaatctgcccaacagttttgtacctctccatccggaagctctgccagatataccttaccaaacctgctatctcttatcaaattttcttcgttgaaactattggtatattgctgaagggacgcaatagagaatgacttgacggtagtagttaaa

SEQ ID NO: 88531 - DNA, 665 bp, Oryza sativa
acacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttaaaattcgaccccacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgt

SEQ ID NO: 88532 - DNA, 618 bp, Oryza sativa
ctatagggcgaattcgagctcggtacccccagagactagacgaacggacagctcagggtccattcctgccaagaacttctcttgcttctcctcatcttcccgcacatcctcggggcataacgggccaaactgttgaactcatgcaaatactccatcacggagcgggtgccttgcttcaactctcggaattcccttttcttaagagccacgactccagcgggcacatgggttctccggaaagcggcggtgaagcgggcccaagtaataggctgtccctctggctgcgtagcctggaagtggtcccaccatagagatgcgggcccctgcaattggtgggcggcgaagatgactttctcctcatcgctacactgcaccgtgtctagctttttccccacggcatgcaaccaatccaacgcatccacggggttgttggagctagagaaggtgggtgggcggatgcggaggaactcggcgagtttaaagtgttggggaggtggtggtggagcattctggtgtggcggattttggacgtggtggaggaaagcagtcatcatgttggcttgctgagcgaggattagggtgagaatggcgttggcgtctggtggtggtggcggaggc

SEQ ID NO: 88533 - DNA, 527 bp, Oryza sativa
acttagtttagctgtcatgatttggagtggttagtttgagagccgattaaatgtgtgcgcacggatgtgctagggaggcttagcatttatcttggaatggaaatattatggattagctgagcttaaccatagtcaaggaaggtttttgcgttaattagtactatttgcgttagcatgcacatagagatcagagaggtgaagactagtgcagctggttgcaagtggaaatgtgctatagtcgacaagcttctggccagtctgatgatcacatatatacatcaggcgagcagaaatttaccgtgctctcgcttggctgttttgtgcgcctgcgtatttgcgtgaaggctgaagcagttcctaagccatgaattgtatttcatagtatgttcgtgtacaggatggttgtcagccatcttgtagttatgcacctgctccatgatatacagatcattactagcatcagtagcaccgaatttagtattcagtgcattccataactcataagcgccggtcatatgcatatacac

SEQ ID NO: 88534 - DNA, 758 bp, Oryza sativa
cctaattttgatccttttgtgaatttcccaggacttgactaatcctttgctagctaaagctatccaaggtgaatattatacctattttctgcgaacaattttctactgtaactaaaaaaaatggacaacagtagggaatttccatactaaattgcaaataggattaaagttacaaagtcaaagactcaaagaattcttgtcaaagatttatctgttccttgcaactacatatgccagcaactgtgatcaatttcattctaccgtgtggaggtttacttgttacactgactaatataagatattagagggtaaatcccgttttaagaaacatattgacatttgtggttcattctgtacctttatttattaagcttggaatttgtttagagctactttccacaaaatgtatttgccttcttatggttttctacactttcccatgattcatggactttttttcccatttatttgtttttgtagcctttagccctctacgtatcagacttggaggttccttacaagatcaggtggtgtatggcacgccgaatttaggatctccatgcaccccatttcaaagagttcaagtggcctgtttggattttctcaaggatgcataaccatggaaagatgggatgctattaataagatctttatggatacagggtaagggcttccttctccagtagtttctgatgtgcattcttttttctgtagtgaattctgatatattataagataaattgttgaccacatcacaa

SEQ ID NO: 88535 - DNA, 624 bp, Oryza sativa
ttttttttgacagttatagatcattatgttggcagtttatttctgtgttttttgagacagtttatttctgtgtgagattttattctgctgttgtagctcatgatgttttttccttggatttagatgcacatgttcaatagctgtttttgtagttgtaaaatgtgctgtaatgatttgcaacttgtcctttggtgcgttctggcgggagattggattcggcgtgacaattaataagacgtatagtactggttatgcccaatgatttattcaatgccatattttggcaggatgaggaacctgaccatcaatatggttctcgccgaatgccagcacgtagtcgttttggggatgaactggaggctgaagcactagctgagaggcgcatagttagtgcaaagaaggtgagcaactctcagcatgtaacccttgttatttttatccaatatattgctgtttatacataatctgtattgtttgcacattttcagtcaagtatgggcagaaacattcctcgcaaaccatcctttcctgctcgtccgcctagacgacaggaaaatgaatattctgagagtgaaagggaggagtcagagtatgaaactgaaggagaggatattgagcactcac

SEQ ID NO: 88536 - DNA, 581 bp, Oryza sativa
tccatttgctgtacaagtggagtcgtgtgatcatcactctctctgccaaatcttgcctctcctggtgcatacgaagtcaaattaattagagaatgaaccttggcacaatgctgaacatcatatatatttttcttcattgcttagtaacaagatgcaaaaagatacctttgcgagtgcgatgaggaaatgtttgccctcctttggatcgttaaccacgacgtagctgacaaatcgtaagtgttcgtattttagacgctaaggatgcagattggaactgacaccaacattaacctattctacttagatttcatttcaacatagcacaatatatcaatgtgagattttcttgcaatggggtgacttacttatacagccaagtataagcaggtggattcatttcatacaactggtggagcaccgtgcttgtggccttgtaagtgaagtaattcatgatttcctgcaaaatggagagaacaatcttcagagttccatgcaatctaaacccaattaaccttgcagttagagaaaattaaccattatattgctgtcgtttacagatagcgttccgattatcccctgcc

SEQ ID NO: 88537 - DNA, 588 bp, Oryza sativa
aattccaccactctaccaatataggttttagcattgcacgcggccactccatgatgcgcttattctacggtgactaacgaccagaaccgattgattgcagcccgacgtgcctgttgtcagtggcatcaacagcggcagcacggtgaagctcaaagacctcgccccggcggccaccaacaacgtgaacacgacgttcatcgtgctcgacaaggcggccagggcgccgccgccgccgccgcacggccgcgccgacgcaagggaggagacgtgcctggcgctcgtggccgacgagacggcggcggcgcacttcctcctgtggggcgccgagcgcgacgcgttcgagccgggcgacatcgtgcggctgaccggcggcatcttctcctaccacaggagcaacagcctcgtgctgcgggccgggcggcgcggccgcgccgagaaggtgggcgagttcacgatgctgttcgtcgagacgcccaacatgagcgaggtgaagtgggtgcgcgacccggcgaccccaggaggatggtgcaggaggccgtcgtctcgccgcactctcaggtcttcaagccgatgcagtgactgactgac

SEQ ID NO: 88538 - DNA, 1169 bp, Oryza sativa
agcggcataatagcccagccgtgtaggcgaaggcaccactcggcgtcgacgtaggcaggccggcggtgaagtcgtagacgcccaacagcggcggcataatagtccacccgtgtaggcgaaggcaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcggggacaccagtcggcggcgacggaggcaggccggtggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcgggccggcggtgaagtcgtagacgcccaacagcggcggcataataggccagccgtgtaggcggaggcaccactcggcggcgacggaggcgggccggcggtgaagtcgtagacgcccaacagcagcggcataataggccagccgtgtaggcggaggcaccactcggcggcgacggaggcaggccggcggtgaagtcgtagacgcccaacagcggcggcataataggtcagccgtgtaggcggaggcaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcggggacaccagtcggcggcgacggaggcaggccggtggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcgacataata

SEQ ID NO: 88539 - DNA, 934 bp, Oryza sativa
cggtgaagtcgtagacgcccaacagcggcggcataataggccacccgtgtaggcggaggcaccagtcggcggcgacggaggcaggccggcggtgaagacgtggacgcccaacagcggcggcataataggccaaccgtgtaggcggaggcaccactcggcggcgacggaggcaggccggcggtgaagacgtggacgcccaacagcggcggcataataggccaaccgtgtaggcggaggcaccactcggcggcgacggaggcaggccggcggtgaagtcgtagacgcccaacaacggcggcataataggccagccgtgtaggcggaggcaccagtcggcggcgacggaggcaggccggcggtgaagtcatagacgcccaacagcggcggcataataggccagccgtgtaggcggaggcaccaatcggcggcgacggaggcaggccggcggtgaagacgtggacgcccatgaacggtggtgtgaccaaccaaccgtataggcggaggcaccagtcggcggcgacggaggcaggccggcggtaaagtcatagacgcccaacagcggcggcataataggccagctgtgtaggcggaggcaccaatcggcggcgacggaggcaggccggcggtgaagacgtggacgcccatgaacggcggcgtaaccagccaaccgtgtaggcggaggcaccactcggcggcgacggaggtaggccggcggtgaagtcgtagacgcccaacagcggcggcataataggccagccgtgcaggcggaaacaccagtcggcggcggcgaaggctagccggtcgatgaagacgttgacgcccatgaacggtggtgtgaccgaccaaccatataggcgaggacaccagtcagcggcgacggaggcagccggttggtgaagacaatgtcgccaccagcaatggtggcagagtacac

SEQ ID NO: 88540 - DNA, 759 bp, Oryza sativa
attcctgcagccctatattatgtgatttatttgtcaaccaggatgctggagaaagtctgcaaggattcacaaatgcttgcagacatgtttgtaaattatgattgtgaccttgaggggccaaacctttttgaacgcatggtgagcacaatgaattttatttttacactagaaaactagtatctcttctaactatctccacatgatatatctgattgaacatgtatcactatcaggtcagtgcactctcaaggattgcacaaggatctcaaaatgcggatacaaacactgccgcatcttctcaaacagtttctgtgaaaggctcatctcttcaggttactgttatccaaattgctaagatatttttgtccttagtgtatataatgttaatcactcgtaaaacccaaattgcagtgtttggtgagtattttgaagtcattggttgattgggagcaagctcgaagagattccttgaaacaggggagtgttgccgaagcttgtgaaaatgattcttctgcaaggagcataacaagtgatgaaataaagagccaagaggatggtcgcaatcagtttgagatagctaaagctcataagtcaacaatggaggctgcaatctcagaggtagggaggttgctgttttaattgttttgttttgttttatttattttgcaatcaagaatctttatctcatgatgtttaccaaatacatgcatgttcttgtagcagttaacctagtttgctgttactgcattgctgattgta

SEQ ID NO: 88541 - DNA, 1272 bp, Oryza sativa
tcccccaccacttgcgggcgcgcgcgcgcggtttatgtggggggggggggagagcggcgacgtgggcgctaggtgcgggcgcggagagggacggagaaggcgggcggcgtggggaggtggggccgccggcggttggggctcggctccaaccggctagaggaggaagacgaccgacaggtgggccccacctgtcggcgcccgaaggagagagggagggagggagaacttcggggaggggaaaggggaacgggccggcccacaaggggaggccgagcgcgggcgacgggtggactgggccgacggcccaagaagaggaaaaaggaggaaaaaggaaaaacaaaaagaagaaaggattttcctgggattaaaaattgcactttggtgatttttaattggtaaaaattatttccaaggctctgaaaattccactaaaaatcctgttagcattatttgacatgtagaatccaagaaaaattccacatgccgattccgattattatttgcatttattaattagggaattagctctaggttaattaagataatttcttcggacgatttatttagccaatttttaaagcaagcaaaggggggaaaacttcagggcgtgacagcccgaagacccgcagtgcgaggatttcgaggatcaagctccagatctcgagcaaggcaagctacctttgaacatcttgagcctatatttgaaatttaattatgttgcttaaaaatattatgcattgataggatcgcacttaatctgtttgtcccgtctgcaaggcagattggcggacctatctaatttgttgtatttgatccttcttttgttaattgttataccatgtccccttgtaccatctagttgcgtctcgatattcgtgcaccctgtgcgagtatcgacggacgccttcaaacttaaaatctgaataacaacttgcgtaaaacttgggttttacaaaagatttggaaaacccgacacctgggtcggtgcttgcgaactaaatgaatttccaaacccgcggaccggggaacgtccgggtgtacggtttcccgctctcgcacttaaggaccgatttccttggaatttcatccaaacataagacaagtacgaccacatgggtggaatgggacacccttggctgagtaactagcttatcaggggagccttgatgccgagagacatgtggattcgccggggtggtgtcggggaggacccctgggcttcttggcacagtatggtctgggacctaacctgttgttggtttgggactcctc

SEQ ID NO: 88542 - DNA, 573 bp, Oryza sativa
agcttcttcccccaaagcaaatgccatgtgtattcacatggggcacatgagccacaagggtcccacctgcttgttaaattatttgatttatatgttttattaggctggcttatggatgcatggatgtactgtagaatcaaccttaactatatgaatggtcctcagttgtttacagcataagaatatatcatgttctctttcatgtcctttagttgcattctagtatgatcttcacaatagttttcttgattagcttacagttgactgagtacttccacatgccttgcactataaaagttgagcattggagtgtgatgccattattttagtcctctgttttgttacttttgggtaatgctaatacttctctgattccgccctatcatttgtttttggttcattgctgacctattcctcttgcaaaatctcaggttgctaaagacccatcaggaaaagatatcaatgcacttgagcagcacatcaagaaccttctgaacccttccactccatttttcttcaacactttgtatgacccgtaccgtgatggcgctgattttgtccgggggtacccct

SEQ ID NO: 88543 - DNA, 1441 bp, Oryza sativa
caaagtgacccttaccaccacttatgcgacgacagacggcgagggagatggcaggcgacaagctccaaaggcggtgaccttgggttgacgatggcgacggctttccggcgacgagaggcaacaaccgagggcggacggtcttcacctcgctcctgcgatcccgagggtggtgacggtgaatgaaggcggcgatggacggcgacgaacggcgcggctgaagatggaacggatcggcttcacggtgacgacgggcttcccggggtcttcgacgacggggaagtggaggccggtcttcttctcctcctcgcgaacccaacggcgggagcggcgaccgaaggcgacgaccacagcgacggcgcggggctgctggagcggcgccggcgaaccacgatacgacctcgccggagatagagcggccggctgcggatttggagggcatgcacacgtagaggacgacgaggcgaacccaacggtactcaccacaacgacaatcgacgtccgacgacggccggcgacgagaggaggcggcggcggcttggaccttaccgacgacggcgagctacggcggccggcggcgaagaaggacgggcggccgggcttctccaccccttggcgcacctcttggcgacggcggcaagcggcggcgacggcagaagcggcgcggcggcgcggctgcactcggccggcggcggcgacgaactaaacgcgcgcgccgacgaggctacgaggcactagagagctcgggagagggggcaaacgaaagaggaggactagggggtcctatttatagccttggaagctcgggtccgggcccaaaacgacgggaaaaactcgggaaagtttatcttcgccggaaaaaggaaaggatttgatccgcgaaattggaaaggatttccatataaaattttggggatttcttggggaaaaggaagaggagaataagaggaatatttcccctcaactaatttggaaagaggagcaacgaggaggccggatttggtggaagaaggcggcactgtgcacaggctcggctggctcgggctctgtccagagctggaagatgaacagtgccagggaggcaaactagacttttttcggttggctgagaacagaacagagcacttgacttgggccggcttgggctgcacagcacgcgcgcaagggagagagaagaggaaggaatgggccgaaaatggcccaagcggaggaggaggatttttattactttcccaattaaaataatcacttaaatgatctttgaattgttaaaaatacttccaatgctcaaataatttcaagaaaaatcatgaaaatacttggacactcaaagtatttaacaatattaaaaccagaccatttaatgattaatttaatatgtggattattactgaaatgttctttgtatgattaaaaattaggaattgagctccgaaaaatttga

SEQ ID NO: 88544 - DNA, 1087 bp, Oryza sativa
  unsure (1)..(1087): unsure at all n locations
aactcctacattcagatctttgtgaaatgaatggggtgttgacgaagggtggaaaacgatatttcatgacattgattgatgatgctactagattttgctatgtgtacttgttaaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaatcgcacactgactgacttggtgaatgccatgttggacgccgcgggactgcttaaggcatggtggggggaggcattngttgacctcaaatcatgtgttaaatagagttcctaacagaaataaggacaaaacaccatatgagatatggattggtagaaaaccatcactttcttatttgcgcacatgggggtgcttggcgacagtcaatgtaccaataacgaagaagcgcaaacttggacctaagactgtggactgtgtttttctgggatatgctcatcacaagcattgcctatagatttttaatagttaaatccgaggtaccgnacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtaacagagcgaccctatgggtgtaaacctgtggggtgcaagtgggtgttcaagaagaagcttaggcctgacggtactattgaa

SEQ ID NO: 88545 - DNA, 544 bp, Oryza sativa
cggatcctcggccccagggcctcctgcatctccttcaaggactccgcctgccgctgcttcggctacatggtctccaagaagaagtacatctacaccatcgacgacgactgcttcgtgagcttctttcccccttccacccctcgattaacttcgcctcagtgagatctgtctctgttaaggtttgatctgctggttgatggccgctggatcttgggcgatctttctccactgccatggcgtgatctgtgtgcggggattttagatcttggtttggtggggatcggatctggatgtgtagttttagtgggggaaaggcgagatctctgggctgtttcttcgtcagcaatcggcattgccccgtagttagatttttgagtttagcttcagttttgcgagattagtagttctttttgttaggacagtttagtttagtagtgataaaaaaaccctttaatttttgcattacatcatactactactattactactgcatagtgctgtgatgtgggtaggttgaatgtgaatttcacatgggtaccgagct

SEQ ID NO: 88546 - DNA, 667 bp, Oryza sativa
ggtgagaatgggataacactcttgcagtcccattatgtggagaagatcttgaatcgctttggctacattgatagtaagccttctccaacaccttatgatcctagcttgttgcttcgcaagaacaagagaaattgctaggaatcaactggaatactcccaaatcattggctcgttgatgtacctggctagtgcaactaggcctgatatctcctttgctgtaagcaagttgagccgatttacctctaatccgggaaatgatcactggcgtgcgcttaagcgagtaatgcgctatctaaaaggtactgtggaattggggcttcactattctgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatgaaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaaga

SEQ ID NO: 88547 - DNA, 739 bp, Oryza sativa
agccagacatgaagaagacaggggcctacctttttgagagtactgccactgcacatgctcaccgggatgtggcatacaagcattatgtcaatgagatggactgctgcaagcctcacatgtaagtacttccaatatcacttctagtagacaattacttctttaattgagatactaaccaacgacatctcttcaacttttgcagattgagtggttaccataccacacaaatgaggcttcaagcctgaccctgaactcgatgtgcaatcgagactctgactatttcatgtaccagtgcccattgatttgtttctgggcagttgagtaccaccttccgcaccgtgtcatgcgacagttcgggaagaaacaagattggccggttgaggacatctcaactggagttgaattacacaagtaaatatttcttatctttgtttgctttcattgtcaatgttcaattttgtaccatttaacccttgtcgatgctcactactatttcatcaccttctacttgtctaggtatgacagggtgagaacaaagaaggtgaaagactgggggctagagcataatagatacattgatgaatggagaacagccggaaggaacgataggtacatcgaaactatacaccaaaatcatcttttctcagagtaccttcgttggctgcataggacatatagactgttcctccgccctacttgaacgaaagccgacatagaggatgaccgcgactccgatgag

SEQ ID NO: 88548 - DNA, 1435 bp, Oryza sativa
agtgtcatactcatagtgccgaggtgagcaagactgttcctggaatgaactaaaacaaaactggtcacgaggacctcttctacccatttgtacaaacccattactgtgtacggcttcctgatctttgacatgttgtgtttggccacctccatcatcagagctgcctccggagtcctgcaaatcggtctgctctccattggcttggaatgttatctcctcaaaccgcccatgtagctctgcacactggcaacctcgagcagcagatgacatgtaggcataaagtgaaccacatgacgatacatttgatccgcagttatggcagtatgtagtgtcttgagattcctctatgcctgggccaggcctccaatctggcaccagtgcactaacctcgccatcaatcatctcagcaattcgagtaacctcatggtcagttatatctagctcggctaccatctcagttgcaacactcaatgcggtatcggcctctatgtcaaaaggaaaatagatgttccgtacatgccctgcaaagtgagaaattagatatcaagaataatacaatttggcatttttttggtgcactgaatttaacccaagaatttaaggaattgaacatttgtgcataccatcattatctgcaatccgtaatctgaggaatatgcttccatcctcactttttctccctttgattgtgatatccacattgccaagaggctcatcttcatgcccattgaacaagtcaataccatcagctttaatgtcatcatcttcacaatcccatctatcttccgttggtgtatcctcgtcaatgctttcagataatccattactcatcatggagacattactataagcgtgttctaaataaggctgccgcagatagttcatcaggctgtaatctccatcacccggacaaaagaccaaatcgtcaacctgcaggaatgggtccttgagcagctctctcgctgagagcctccgggatgcagtggccaggcatttctcgacgaactgcctcaccatcggatctttgaccttgtacaacgcttccggcttagtaccctatcagccaaaccactagctaaaatcagcaaaaaccgtttcgaactagccacacaccagaatcacaaagtgctgcaaacattacaaggatccaggaggcaattcttacagagatcactttcttgtagatctgcaccgggtgcgtgcactcgctatacgggtactcgaaggtgaccatctcaagcacgcacatcccgaacgagtatatgtccaccagctcgttgtactcctcctcgtacacctctggcgccatgaactccggcgtgcctaaccaaacaatcccacacctccaccccaatcaaattcccgtaaaactactgcaaattgggatcacgagcacaatccagtagcactatctagccaatcagagacgccttac

SEQ ID NO: 88549 - DNA, 584 bp, Oryza sativa
cctcgggaacaaggcgtcaagcttctcgtcgatgtccatgaaagcgagtgcggagcccactccgcctcacgcaccttggttggcaaggcctttcgccagggtttctattggccgacggctctcaacgatgcggtcgacctggtccggcggtgcaaggcgtgccagttccacgccaggcaaacccatcagccggcccaggccctgcagaccatacctctttcgtggccgtttgctgtctgggggctcgatatcctgggtccgttcaggcgggccccgggcgggttcgagtatctgtatgtcgctgtcgacaagttcactaagtggcccgaggcttatccggtcatcaagatcgataagcactccgcgcttaaattcatcaagggcatcactgcttggtttggggtgcctaaccgtatcattacggataacgggacccagttcactagtgagctattcggtgactactgcgaagacatgggcatcaagctctgctttggctcccccggccaccccagaagcaatggccaagtggagcgcgccaacgcggaaatcctcaagggcctcaaaaccaagaccttcaacat

SEQ ID NO: 88550 - DNA, 649 bp, Oryza sativa
ggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccgatcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaagcaccagtcggcggcggacgaggcggccggtcggtgaagacgtagacgcccaacaacggcggcataaaggccagccgtacaggcggaaacaccagtcggcagcggcgaaggcaagccggtcggtgaagacgtagacgcccaacaacggtggcataataggccagccgtgcaggcgaaaacaccagtcggcggcggcgaaggcaagccggtcggtgaagacgtagacgcccaacaa

SEQ ID NO: 88551 - DNA, 3554 bp, Oryza sativa
taaatgatgcacttttctgtttagtgttaactagcaaatgaaatgtaattaaattaaagatcaattttgagattgaaaggaaacaagaaaacagttatcaaagaaatattatgttcctaagttatccccttgtgcacagcatgatggtccaaaagtagtaccagacatcgcagcatcatcttttttcagtttgatcctatccttataacaggggattgttttaatatagacctgtgaactgcaatgccgtggttttttcatggtgacaagaaatcattttgagcttttaacacgatcgatgcaaaaaactgatatcacatcattgaaatggaatcacctggaaaggcagagaaggtgaaggatcacactcccaaagaagatcatcagttttcagctccaagtacattctagcatccagtcgtgatttcccttctaagtaaataaatgataagacatactgtaggcaaaaatgatccctcagtttgtccagtgaatgttgcagactacgtttccactctttgtattctatggagtatatagatccagagccaaggccctcgcctgttccaccaattctcttcttctcggtttggatatcaaaaaatttggatacagctgctggcaataattcatctgctacagtgtatgctgttccaatgagttgaatctgctgggcatcactctctgctttaaattctataggctcttttgactccactagatgatcatcctcagaagctcctggtaagacttcaattagtgcttcaacatatttatcaaatagctggacaaatttattcaaaatcgttcctccaaagtgaactatagtcattggggtaatttgatccaaaacatcctgaaagaagcagatacagagatcagctgcttcataatatagacaacaggtggtgtacattaaattctaaagcaactcgatgaactgcacgctgttctaatttccattcattccataaaagtgtgtcatttccaaatttctgtaataggctatagtattttggtgcctgcactaactaatgctagtgggccacgtatatttatcatatgtatgtgggcgcagggatatgttacatgtatctttggttgctttctaccaagtaaataacataaagcaacggcgtacattaatccaggtgtaatttcaacaaggttttcaagtggtgctagaaacccataccaacaaaaagaaatgctgctatagtgctagaaaccaggaaatcatgtgtatcttaaaatgagaatgcattggatttaatacatatcgagtttagtgacaggatcattcaattacttaataatattgttcagttgaacacaacagaaaactgaattgtcagacacattaagaaaaaaggttgtaataaggaaaatccagtaaaaagaataaaacaggaactcacattgacaatggacatgaacttctttccactgcttgtaagcattatatttggtgcaactgaactagagagccgtgatccttcttgagggctgggaagcagaatatcatcattttttgctgaatctacaatctttcttctcagccttctaaaattcagctcaagcacttcttcaacataggggtgcaatagtaccattagtaaatttgagaatttcaggccatatgattctagataagagcagtgagtgagactagtttggatgcatatgcaggcagaacgaagggcagatacgctctcaggcaaaggagaattttccttaaccaaacgcgcaaaggtttctatttcatattcagcccactgaataatccggttcaaattcatggggctatccccaaatagcgaactagattctttggatacctttgagatagctgagaaaacaatctttgacaaagttgcagagtaagtttctgtgtagatcgaacatgttggaagaaatgcttcaacatttttctgaagacgtgacccataagcttttagaagtacttggtgggctagagaacctttgccaatcttaataaggccagacaaagatttccttagctcggtaatagataaagaaggctgttctgaatacctaacaagctgatcctcaagaattgatttccttttagatagtgctgtcttataggtagaaatctctgcatctaattctttgccaggatcatccgtagccatacatttcttctcttcggtttccaaagcaagcaatgcctcctctattttgtgctccgcgagcaaagtatctaatttatccagaaaactaaccttggaatcttgggtatcatatgacaaaatttcatcaagttctgtttgaaggtctttctcttccacatgttcatccttgcaatgtttttgccacatttcgagttcacggcacacaccgctcattagatcttgcacaagaatcccctgggcagacacatgcttctgcaactcaattaattcttgttctgcctcaacaacctcctcagatattctgcatgaagaaaacaaacaccagaaaacattgcggtagattaaaaacagcaaatgagtgcaaggaagtaggaagaaacgctaaacattatatattactttctaaatttatagcgactcaaagataaaagctgaatcgtgcgttaacaaaacattgatgaacttgggaaaaggttaacttgtacgtttcagcaacaagacttagtaaagaataaacgaccaacaagaatataaagggaaggatccatagagacaacattctctctaatatcagaagggaatgaatcgatcagtaattaacattaacctgaggaaagcgtggtatttcgactgcatattcccgcacaagttttcgatagcatccttcaactccagtagctcagagcaaattttcctgatgccctgttcaacacagcaggtagcatcagtgagtagagtaccatcaccacactagcaagaaggtctcagcaataaccagagtccccagttccccaccagaggccccagcagacacaaatgcaggtgaaccaacacctccatttaagttcaattgcaataaggtcaagctagcctaggttgtacttcagattgcattgcagtttgcttcaattataactcacaccagattgtattatcgcacacgctacacaatcaagattcacaaattataatttgttaaaaagaactcgatgcccaaactgctgcatagattaattagcggttgccccttgcaacaccaccacaccacagatccgaaaccgtaatataaactcgaccacaaagcgagcgaaatagctgcaaggagatggcgagcaagaactagccgagacagaatgtgggagcggggggagagggcggagtggaggaggaatgaaggaaggaagggggggcaaaccttctcggtctgcgactggtaggcggcgcggatggaggactgcggggtgatccactcgtggccagggaagtcctcctccagctcctcctcgctgctgctctccatcgccgccagcctccccagcttcgtcggaacctcctcgccgatcgagagagctgcggcttgcgggctttgcgcggcggtgtgcggcggggaggggaggg

SEQ ID NO: 88552 - DNA, 679 bp, Oryza sativa
gactgtggttcatgcactattgtaaatggatataacaaggtttttgtattcaatgcagcatgttcaggagctgctttggtatatcagatttggattatggtgggtcatactaggggtggcttcatccattgggttaggtaagctcgtacgtgcaagttgaatttagcttagtgaaatggtgtgaacaagcttcaattggttgagtaaaatattgaccaaacatctaaacatttagtattataacttatacaagaagtatggttctgaaggcattgtcatttgtttttcaggctctggtttgcacacatttgtattgtatttagggcctcatattgccctttttacaatcaaggcagttcattgcggtcggactgatttaaagagtgctccttatgatactattctccttaaaatgagaccttcatggttggagaaagactgtctagaatttggaccgccaatgtaccaggaaacaattccatttagcaaaatactgcatgaagttcaccttgaagctgttctctggggcattggaactgcacttggagaacttcctccatatttcctctcgagagcaggttgcgtcttactgctttgctgctatagcaccacttgatcatatgcttttcacatgctcacagcctcacaatatgtccctttttatcttcaatattaatca

SEQ ID NO: 88553 - DNA, 2287 bp, Oryza sativa
gcttgggccaacgccgcaccccccctgggcgtgcagggttggccgggggctaccacatgcatatacttaccttttttttcttccgtattacaataaaagcattttcgatttcttgaggactgtgtctgggccatcgttttcttttgaagaatcttggcttaaattagcacgctcgtgctcgaccctgccctcggtggcccgggccggctaaaatcgccaaacggggcccagaaccgagccgtgccccggggcgtggtgaactccgggggggaatcggcaaaggcccacaatcgggtcatccataaccctcggtcaccgcgctcccggcttggccagtctcgacacgaggatctccccaggcactagccccgacccgcgccgtttgaggctgggacctgggcacgagcccttgttcaagccaagacacagaaggaccgcggcacagaccatcctcgtctcatacacacaacaaacagaactgacgtagaaatttcctctttacttgattgcagattaaatcagtctatacaagaagggggcccgaaggcctcggaagaagaaggaaaagttattaagattggcgggggcctgggggctcactccgacgcgcccgggtcgtcggcctcgtcgtcgctgtcgtccgcatcgtctcctcgagctcctcggggagccgctcgagggccccggccatctctgagaggcgctgggcgaggcccccctggttggcggcgtacttcgcgtaccgcccgccccagaggcccgcctgccgcccggcgcggtctagacgggagacggcgtcccgaagcatgccgggccctacctcgctcgccaagcggagggcctcgacctccccggcggacgagtccagcgcgccctgcagctcggcgatggtgtgttcggcggctgcgaggcgggcggctaggtcgccgtggcccgcgaccgccccgccgctgtgcgctctcgcgtccagctccttcgcccgcgcctcgagctcagcggcccgctgatccagtgcggccctctcggcgcgggcgctttccatattgcggcgcgcctgctcctcccgcgctgcctcgcggaggaacaggctgtccgccagccgctgcgccgcgggctcggcctcctcgagagctcgcccccgctcggtgagcgcgtcctcgcggaggcggagtgcggactcctcttcggcgcaggcggcctcgtgcgccgccagtgttgcctcccgggtggcgacggcgacctcgcggtccgccaggtctctctccttcgcgtccagggcgcgggcgcgctcctccagcgccgtggcgcgagcctcaagggcctcttcgcgctgccgggacgccgcctcgttctccgccgcccgccgttcccgggcagcggcggcgtcgagcttctcctctagctccgccgcccggctcccgtattggaggcggaggtcgtcccgcgcctcgtcgagcacgtcggtggcgatgagggcagtctcccgctcctcctccacctccctggcgatctccgccaggtccctacgacgggcctcgagctgtgagacgtgccggcagtgtgccttgcggcccgcctccaccatggcctccaccgagcgccgcccctcctcgacgcgcgcccacgccgcgtcgagctccgcccgctccgcctgcagggcctccatctgggcacttaacccgtccagcaccgtgctgttcgcggcggccaaggcctgcaggaggggctccgcgctcagtggggcagcggaaggcagaggggagagccccctcggtgtgggtgccgcgcggctcggcccgccgatcgacgtgccggactcgggggcgtcccccgaagctggctcgtcccaagcgtcgcccgaggggtcgggcccgagcggcgcgcccgcggcctcgtcgtgggtggccttggaagtcatcgtcgcctcgggcggagtcgggtcgggggtttggcaggccgcctagcgtgcgcgcgccgcctctgcctcccggacggactccccggcccggcggagtctggcctcctcccgagcggcctcctcagcctggcgaacccggacggcctcctgggcagcctcctcggcttcccggaggcggtccgcggcttctcgccggtcagcttcccgcctccgggcctccgcggtcgccgtctcctcggcctcagaccggccggacttggaatggcgggggggggggcgcgacgggatctcgctgaggcagaagaaaaaccagaagacaaaaagaaacgggtgagtgaaaactcgccttgggagatgggagaatgaata

SEQ ID NO: 88554 - DNA, 692 bp, Oryza sativa
gctctggcccgcagatggacgcttacgtgcgccaggtgcggcgtatggagcgccatttcgacgggataaagcttcggcacgtgcccagacgggataacgcggtcgccgatgaactctcaaggctcgcttcctcgcgagcccagaccccaccggacgcctttgaagaaaggctagcccagccgtcggcgcgacccgaccccctaggggagacggacgcgcctgaacggcccccgaggcccgtcggagtccaggcctcgggacccgaggggagcgctcccagctcccctagattgattgcttggatcactgagatccaggcgtacctcgcagataagactctacccgaggaccgcgaagggagtgaacgcgtccggcgcatctccaagcgctacgtgctggtggaagggaccctctatcggcgcgcggctaacagagtcctcctgaagtgcattcctcgggaacaaggcgtcaagcttctcgtcgatgtccatgaaggcgagtgcggagcccactccgcctcacgcaccttggttggcaaggcctttcgccagggtttctattggccgacggctctcaacgatgcggtcgacctggtccggcggtgcagggcgtgccagttccacgccaggcaaacccatcagccggcccaggccctgcagaccatacctctttcgtggccgtttgctgtctgg

SEQ ID NO: 88555 - DNA, 699 bp, Oryza sativa
atgaagtagacggtccgctgcacctttagggggggccgatcctcttcgccaggggccgcatctccagggcgctcttcgtccgagaggccacgcggggcgcactcggcttctgtgccgacgacctcggggtcagagggcgacaggcgcggtcttcccgcagtggccccggagccatcctgggggtcgggggcgcctggcaccgtcggacaagcaggcggagggccagctccggccgtcgggggccttgggccgccgttcggctcgggggcctctcctccctgctctctcccgggtcgagtcgacacagggtgaggacgcgcggagtgagggttgtcctcgtcgcgctccacgaccaacgccgcgctgaccacctgcggggttgccgccaggtagagtagcaacggctcatctggctccggggcgaccaggactgggggagaactgaggtacgccttcaactgagtgaaggcccgctcagcctcctccgtccaggtaaacggcccggagcgtttgaggagcttaaataggggtagtgccttctctcccagcctcgatatgaaccgacttagggcggccatgcagccggtgacgcactgcacatccctaagcttgctgggggggcgcatctgctctatagctcgtatcttctcggggttggcctcgatgcctcgggcagagaccaagaacccgagaagcttg

SEQ ID NO: 88556 - DNA, 608 bp, Oryza sativa
atgggatgccttgttatacagaaatcacatgggtggagacaatcaggtaaccgatacatttcagagttgctgtccagatttcttttggaccttttgttgttgtactaaacggcaaaccggttcggcttttttgcaggttgaggccatgctcgacaagacgatctgtgcgctgtcgaacgttttcataggtgcatcaggctcaaccttcacagaggacatcctgcgtctacggagaggctggggttctgcgtcccactgcgacgaatacctctgccagggtgagctacccaacttcatagcggagctagactgagaaaatgacatcctagaagaagaattgacagctacatccccctttttttccccactacgatctggtggcatgatacacattctgtaaaatggcgtgtacatcctagtgtaaaagagcgatgatatttgttgtaccggtacccccattgatttgttcggtgttgtacacggttaggcaatagaaagagtttggtttttgcgcttgctcagggttcatactctgttatactgtgagacagcttcatagattcatagctcgcaactttgttgcctagcaacgtgcctgacagacacta

SEQ ID NO: 88557 - DNA, 557 bp, Oryza sativa
gggcgaattcgagctcggtaccccactcgtgcgaactcctctttgtagaagctgaagaaaatcaaggggagcgagttagccatatggagaagaacgaagaacaccggagatgccaaaatttccggtggtttccaagcgcatacctgaccgagccttcctcggaaccggcacgccgatcatttcgtcggcggccttccatacgatggggctcttcggattggagccccctttccgctgcatctgcggctggcctccatggtggtgatggttgtggtagcctccgccgccgccgccgctgctgctactgctatggtgatggccgccgccgccgctgggctggggcggcgagggcggtggcgcggtgctcggcgaccgccgctgcaccggcgggtaccgcggcgcggacgcggcgagctcctcgtcggcgtcctcgtcgtcgtcgccgaggctctcgtcggaggtgtcgtcgtcgtcgtcccggccgccgccgccgtcgccgtcgttgagcatcaacctctcaccccgccgcctcttggagcgaggcgagtccctcggcc

SEQ ID NO: 88558 - DNA, 509 bp, Oryza sativa
acgaactgcctcaccatcggatctttgaccttgtacaacgcttccggcttagtaccctatcagccaaaccactagctaaaatcagcaaaaaccgtttcgaactagccacacaccagaatcacaaagtgctgcaaacattacaaggatccaggaggcaattcttacagagatcactttcttgtagatctgcaccgggtgcgtgcactcgctatacgggtactcgaaggtgaccatctcaagcacgcacatcccgaacgagtatatgtccaccagctcgttgtactcctcctcgtacacctctggcgccatgaactccggcgtgcctaaccaaacaatcccacacctccaccccaatcaaattcccgtaaaactactgcaaattgggatcacgagcacaatccagtagcactatctagccaatcagagacgccttacctacgcagtggacggcgtgggacttgcggaggatggcggcaaggccaaggtcaccgatcttgacctccccctgg

SEQ ID NO: 88559 - DNA, 2399 bp, Oryza sativa
atcctgcgtcaaagaaaataaatcctcaaatttcaattttaatggaaggtacttttgatcaaatctcgggtccgtgtcgaagagaggagaacacgcgtctcacacttttccccaccttttcaccgtcggcgagggcgcgccgccgctgatgtcgcagcagcagcaggcgccggcgccgccgtaccggccgtaccggcaggtgagggcggcgaccccgcacagccgcgccgtctcgtgcgtgaggttctccccatgcgggcgcctcctcgcgacggcgtccctcgacggcacggtcgcgctgctctccccgtcgtcgctcgccgccatcgccaccctgcgggggcacgccgacggcgtgtccgacatctcctggtccacggactcgttctacctctgctccgcctccgacgaccgcaccctccgcatctgggacgtccgccccgtcctcgccggcctcaaccccggcagcggcggcggcggcggcggcgcccagcccgccgaccccaacgccgaccgctgcatccgcgtgctcaagggccacaccaacttcgtctttagcgccaacttcaacccgcagacgaacagcacggtcgcgtccggggggttcgactgcaccgtgcgcatctgggacgtcaagagcggccgctgcgtccgcgccatcgacgcgcactccgagcccgtcacctccgtccacttcatccgcgacggctccatcatcgtgtcggggagccatgatgggacctgcaagatttgggatgcggggactgggtcttgcctcaagacggtcatcgacgagaagaagcccgcggtgtcattctccatgttctcgcccaatggcaagtttatcctcgtcgccgcgctcgacgacacactggtatgatcaatttttactgctattccatgcatttagtgatcaatcagttaaagcagtgaaatttttttgttcagctatcatcgtcttattttaactgaactgcgattgaagctcataaataggccctttggtgctctgagaaaatgttgttatagttgttgaggattggaaacccctgtctgttcatgtataatgtggaaaccacaatttggaggcaacatttttcttccaaattgtagccaaatattatctgtgtacatggagtacaacattgcagattctatctggcttcgggcctaattctctgcttttgttgaagtacacctgacaatgagtaaaaaatccttcttggttctcattaaaatgaaatagcagtggtacactccacattgaatagaagcctatcgtagctttatttctggtattcgccgtggtctttttcataggcagattgttcttccaactgctaattatttaatctagtattactggcggccatatagcacatcttgtttcagtttcacacagaaaagaaattatagttaccaatacaatcaaagatccttcactctgaggatcatttcgttaaagccgttgcccaagatttaaggtaaccaatatgttacatgttgaactaagtatgtctatacttacccagtttcacaccaaacctcatgttcttgatctgtgtggtcttagtactgtgaaaagtttatcttcagatagttatgttgttaaatggttttaaaaaactgcttctgaagtttatttgggcacatcagttcacacgataacagatcactgtttcatgcataattcaagtaattggaggcatatgaaagaaatatgaaacttgcagtgcaaatgttgttatcagtgctttatattagtattagactattaggttgatccatggtattcattgtgcatacatacaccttcactccttcagcccttgtactgtttacatctgtaaaactttatgggcatttaggtcaataatgcttcacatcaagcaacattgtaagaaattttggcattgtgttattctatcatgggcttcctcatgtagtgattttacttcatttttcacggaatgtttttataaattagttatttatttcatttggaaaatatatggttattgcaacctttgcttcataagtatgtccttaccaaatttcagaaactatgcaactttgcaagtggcaagttcttgaagatgtacagtggacatgttaacagaaagtattgcctccagtccgcgttttccgttacaaatgggaagtatattgttagtggatcagaagacaactgtgtgtacatatgggatctccaagggaagaacattcttcagaaacttgaaggccatactgacactgtcatctcggtgtcctgccatccaacggagaacaaaattgcgtcgggcggcctcgacaatgataggactgtgagactatggcttcaagatggctgatgaatttgcagaaggaatgtgcctgatacaactcttgtgtgaacctgg

SEQ ID NO: 88560 - DNA, 527 bp, Oryza sativa
ccatgcccatcaacggtggtgtgaccaaccgaccgtataggcggggacaccagtcggcggcgacggaggcaggccggtggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccaatcggcggcgacggaggcgggccggcggtgaagtcgtagacgcccaacagcggcgacataataggccagccgtgtaggcggaggcaccactcggcggcgacggaggcgggccggcggtgaagtcgtagacgcccaacagcagcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtg

SEQ ID NO: 88561 - DNA, 664 bp, Oryza sativa
agcccgtgccatggcgctggaagatcatgccggcgccgtggagaccagcttggcggaccgcgaggccgccgccgctatccgtgaggcgacgctggcggcgcacgaggccgcctgcgccgaagaggagtccgcgctccggctccgcgaggacgcgcttgctgagcgggagcgagctcttgaggagtccgaggccgcgacacaacggctggcggacagcctgtccctccgcgaggcagcgcaggaggagcaggcgcgccgcaatctggaatgcgtccgcgccgagagagccgcgctggagcagcgggctgctaacctcgaggcgcgagaaaaggagctggacgcgagggagcgcagcggcggggcggctacgggcgaaagcgacttagtcgcccgcctcgcagctgccgaacacaccgtcgcggacatgcagcgcgccctggactcatccaccggggaagccgaggccctccgcttgtcgggtgagatagggcccggcatgctttgggatgcagtctcccggctggatcgcgccggtcgggaagcgggcctctggaaaggccagacaatttcgcgctccaccaatctggaaggcctcgccccgcaccttaggaggatggcctgggctgtccaacaactccccgaggagctcgagaagaccatcggg

SEQ ID NO: 88562 - DNA, 666 bp, Oryza sativa
ttcaccgcgggcctgcctccgtcgccgccgactggtgtttccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccaccggcctgcctccgtcgccgccgactggtgtccccgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatctacaccgccggcctgcctccgtcgccgccgagtggtgcctccg

SEQ ID NO: 88563 - DNA, 516 bp, Oryza sativa
  unsure (1)..(516): unsure at all n locations
cgttcaagccaacaaaaaaagaaaatcatagcatccacgattactaatttctcagaggttttacgcaacaagtcaaaacaggaagctcaccaaggaaatgtgcaaggccagggagcctctcgggatcgcagaagtagcccaccgagacattcatcgacgccgccgcctgcaaacaaacaaagccgggattcacccattcaagccaaaaacccaggaggcaggcaccaaaacccccggcacatccccgatcgaaggagccagcgaaagcacggagaccttgtcggtgtcggggtcgctgacgaggaggcactcgagggcgttggggagcacgacgcggcggtacccgcgcttgtcgttgcggggcctggtgatctccgcgtnggnccccccctttccccccggggccccccccccgcggccccgccgcggcgaggtgcggccgcgaccgcccgtctacgacggctcggcgggggcgtcggtcgtcgtctcncgcgctggcctcgaacccgccattgc

SEQ ID NO: 88564 - DNA, 636 bp, Oryza sativa
atatttgctccccgtgcctccctcctccgtttccgccgttcgtcgcttgctctcgccgtcggattcgtgctcgcgacgtccacctgtctctccgccgtcgccgccgacctccggtacgccgccgacgtcgctccggactccctgccgactcggcgccacctccatcggcttcgccgcgttgtcggcgaccccgtccgccccttcgcttcgcccgccgaccgccggagctccgtcgccctcgtcatcccgaaccgcgccgacgatttcctccgctccgatcgtcgtttccgccgccctcgtcgtcccggggtgagccgtggaccgcccctttcgcttccctctcttctccgctctatcgggtgccgctccgccgcgccgttggtcgccggcggagaccatcggggcgcgggtgcgccgcctcccgtcggccgtgccggggaggcagccttcgggcgcgccccgcggatgtcaggttggcccggcagtcagccgcccgcgcccgcgggtgcggctgacgcgtgggacccacggcgccggccgccgccagccgcgtgcacccggtccaccgtgttctgtgtaggtgacgcgtgggccccactcccgtggactcggtccgcgcgccctctctctcggttg

SEQ ID NO: 88565 - DNA, 2038 bp, Oryza sativa
cgagaaggagacgcccgagagcgagccgccgccgacgttcctgcgggaggacgggtccggggcggggtccgggtcggtgcgggagcggttcgaggccatgatccgccgcgtgcagggggaggtgtgcgcggcgctggaggaggccgacgggagcggcgcccggttcgtggaggacgtgtggtcgcgccccggcggcggcgggggcatcagccgggtgctccaggacggccgcgtgttcgagaaggccggggtcaacgtctccgtcgtgtacggcgtcatgccccccgacgcgtaccgcgccgccaagggggaggccggcaagaacggcgcggcggcagatggccccaaggctgggcccgtgcccttctttgccgctggcattagctcggtaaggcacaattactggttcattttgagtgagaattttaggtgattttgcagttctagtcattgcattgccgtcagagatttggatttcttagcatcaggggtagtacactacactacgattccattcttcagctttgttggcatccgagattccgagtgcaagtgaactgtttaggtggtcagtaaaatttgggagtctttacatcgcagttgtgtgaatgatttggctattgtgggtgtttactgttcacaatgtccatttttaaacttccatgtgctgtttgacaataacaaacagttgttgagaaggaagtgtttgctagattagtgtttgcttttctgtttgaaatgtagtgatgtcattgctatcttattgtgagaacttgaaatgcataactttgaatttggatatgtagttaagcatttgaatgatgaatttagatgagcccgatattctatcgtcttcctgtatattctcataagagactaggaattctcatatatcggaaaattatgtttttaagaaatttggaacatgctgcattttgttagatgcttcagcttcagccatcatttgaagaactgcggtgaccatgtttgccatgcctgtgcaatatttcctactgtctcttgtatcccaagcactggtgactggtccactgtcttgtgctactgtttatgtgctactaattggaccagtagagttataaagagctagatctttagccaaactttgtatttttgttccacgattaaacacactcactcttgtttcaacatatcatacctttccagtaatggaattattccttttatctgcaggttcttcaccccaagaacccatttgctccaacattgcattttaactaccgctattttgagacagatgcaccgaaaggtatttgtgcgaacaatatacactgcataattttagtttcatcaagtgtaggtcaatcttagcaatttttatgattactttctttttccgcctgcagttgatatgttctctgttctatcctctttaaatcttttgtttagatatacatgtgaatgaagctagattttttttttgaaaaaaaaactggatatctgtatgagacatagagcaattctatttacagtaatgagtaaatataaaactcttaacattctcctatatattacgattaatttacatttggttggccatttaaaccacctttattatcaggaactgcgaatctcatcatgcagattattaattcataatgctctactgcagatgctcctggtgcaccaaggcaatggtggtttggaggtggtactgatttgactccttcatatatcattgaagaggatgtgaagcatttccattctgtatgtaacagttcctgcacatttcaaagccatatgtcctagactcctaggatcaagagttttatttccctcacgtagccaaaacactgttatttgctacttcgtatacatggaactcatttaatttttatgccttttcaggttcaaaaacaagcgtgtgataagtttgacccaagtttttacccgagattcaaaaaatggtgtgatgattatttctatattaaggtacattcagtttcttattgcgtgctatagcaattaagaaaggttctttaatctctgcatatgctgc

SEQ ID NO: 88566 - DNA, 700 bp, Oryza sativa
attcctgcagccccgattactcgcgtgttcttggtgcctcgtgtctttttttgttatcaaagggatatctgaaattgcagccatggtcgacactgttcaattctacagagaaatgtgtttactgtttattgtatttttatatcttatcgatctctctcactgacattcttttctttaccaatcagtatatattgagaagagattgggagtaggagggggaaatgcatcaagcctgcaagacatggtagtaatagtatgaaccaatgtgacagtgtgctgattattattattattattattatatctgaaacctgatgctctgtgtccctgattgaattaattattgtgatgaaatgcagcacaggaaggagctccaggcaaggacaagggaccagctccagacattggagttatctacgtctttgtacgacacggcgtgggtggccatggtgccactgcggggttcccgtcagcatccgtgtttcccacaatgcgtggagtggatattacaaaaccagcaggatgatggatcttggggtacaagaggattcggcgtggcggtcacaagagatgttctgtcgtctacgttggcgtgtgttcttgcactcaagagatggaatgttgggcaggagcacatcaggagaggtacaaacgactgtgcatttacctgtcgatgtttgttttaattgactctgtatgt

SEQ ID NO: 88567 - DNA, 699 bp, Oryza sativa
gagtgattttgatgcaaagtttcatggaaatgctcttgacataaggtgctgtattttgtttgcatagttttcttcttttgctgcaagtaattgaaggggaggataagggcgatctttttaactgtgtgagttcctcaggtatcaattcataccacagatgatctttctgaacagcctctttggctacttagcactcctaattctcatcaagtggtgcacgggctctcaagctgacctatatcatgtgatgatatatatgttccttgatccttctggcaatcttggagaaaatcaactattttggggccagaaggaacttcaggtttgtataaccttttattaacaagaaaaaggcttcactacctcattttcctgccagctaacaattattactctccgttcagatacttttgttgcttatggctattgtagctgttccgtggatgctcttcccaaagccttttatcttgaagaaacttcacaaggaggtagatttttcatgaaaattcttatagttgatcaacaaagcatttcccttttgagatgggcattgatttgttttcatgttctagtactgcatgcataacttgacaaccacagaaaccactgccattacatactctgcaagtacttgtgcacattgttagtctttttatgcaatgggctaatggttagagttatggcttagggttgtagggt

SEQ ID NO: 88568 - DNA, 4259 bp, Oryza sativa
cccatcacccacgcacggaaaatgaagtgtccattagcgtgtgattaattaagtatcagctaaatttttttcaaaaatatatcaatatgatttttttaaaaaaagcaactttcatatataaacgtttttttaaaaaaaaacataccgtttagtaatttgaaaagcgtgtgcgcggaaaatgagaggagggagttgggaactcctggtattgaaacacagccttagtgctctaaggttgtgtaatactacatatgcttagaaataaactctactcctttttttcgcttgacaaccattattgctcgttatggatgcctgaaaatcaaagatgttgcttgttgtctcagaacaaggaaagtgttacttatatgttgccatgagaaaagcaccatacattttccccacaatatagttgaacacactttaaaaaaatcttcattttaaagtttcaaatcactgcattaagaatacaacaagacgttagaaggatcaagaggatagacatctgcaccggggcaattccattagttgcaaaaccggaatatttctaatggtcttacatcagctctcattctctaatagaaggcttttattgtcttagaagattcagataggctgatagctgggctattaggtattgcatgattgatataaccctggcatttatcattaggatgcgcaacgtacgtatcagctgaaatgctcaaacggcatacttttcgcttgcttcacctaaagaaagtcagaaaaaatcagctgtccattgctccattttgctgaacatgggttcacgtcacaacgtggccgcgctcgttaatcagaaacacctttcctcctaccaggaataatacaataaaacaaggtgctgtctatacaactattaaaaaaaattctctcgtatatatagtcttcccatcgctctgtatcaaagattcaatgggctatccccgctaaaaaaaaaagattcaatgggctaaactaactcttacacacacttattagccttttgtttaggtttatgttttaagtcgattttttcttatatggtttataagtcattggcttttaaaccttaaatttaatggtgtaatcctatctcatcttgcattagcccaataggttactctgacataactttttaacataacggtgtaatcgtggtttatggttttaaaagagccaaacaaaaaaacttgccttgttgcttagacttagatttttttataaatcgtctaataagcctaaataaagaggacctaaagatataagcctaatcttcacctgcgactcgttcttaccagtgaggcaagtcattcccaacctccactcctggcgatctccaacaaggttacctacgccattgatcttctccatctccacctaactaattagcatattcttcctgatattcggtgaggtacctctactttgccaatctccctcatctctaaccgatcctactgttgattcatcatcaccatgtaaccattcggccaatattccccgtcactgcccacctacggcttcagaagtatcgccactgccttgtcgaccccttatccaccacccgtcgccaaacaccatctcgacctccctttaaaccaagggtccccctcccccttcgtacccctaccacctctactgttattaactgttagggggtcaccatcgttctcactgtgggagaatcgacatatcgcgagctagagaacaaagatctcgcacacaaatcttgaagccaattagatagtctaaaacatgtaagatttattcccctgtttttctatcaaatgactgcaagtagcccctccattttatattataagacatttagacttttttatagtaatttttttttcacttttaaccaaaattatagaaaatttggaaacatctacaacaataaattagtttaatttaatgaaacggtgaatatattttgataatatgtttgttgtgtgttgtaaatattactatgttttttattaacttggacaaattttaaaaagttttactaaaaaaaatcaaagtgcctcataaggatctactccctccgttttacaatgtaagtcattctagcatttcccacattcatattgatgttagtgaatccagacatatatatctatctagattcattaacaacaacatgaacgtgggaaatattagaatgacttacattgtgaaacggaggaagtatctacaaatatctcgccataaaacagaggcgaaaaccatcaaatttcgggactataggatacaaagttacaaacttaatcaccacaaatcgccaggcccatacaacatcgacaaagatcattggtgtgggttggtttctcattaggagtcttagataaatgaatcagtacttataaaaagtataccaaagttacgctacaattacatcataattttattcaaagttacatgaaaggtgttaaatgatcacactgaattctaaacactacggcgactgcattgttgcccagcgccgtagtgggcatggtgcacatcaaaacaacttcagccagcacaaatctagatgaatatcaaaagtttaaatatcgaatgtaatcgggcgaaaattatatcgctggaagtatagtatgtccgtcttatatataatatagtgagggagtagcaaatccgataaaacaatcacaacactgagcaacgagacatgagtcaaaagccaggaaatctccaagcattgccatgaacccatgatagcgcggagggcaaaggtgaccaaccgccaccccccacaaaaacaggggccgttcgtttcgttgatgggcgcaggcatggtggtggaagcagcaaggggccctcgtgggccacgggtctcatgtgacaacaggtgacgctgggaatgcgccactacaaactgtttctctgctatgtgatgtgatgcgatcatggggatgggccgcgcgccgggatccgcatggataatgctgccgcctgacaggatggatgctgatgtggtacgtgggggggccagtgcagagcgcatcgcatcgccatcgccacgccaatgcatggccagcatatgggttcttcttcttcccttctgctgctgttgcaacttgcaggttgcaaggcggttgggtgacagtatcaggcccgtagtatggtttgtgctttaccacggtctaaactcttcgtttgtttcatctgggatcctgacgaaaaaggctggtgatgtttgctacgaaatgggctggcccaagacagaaaagggcccaggactgagaaatgggccgaaatgtttgaatcacgccgattgaagaacaaaaggttacatacaaacagctctcatcggtgaatctgagagaatcagaactgacgaaaactaacaaaaagcctaatccaatctgtcacgcccggatgaattaacccttcatataccacgtatgatacagctatgagcacgtttacccccaaccagtacaagcacactcctatgtttttctcctttttccttttgtaccaaagcaaccggcaaaaagaatttactacaacacgggaaaagatgagcaaattccctagcgcatagcgcgcgcagtttgattctgatcagcctcatttcttccacatgccgctgatccgcctgagcacgttgccgttcttcctggccgccgcgtcgtcgtcgagctcgtcccacaggccggcgtacttgccgccgccgccgccgcctccttcaagcgactcgctccggtccaccaccttcccgttgccgcccttgcccaccgtgagcagcgccatggcggtctcggcggccttcctccactgctcggcctgcacccgcagacgcctcagctcggcctccatctcccccttcttcgccgcctccgccgccgcgtcggcggcgtccgtcgccttcgccgaggccttcttctcggaggtgtgctgctgcagctcgcgcttcagctgcccgttctccaggagcgcgccctgcagctgctccttcagctcgttgtccgttctcgtctcggattggagcttctcgttcgcgtccagggcgcgccgcagctcggagtccttgtcgaagaggctcgccttgaggaagatgacctcggacttggtgctctcgagcgccgcggcgagcttgccgtgccgcgagtcggactccatttttatctggtccatgagctcgtaggcgcactgcgtctccactgtgctcaggatgcgctcttcttggaacctggcctccgtggactccaattccgacctcagctcagcgacctccgatgccg

SEQ ID NO: 88569 - DNA, 532 bp, Oryza sativa
aaggagaagccgaggtcttagattactggtacatcttggttggcaagcatggaatagacagaatgaaaggctttagatgctcaagaatgaaggctttagatgctcaagaagatggttccttgctatgtttaaagtgcgctctttatattgttaacttaagattgtgttggtaaaaaccatgccttgtcagatttttgcttctgttaaggggaaagtactgtgctgagctattttctccgattttgaggcgccaatgttttgtttgtttctttgatgactccagctcgtttcgttcatctgttctttgtttgagcctgaagcatcgtttagctattgatttttatatgctcgtatggtttccggttatcttcgtcggcgtccctttgatttactggcttactgctagtcacatgcacatatttactgtgactctaatatgatacctgcgcttatgttttgcatttgcttggattcatccctttgattcatctcccaaacggccaaaccatccgatttgtgctgaattttttga

SEQ ID NO: 88570 - DNA, 577 bp, Oryza sativa
gcatgcgtgacactgtatgcacttataacatggagaacagtattgattaaatatttatacacgactttttgacttatttagtttgtctgctgaatttttttgaaaccataattgataattttaggggtgaaagaagtgttattttgagaaggatacctggtcttttggatcaggcaaagaatcaatctcagtgttgacagtcaggccactatacatgtcatctgtacttccagaactagtttctgtcaagtcacttaattgttctgttgataaagacaccaatggttcagggtcacgcttgaaattatagagctttgacgcaaggccattggtgtccctccaaacacgaagaccttttgctctctgttccattgaagatataacagatggccggtgtttatttcgcagttcttgcagccttgcttcgtctacagcttgataacccatgcatgcagttaaaacaagttggctgctgtcaaaagtagaaccagccaaagactgtaaaagggtcacagcatccccagcatcctttgttgtcacaagcgcaggacctgtaaccaacaccagtggtaagtat

SEQ ID NO: 88571 - DNA, 653 bp, Oryza sativa
ttagcactcctaattctcatcaagtggtgcacgggctctcaagctgacctatatcatgtgatgatatatatgttccttgatccttctggcaatcttggagaaaatcaactattttggggccagaaggaacttcaggtttgtataaccttttattaacaagaaaaaggcttcactacctcattttcctgccagctaacaattattactctccgttcagatacttttgttgcttatggctattgtagctgttccgtggatgctcttcccaaagccttttatcttgaagaaacttcacaaggaggtagatttttcatgaaaattcttatagttgatcaacaaagcatttcccttttgagatgggcattgatttgttttcatgttctagtactgcatgcataacttgacaaccacagaaaccactgccattacatactctgcaagtacttgtgcacattgttagtctttttatgcaatgggctaatggttagagttatggcttagggttgtagggttgcgtcttctcctgattgaagtatatccactggagtgaatagatgagctgcctaatccaaaacattatttatttagcagaaatattggattaatactccttccgttttttaatagatgacgctgttgactttagacataca

SEQ ID NO: 88572 - DNA, 526 bp, Oryza sativa
cgaattcgagctcggtacccactgaattaattaacgaatggccaattcaacgacctcattaatgaaactatgtgaatggcaactggctaatcacagtgtagtagtacaaattgctaatctagttggattctagaattgatcaaagctagcaggaagcagctgatacctgcgccgggggtgatgcagacgagaccggtcatcatgccctgcacggcgccgatgacggagggcttgccgaagaagatgacgtcgaggcaggtccaggtgaggaggctcgccgcggcgctgacgttggtgttgagcacggcgatggacgcggtgatgtttggggcgtacggcgcgccgccgttgaacccggcccagcccagccacagcagcccgccgccggcgatcatgaggaggatgttgttcggcgagaaccgctccctgtcgctcttcagcctcggccccacctgtcacaaaaaaagtatttattaatcgccgtcacgtggttaacacttaacgccgtcgcgattcgtgccacgta

SEQ ID NO: 88573 - DNA, 554 bp, Oryza sativa
aaatccttttcacggccactaagtgacactccttaggagcggcttgaaaccgtgcacacatgcaaacactaaacatgatatccggcctagatgcggtaaggtaaagcaagctaccaatcatggaacgataaagctttaaatctaccggtttacctccctcatcaaggtcgagatgtccgttggttgccataggtgtcttgatgggcttcgcatcctccaaaccaaacctcttgagtagatccttgatgtacttggtttggctcacgaacgtcccatccttgagttgcttgatttgaagtccaaggaagaagctcaactctccaatcatggacatctcaaattccctagacatcatatcaccaaattccttcaacttgtgtgaaaccttgcgccaccaaccttgccttgtttctcaccaccaatccactttgttcctaaatatccactttgtccctatgacattgtggtctctaggtctttcaaccaaagtccacaccttgtttcttgcaaagttgttgagctcttcatgcatagcattcatccaatccggatca

SEQ ID NO: 88574 - DNA, 610 bp, Oryza sativa
ccctctctgcgcgggcgccttccagattgaggcgcgcctgctcctcccgccgctgcgccgcggcctcggcctcctcgagagctcgctcccactcagtgagctcgtcctcacggaggcggagtgcggactcctcttcggcgcaggcggcctcgtgcgccgccagcgttgcctcccggatggcgacggcggcctcgcgacccgccagttccctctccttcgtgtccagggcgcgggcgcgctcctccagcaccgtggcgcgagcctcaagggcctcttcgcgctgccgggacgcgtcgagcttcttctctagctccgccgcccggctcccgtattggaggcagaggtcgtcctgcgccgcgttgaacacggcggtggcgatgagggcagtctcccgctcctcctccacctccctggcgatctccgccaggtccctacgacgggcctcgagctcggaggcgtgccggctgtgtgccttgcggcccgcctccaccatggcttccaccgagcgccgaccctcttcgacacgcgcccacgccctatcgacctccccccgctctgcctgcaggacttccatctgggcgcttaacccgtccaacaccatggtgttcgc

SEQ ID NO: 88575 - DNA, 709 bp, Oryza sativa
ttcctgcagccctagatgcattggctgccagctcgatccgcaccgacgatactccggcgaggcaaagcgcggcgtaaggaggaggaggaaaagtggccgggatggagtcggtcggcgacccgcgggatgggccgtcgacggagcgcgcgttcgaggggcagcccgtcccgccgtggacggagcaggtgacgctgcgcgccgtggtggcgagcgtggcgctgggcgtggccctgagcagcgtgatgatgaacctggtgttcacgtcggggatcatcccgtcgctcaacatctccgccggcctcctcggcttcttcttcgtctacccttcctctgtgtgactaaatttgccatcaatagaacattgtatccccgataattttgtagcagtggaaaacgggtgacaagcgtccatcgagaggagccaggcaatggccatagttagtgaacacattggcatagctctgggtggaagagagattcgagcaacttatcacggattgtagcgtgggtggaagagattcagtcgacgctcgagggtggcggcaaggcaagatagcaaccgtagcaataatatcctcgttcgtcgctccacaccaccatattggtggtctaaggggcgatgctagagataggagccccagcctgattacccatggccctagcctgaaccacatctcatcaagtcacgtaccgtttccagccacgtcag

SEQ ID NO: 88576 - DNA, 1388 bp, Oryza sativa
ccattccacgttcgagagcaaactgtatctgagcttcatgctcatctttgggtgcaacagacatagtaatgacattcctgtcagcaagtatccaccaaagctggcaacaccgcatccaacatccagaacagttcttgtatgggtcccccattcaatgtttggcatgatctattaaatcaacaaggctggaagtaaacaattataacaagggataacatcatatcggatactttgaagcaatatattttaactttgcatgattatcctaggaatatatgtccatgtttgcttttgaaccaccaggatccatattaattttaggaatatgccacttaaacactgaacttaggctgtgaagttgtttcacagacaagcataaatttattgtcttaatattatgaaacttatctacgacttaacaacttctaaagtatatacctgttgaataaatcgaatgtatttagtcacaccagctttaaattgagttccacctccagggaaaacaaaataattgccagacttcctaacccagttctggtccttcttgtattccactaactttggatgagggacattattgtaccaaatctgaaatttgcagaggaaatatgtcatcacaagatatagccacaattggcttttataaaacagaattctagttgatgaacatcttgtggacgatgccacaattggcttttataaaacagaattctagttgatgaacatcttgtggacgatagttgcacagataaaatgcacgggtctttctgatttgacaaaaaaaaaatcctactacctagtggatatgcacaattctcaacctggcaacatacattagacggggacgttgaagccacgtccctaagaccctaacagtgttctccattatggtttccaggttcatttgtacatataagttcataacagtagctagtttagtaacaaaatactgaagaaactgcaatgtttgctttgtttacttggatgcttaaacatgctagtttgggttgagtatcaccgatcacggcacagccaaaccacacggcacacaacagactctttgtcaggtactcctatgggacaagatttagcaatatcaaattaccattactaccatttcaccattgtggaatgaacaaggtaaaaccgcttcctcgcttaccgaagaaggcaagcagtcatgctcaccatgtcacggctgcgcggccacggcaagggtgaccggtaccccgtgggcagcggcacgaggcacctcggcctcggcgccgtcgggcagtggcgctcccggtgctccatgtgacgcagcgacttcaacgccttcaccgccttcacgttgtccaggcacggtatgtagtccgcggccaccactcccttccccacctcgcaca

SEQ ID NO: 88577 - DNA, 1223 bp, Oryza sativa
ttcctgcagcctcacttcttccaagtatggcgagaaacacatgctgtcacaaggtagttcatcacatacctttcattggatgcactccaccatctagtggacaagactcacttggatcacgtcgtactaggttttcaagagccattaagatggccttaattgacaatccgaggcattcacgaagagcagctacttcaggattaaaagcatcatcaagaacaggaagtatatcacgtacagcatcatacatatcaactatgcggaatagacattctggattttttccagcagcggcaataaaatttccgaaggataggagttggagaaatggatgacacgcagtgacaaaagcaacgtcactgtaggatgtgaaaccctcaaaaatgctatcacacaggtgtctttcacttgggatcaagatgtgaaacacaacacgaattgcagggatccagcacatgatttgaatctcaagctcctcccacgatgctgacttgaacatctctgccatgtgagcatgaaccccaaggcgtgcaatgctctcatcaatgaagttgaggcgtgaagaagcataggtctcagcacatgaatcaccaaaaccagcggcaaccatcctctttgcaattcggtttgcctcaaagattacgccctcaggtaaagcatcaacaatgatgtcgaagttgctaactggctgggctacaagggtgtgcctatcatcatcatcatcatggcttttcctggtgttggggtagctgcagttggtatcgaagccagatgcatcaatcaggtgctgcaactcttctccaagcctcaaggaacaacgctctagaagatggtcaaaactctcaaggaggatatggtccgctgacatgctttcaaggctgtggatggtggaagttagttcatccacagcttctaagaaggcatcagcatcatcagaactagaccagaggggccgattcaagcagagaaattgggaaatcaggtcgttaagtgcctgcagagtatcctccatgccagccatcaccctttcttagattaaattccttcagatctgcaactttggatatatgaacttcttgagtcttcagtgcaagccatggaagaggatggtgcagtccagtccaaagatctgcagctgacaaaattgactaggatgaatgaaattgcgaacatacctcagtgaagacgaattttgaaattggtgatgcaagggctgcaggaat

SEQ ID NO: 88578 - DNA, 2245 bp, Oryza sativa
ttgacgatagatcggggattgagatcttgagatggcacggacactagacaacaagcaaggaaacaaaatttcgcaattagggtttttgagagataattttcccgctaggcgccacgacggaacgggcgctacaagcagccaccgccgccgcccttcgtgtccgggcttggcggggacctggtggtggttaagctagtgtccgcgacggtgccgaggtggaagaagtacgacttcgccaggtgtaaggtgcagatcatggcgatggccaggttttgccacccccgcatcctcttcgatgaccatcgcgatggcgtgtccctccctgccgcgctcttgacaaacagtgttggtgatgatgtggcatcctgacatgtggggtccacgtgggtcccacgctaactcaacctccacgtcggataaaaccggggtcaaaaacaccaaaggatctaaaatgaacggttttgtaagttgagagatgtcatatatctagttttgtggttggggacgatttttgtaactcgatgacaagttgagggaccttcggtgtactttttacaacggactttgacccctcggcccggtagaaccaatttaactgacgattgcggctcataggccataacccatacatgtctccgtacccatgcggcccacgttcacggtttgttctcctgtgatctgctgggtccgcacgacgcgggcctaccacagacgaacacgaacatagcgtgcgcggccgaacgtggtgtgtcctcgtctccgctgcgacgggcgtgggcgagcaccaccgctcgtctacgcgctcgagcatcagatctcatcagatctcgtgagccaccgtcgcccggcggcaatggtcaagccaaaggtaaggatagtatgggtggctatcaaacacccgatcatagtgctgccctaataaattagggtaatatgatattatctattatcttacattgacagttttggaatcaaactaaacctaacctttttcatgagcttctagcattgatgtgtagtcagcgtgttgcactggaccagttttttgaaattttagaatctgatttttaggattaattttaggtggtttcttccgcagttttgttgcccaactcttttttattttttcatgtttgctattcctaagtaaacaagtaaaagaaaccagctaaatttattcttaaaatcaacatttcaaattaaaattagcttcgtcttaaaagccgaagaagctatgccaaatactggcttcttaaattgcatgaacaaaataataatagagaggaaacacatcacttacacaatgctttcttcacctctgaagcgcttcgaaaaaaataaactaaaggtaagtttcagcacgccaacgtacgcccctctctggcggattcaggtccggcctgtccattctacacccattgctggggacaatatcatagtatttgatgggtgttcaatccaaacagacgagtcaactgtgaagcatgcaaagaaataatatacccgagacaacacaaaaagcaccggtaacaaaatagcttgggagtttactgttgttactttgcaagaaggcatgaaaacatcattgctaaatatacgaaggtaaataccaatgaataatcaagacatgctttcaaaatccacaatctgttattgctaacctattggctattgctgtagccataagttctttaatttgtacacaacaaaacggaaacaaaagaatcaactcagtaagcccgatggttaatatggactgctaactacaaacagagggaatgaactcaccgttgatatggggctaatttgtgtcatctatgctatgcgaagaatccatgtaattagaatttaaagaatcaaatcagttgtttgatttttactaacagcaacagaagacgaagcatgaatcatcttgactcagaacctgcactgtatgggcgccagaagccctttgtagcgacaagaaattgttgcttcacaattgcagtcctgtagtgcaaagagcgaagaactggatccatttttctaatcacttgctcagtatcttgcaacacgaaccattttccaggtctaagtatcctatcaatttctgctgctacttcaatgatatcacacctaaaatacaaaagcattaataccaagcttgcttgattctgtacgttggtagaagagaataatgatatttaaacagaacagttctcaaagaatcaagacatgatttttcacctatttgtgaggccctgaa

SEQ ID NO: 88579 - DNA, 9917 bp, Oryza sativa
taggtcccagaccatactgtgccaggaagcccaggggtcctctccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggatttggaaattcatttagttcgcaagcaccgacccaggtgtcgggttttccaaggcttttgtaaaactccagttttacccaagttgttacttcagattttaaatttgaaggcgaccgtcgatattcgcacagagtgcacgagtatcgagtcgcatctgggtggttacaaggggacatggtgtaacaattaacaacggatggatcaaatgcaacaagttaggtaggtccgccaatctgccttgcagacgggacaacagattaagtgtgatcctatcaatgcataatattttgcaagcaatataattaaatttcaaatataggctcaagttgttcaaaggtggcttgccttgctcgagatctggagcttgatccttgaaatcctcgcactgcgggtcttcgggctccgaaactacacgcgaaacgggacaactcaacaaacggcgaaaataaagccctattaatgacccctaagcgtgccattaggtagatctcgagatttgggaaattttggaagttgaacggagtcaagcggagttatggttggaaagatattgaatttctaaggttattggattttttttggtctaaaggaaaaaggatttaattaaatcccttttggaaaaagaaaaaggaaatgatgaagggagggactctagactttcctcgggcggctagggcgcggcccaaaggtattcggctcggtccggccgagctaaacgggccggacggcccaaagcggcccatttacgcgcgcgcgcgggagaggagagagagagagccggtggaccgggctcacctcgcgcggccccgggtgggacccgcttgtcagcggctcggcccaccgtgcggagggagcacgcggcgcatgcgcgcggctcgcggtgagggcggaggcggcgggcccacgtgcagcctcacggcttaccgcggaccacgcgcacggggagaaacggagggagcggctggccgggtcggcttatctggtcgcggccgaggtggcgccgacgtggcgcctacgtggcagccacgcgggtcggcggaaggtagacgaaggcccagccgaaacggacggcgggcggcggcggcgatcggcggagcgggccacggcgatacaagcgacagcgagtacaccgggcggtagtacgggacgagaggagacgagccaacggctcggattcgccggaggtagctcggcggcggcggattgcggcggcggcaaccggcggcggaagaagagggaaacggcgatgaggccacgagaggtcgatttccggcggtgagagcatctacaaggccacgggaactcgatgctagggttggattggacggagctatgccgagctgggctggcgacgtgcggctacttcggagctcgagcggcgacggcggcgagcacaaggcgagcaacggcatcggtcggggcggcgccggccaactatgggaggtctactcgagctaaaaccgaagtctaagggggggagacggagcgaggagggagaacgaagcgaaacatcaccgcggggagggagaggcgctgtgacgagaggccgacggcgcgggagtgacctctccggcctcgggccggggaagaggaagaagaggcgcggccggagtcctcttcggcgtccttgctcgtgccggctcctccgacacgcgcggcgatgattggggacggcgaaaaaaagagacggcagtggaggaggcgaaaatggggaggaaaggagaaggggaggccgggggtttaaggaggcggcaatgtcggtttggggaaccgacttgcgcggtcaagagcgcgagctggcgctcggctagcggccaaagcggtggcagacgggatgacgccggcgggagaggaaaaaggaggaaggggaaaaggaggaggagaaaggaattctctcctttgccgattcgggaaaaagagggtgggcgcggggcgacgacgcggcagagggaggtgaggcgcggcctccgggccttggcggctagcgcgcggagtggcgggggccggtgatgacgacggcgggcggtttggagcggagcggcgacagcggcgactggcgcgggcagagctgacggcggcggcgaccgggcggtcggccactcggcttgcgcgggcgcgagcggctcacgcgcgcacgcgcgcggcgcgcgggcaaagcggcgggatcgggagagagcgagggagcgcgagggagagagagagagaggaaaaaggaaaagggccggggaggcaaagcagactttgcggaggaaaaagattcggaagatttggattcggaaattggaacttgacgatagatcggggattgagatcttgagatggcacggacactagacaacaagcaaggaaacaaaatttcgcaattagggtttttgagagataattttcccgctaggcgccacgacggaacgggcgctacagaccaacccccctaacaaggatctcgaccccgagatccagcacctaagggagcagctccggaaactcggcgcggagaagatcttctcgttcccaggttgcctcatcttcagaatgattgctccattggaccttgtagaacttgatggtctttcttcgagtctgacgttctgcttcctcaagaaccttgatcggtctttccttgtaggtcagattcttttccagctcgatgttacccaggggaacttgctcttctggaactcgaagacatttctttaactgggatacgtggaacacgttgtgcacatctgcgagaccttcaggtagctcaagctgataagccacttcgccacgtctggcggttatgaggtaggggccgatatagcggggtgctaacttgccggacatcccaaaccttctcattcctcggagtggtgatacccgtaggtacacatgatctcctttttcgaactcaaggtcacgcctccgattgtcagcgtaattcttctgacggttctgtgctgtcttcaaacgttctcgtatcagcttaacttgttcttctgctgacttgagtatgtcaggaccgaataccaaggcttcgcccacctcattccagcacaagggagtgcggcaccttcttccgaacattgcctcattcggcgacatctgaatgctggcctgataactgttgttgtatgagaactcggcatacggcaaacaacgatcccaagtgccttcgaaatccaaggcacatgctcgcagcatgtcttctaggatctggtttactctttctgtctgaccatcggtctgcgggtggtaggccgtactaaaattcagatcagttccgagtgcttcatgcaattgcttccagaaccttgaggtgaactgagtgcctcgatccgacactattttcttgggacagccaaatctacatacgacatgagtcatgtagagttctgctagtttctttccatcataggtggtcttcactggcacgaaatgtgctgacttcgtgagtcggtccacgattacccaaatggagtcgtatccgctgggggttcttggcaaaccggtgatgaaatccattccgatctcttcccatttccactcgggaatcggtaagggttgtagcagtccagctggcctttggtgttctgccttgactctttggcaaatgtcacacagggctacgtattctgcgacatctcgtttcattccagcccaccagaagtatgccttgatatcttggtacatcttcgtacttcctgggtgaatggagtaggcggactcatgagcttcctttaggatgaggtctcttaactccttcttggccggtacacagatgcgtggaccgtaccaaactgtgccttgatcgtctatggagaagttggtgtctttcttctcctgtattctttctattaactcttttatcccttcgtcttctttctgtgcctcccgaatttgcgattctagggtaggctgtactgtcaagctggcagggactcctgactgtaccacggtcagccttaacttctccaattctctgcacagttgaccttggtcaggccgtatttgagctatattgcaataggccttgcgacttagcgcatcagcgaccacgttggctttaccaggatgatagtggattccaagatcgtaatccttgattagttccaaccatcttctctgtctcatatttaactcggtctgagtgaagatatacttaagacttttgtgatcggtgtatacttcacatctgttcccgattaaatagtgcctccagatcttaagagcatgaatcacggctgccaactcgagatcatgggtggggtaattgacttcatgaggcctgagctgcctggatgcataggccacaacctttcgttcttgcattaggacacatcctaagccctgtcttgatgcatcacagaagatctcgaagtcttttcggatatctggcaaggtgagaactggggcagtggtcaatcttttcttcatttcttgaaagctgtcttcacaggctgtggaccattgaaatttcttctccttctttaacagctcggtcataggtctggctagcttagagaatccttcaatgaatcttcgataatatccagctaagccgaggaagctgcgaatctctgacacattcttgggcgggttccacgcaagtacagcttcaactttgctgggatctacttcgacaccgttggaggagatcacgtgaccaagaaaagctactcggtccaaccagaattcgcatttcgagaatttagcgaatagttgatgatctctgagcttttccattatcagcctcaggtgttcagcatgttcttcctcgttcttagagtatatcaggatgtcatcgatgaataccacgacaaactggtccaggtattccataaagattttgttcattaagttcatgaagaatgctggagcattggtgagtccgaaggacattactgtaaactcatatagaccataacgcgtcgagaaagcggtcttcggaatatcttcagatctgattttcagttggtggtaacctgacctcaagtcaatttttgagaagactcttgctcctttaagttgatcgaataagtcgtcaatccgaggcaacgggtacttgttctttatagttacttcattcagggctctatagtcaattaccattctctcagagccatcctttttcttaaccagaagcactggggctccccaaggggatgagctaggtcgcacataacctttactttccagttcttcgatttgtcttttaacttctgctaattcattagcggccattcggtagggtctttttgcaattggagctgtgcctggtgccagttctatggcgaactcaatctctctatctggtggcattcttgttaattcttccggaaatacgtcgggatattcacagactatgggcaccgactccaaggaggtgcttgcaaacaggttaggatagaccgacttgcggtaggggtgttaggggtaaagcggacttgctttcctccaggtccttgcaaggtgatggacttttcggcacaatctatctgtcctttgtgcttagccaaccaatccatccctagaatgatgtccaagctttgcgagtctaggactatcggtttggctaggaagtcaacttcctcaattctaaggttaacttccgggcatatttgagttgcccttatatttcttccaggggaatgtactatcattggtacacgcaaattttgggttttccaaccatttcttttcacaaaagcttgcgatatgaaagaatgggaagctcctgaatcaaacagaactattgcgggtacggagttgacagagaacatacccatcacaacgtctggagcatcctgagcggtttcagcttgaatgtgattcacacgtcctcgaccaaagtggttggaagcacgggaaccttgtccacttgcctgagagctaggacgagactgagctgccgctggagtaggagttctggcggtgctgccattagcatgccctgagttggtgttggtaggattctgaggacactgtctagcatagtgacccatctggttgcaccggaaacactgaactgctgacggtccctgtggtgacttgaaggaggtaacactgtttggcgcagtgttgccactagggcatgcttctgtggctgaggtgccggacggtttatctgaggacgaggggcgtagcctggctggcggttagtctgagtgaccgactgatggtattgcatgggttgaccgtagcgagggcgaggtgcgcctcgggaagaatttccctgatggttagacttgcgtttcttgtattcttcggtggcctcttttctggcatcctcaagtagaagtgctttgttgatcatatgttgaaaagtggggaagtcatgagcaagcaactggagtctcattccaactgcgattcctttcaagaatttcctgatctttttcttatcggtgtctacttcctcaggggcgtaccgagccaacttgttgaactgacttaggtactcattgacactgctgtggccttgcttaagtctgttaaattcttctttcttcatgtcaatagtgctttcaggcacatgagctgcacggaaggcagctgcaaactcatcccaagcaatgttagtgggttcaggatgtgcattgcagtaattctcccaccaatctgcggcaggtcctcttagctggtgagaggcgtagagcgtcttctcaacaggagtacactgcactaagttgagttttctatcaacatctttcaaccaatcgtcagcctcgacgggctcgacggtctgagagaactctggcggtcgagacctcagaaagtccgtcagcttggatctgttgttgcccacgtgagggtggccatttccatgcgcattatgctgaaagctggctatggctgtggttagaccttgcaggatttgtgtctgaactgccattatgtgttgcatgttgttttccacatgaggtggggaagggaggcgttctcctccagaattgtgactggcagtgtggtgagagcggtgagactgctccaactctgcttcacgggaaactgtgcgatgcgagcggttgctgcggcgaggttgctcaacctctgcgtcgcgggaaacagtacggtgcgaacggttgctgtggtgagaatgctcattagctggttcgtgatttgcttctgcttcaactctaccatcatcaaaaccaaagcggactggtgcacgagctgtacgacgggggcggctagccatctaaactcccagaaaagggcggggtaagagtcagataagcacttaggagggcaaggagcaaagcaaatagcaactcagatagcacacactaggcataaactggatttttcaaatcataaaaacacctgatacaacgggtgtggactagtcacagagctacgccgagcttgactgtgcgcacacctcctaggagaaccagactaccaaacaacacccacaacaatcacacgcacgcactacctcgccacgactccaaaagagttggcggcggaacaaaagggcctaacacacggacggctgctgaagactgcctcctctactcctcgtcggccgggctgcctcctgtggtcggctcctcagtcgaagaaacgtcgatcggctggcgcgaagggaccggcgggacctgtcgagggccggcagcagcacgggccgctggcggtgggggagctgggtggcggaaacggaacacggtggaagaaccaacaacacgcttccgcgcagtgcggataaagcgtgggccacggcgggaggaagcgactggagtgtgtccgggggtgtaggaagggctaactgggtgtgggtagggggagtacactggtgagtacggtgcacgcgagctgggggagcgcgggccactgggtgtgcgagcagagccgcgggagctgtgggaggacaggtggctggcgtggcagagacggcctgagtcccaagagatagtgtcaactgaggtgacaccctcctcggccagacgggcctccaaggcggcgtagcggcgggcaagggaacggtaagcctcaaggagtaggtcgtgctgagtggcctgagcctccgaaagctcgaccatgcgagtcagcactggctgagactcgctgtacggacaagggtacctggcgtctgagtggccagaaggaagacgtggaagctgccggaaggcggagcctccgagacggtggccgtagtcgtgggccaggcggcgaagcgcagtccaggagaggtcctggtacgcgatctggagagtgggcctggccacagtgaagtggtgagggcgaaggccaactccgtgtatacctccacgagggtaaaggtacacagagagctcacagtgagggggaacacggtccacggagtaccccgtgtactcgggacacgagaagccaaggaaacgggcgaggtcacgaagctgggcgacgtggtgaccctcaccaaaaccgtgggaactgaagctggcgttcactgccatctacaattttgaaagagggagaaagatcagtaacccttttttgaaacaaactatggaaaataaagaaaacagaagaaaccctagtttttcgcaagtagttttgaatctagtatccttagggtcgtcctaagcgtcgggtttcgccctagggccaagcctgtgctctgataccatctcttgtcacgccccgaaccagttccggctggaactagcccgtgacgctccaaattaacctgttaatcgataccagtcccaggaaacagtgctggtatcacagggagacagaatatcatagcaacagaggtctctttattatagagtaggagtacagtcatgttgggctacggacagatcccgagctcacaactgcattacaaaagcgaaacggaagccaggacttggaccaatcatcacaggcgcgacttgggaactaggccgaaaccctaaaactcatcgtagccggcttgctcctggaagaactcctcatcagcaggatccacttcatcttcttccgcaactgggggggggattatttatatagagcaagggtgagtacgggagtactcagcaagccaggggaaaataagtgtttaatgcaggcttcaaggaaaggctgttgtttttgcaattgattttatttgaactcttttctaaaagcaactaagtgagtgcttctcaaacgacacggacgaggcagtgcgtctcgtccggtcggagtatgtgcaatgtatcagtctttagattttgaaacaaggttggcacccggccaaaagctttttaaacggccacccgggccaacacctttcaaatggccacccgggcctagctgatcccatcagctgcaggtttcttttcaaacatcgaacccgatttcacaacagcaaatttcacaagcagtagtcaaacaaaactacgctaggaatcacctcacatccgcccatgaccgtgggcacggctgttcgaacagtttgttaacctctgcagagggggtacactttacccacacgacattactaacccgggtcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctctccgacaccaccccggcgaatccacatgtctctcggcatcaaggctcccctgataagctagttactcagccagggg

SEQ ID NO: 88580 - DNA, 685 bp, Oryza sativa
cgatgaatcatccggagaggatcaggatgccaaggtttcaccatccgctgaggatgaagaagctggcaagaaagctgaggatggcaggtccaaattgtcagacgaacagaaagtgaaacagcagagaccacataagattcagatatggtcggaaataaggccctccttaggccacattggggagatgatgagcttgcgtgtcaagaagaagcaatcttctgcagataaggagaatgcagcgaatgaactccaatctgcaaataatgaagaaatcaaaccctcagaggactccgatgatgagttctatgatgtagagaaagttgatcccaaccaagaagggcctgtagctgatagtgctgatgctgattcaggcatgaatgttgatgcgaatcaagaagggcattatccttggaaggaagaattggaatgcctagtccgtgatgggttgccaatggctctgagaggagaggtacatcgtgctcttcatattaatcttgtttagatttttttattgcattaaatcaatggcccctcttcgttttggtgacagctatggcaagcttttgttggtatcggagctcgtcgggtgaaaggctactatgagtctctccttgcagctgatgatgaaagagagaacagcaaaggttctgattctccaactatggaagggaaaccacaaggatcg

SEQ ID NO: 88581 - DNA, 1232 bp, Oryza sativa
tctgaggtttctcgtcactttttgaatggtcttgacatgtctatttgggagatgaaaattacatcaattcaggagtctgttgatatgtctacttcgactttggattcactttacacaaaactgaaaacacatgagatgaatattctctctcgtaaaattgattctaagtcaagtgctgtggttccttcctcgacttctttggatgttggcgcttcttcatcgaagtcttctgtgcttgctttatttgatgccatgtccgatgagcaactcgaacagttcgaggaggaggacttggctcctgcatctaacacatttgctcaagctgtgaataatgtcacgttcaagaaaagaggtggaccgaatcgttgctttgaatgtggttctccggatcacctttgttcgcgttgtcccaagcttgggagaggcaagaaggaatacaatggtagagtcaaggaagatgacgtggacaagaagaacacgaaggagaagaagaagaattgcatgcagtggttaatccaagaactcatagcaacttttgatgaatcggaagataaagatgagagcaaaggtaagcaagttgttgatctagcttttattgctcgtaatgcaagttctgatgttgatgaatctgatgatgataatgaagaaaagcttagttatgatcgactagaatatgctgcttacaaatttgctaagaaacttcaaacatgttatattgtgcttgatgagaaggatcatactattgagattcttaatgttgaaattgctagattaaaatctttgattcctaatgatgataattgtcaatcttgtgaagttttattttctgaaattaatgctttgcgagatgtcaattctgttaattgcaagaaattggaatttgagattgaaaaatctaaaaagttggagtcttcttttgctcttggatttgctttacatgctcgtgttgttaatgtgatttggacaaagaacatgttgaaaaatacaaagttgctttttgtgcaagttctttggtcaatgcttcatgtgcaaataatgtaaaacaaaacaatgttgttttgatttctcaagattgttcaaagtgtgttttaaatgagttgaagttgaaagatgctttagagcatgttaaacacatggaagaaattgttaacaagatgaggtgttttcctgctcaacttgtagaaaacaaaaaggtcttttggatgcttgcaaaaattgtgctattcttactt

SEQ ID NO: 88582 - DNA, 1144 bp, Oryza sativa
acttgtctagcgttctacaagacctaatgaaatggtttgccttgtcattacaggtaactaaatgccggctaatcggctaatcccaatggacagacttatgtctatactccctccgtcccctaatcccctaatataagggattttgagtttttatgtctatactcccttgagtttttatgtctatactccctccatcccctaatataagggattttgagtttttggttaaactgtttaaccactcgtcttatttaaaaatttgtgcaaatataaaaaacaaaaagttgtgcttaaaatactttagataataaagcaagtaaaaaaaaataaataataattctaaaattttttgaataagacgagtggtcaaacaattcaaacaaacactcaaaatcctttatattaagacggagggaatcctttatattaagacggagggagtaccgtttttaattggagtctattgacaagatagataacacatagcataacacagagaagcagttataaaacgctttgcttcatgtcacatgatatatagagcaaagtcaagatcgaaaacggactaaaatcatggatagtctgggcttgtttcatgccgggtaacggagaagttaccagatgtaaaaaacaaacaaaaataagtcatggatagcgcatccttacgcatgcatagagacatttgagggcaaaataaacagcacgtcaacagttactgtccaacgcaagaagcccagaagcacagcaagcaaaacaaagcagcagcagaagcagcgcatcagcagtttaccttgagtgatttcaaacagagctaatggaataaaaacagacatttaaaacacctccattgtcatctcaacataacataactagaagtagtaccttgagtgatgtttacgttattacaccacatctatgaaaaagaacagaagaaaaagaaaacccagtcattgtgtattgttctggaatttgatgcttgagcaggtgatgaccattcaggtgagccggttcatcactaaaagactgcaaactgaagctcgaaggacgtaaattaattagccctgcttgttggcataattgtcaggctcgtcatccttgaagaggtcatccatgagctcatcgttcttgcggcttccaaagctgt

SEQ ID NO: 88583 - DNA, 700 bp, Oryza sativa
ctgcacccccttgatcttggactccccagcctccagaacactcagaaataagttgctgttctttataaataacatggtctgtggaactttgttacagcaacacaaacaagctgcggccacgactagagaccttaaggctttcatgacaaggcatttcgaaagacgacacaggttcaccatatgccaacgagaggggtcccaaaccaacaccagataggtcccagaccttactgtgccaggaagcccaggggtcctccccgacaccaccccggcgaatccatatgtctcttagcatcatggctcccccgataagctagttactcagccaggggtgtcccattccacccatgtggtcgtacttgtcttatgttcggatgaaattccaaggaaacggtccttatgtgcaagagcgggaaaccgtacacccggtacgttccccggtccgcggttttggaaattcatttagttcgcaagcaccgacccaggtgtcgggttttccaagtcttttgtaaaacccaagttttaccaaagatgtttctcagattttaagtttgaaggcgactgtcgatacccgtgcagagtgcacgattaccgaggcacaactaggtgggtacaagggaacatggtataacaattacaatggaagggtcaaatgcaacaaattaggtaggtccgccaatctgccttgcagacgggacaa

SEQ ID NO: 88584 - DNA, 627 bp, Oryza sativa
atgcaaagtgctgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaag

SEQ ID NO: 88585 - DNA, 1733 bp, Oryza sativa
ggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggtgatgtggaaaaagaactctatattttgggagttaccatattgggaattcttggacgtacgccacgcaatcgacgtgatgcacctcactaagaaactttgcgtaaaccttcttggcttcctaggtgtatacagaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtagccttccagacaatgtccgggcaacaataacaaagatatgtgcattcatgaacgcaatttcgcagaaggtcatcgatccggatagattagaagcccttcagaatgaagtggtgcaatgtctcgtcagttttgagttaatatttctaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacaagagcccaagacatgaagagcacgaaccaaaacagcgctgttcgtgtcgatgccatggga

SEQ ID NO: 88586 - DNA, 981 bp, Oryza sativa
ttatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggttaaaatcatgcatgtggcatttacatatgttaattagagtttttagcatttaatttaatataattcctatgctaagtacatatgatgattacaatttttattaattttaaatcatgcagtatgtacatacatatcttaattagagtttttaccaatataataatatcattcatatatatgctaagtatatatgattattggaatttttattaattatattttcttattacgatttatccacttaatttattacagccaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccgggactaaagatatctttagtcccggttgttgagaacaaccggaaggaaatatcttttctttactcccggttga

SEQ ID NO: 88587 - DNA, 603 bp, Oryza sativa
tgtattgctgaatagtcctaacatccttctgcttgggcagtaaaataatcgtaccaaagtttaggctattaagaggcaacgatccctgctggaaatccgaaaacagagctaacaggtcgtcctttataattgtccagaaggcctgataaaactctggtgggaaaccatccggaccaggtgcagtattatgtttcatttggaatatagcacattttatctcttcttctgtaaaatctgccgttaaagactcattttcttctgcagagacttgtcgtatgtcgtcgacctgagactcatctaaaaaaatagatgaagtctgtgatgggccgaacagggtcttaaagtacttggtgatgtgctccttaagttgagcatcaccagtaatgacctcgttcccgtcctgcaattggaaaatacgagttttcctgtgacggccatttgccaaaagatgatagtattttgtgttagcatctccttccaataggtgcttgaccttaccacgttggtaccatttaaattcttcctccctcaataactcagacagtctatcatttataacatgcttaacatttaattcaaacctcattgagtatagtatgttca

SEQ ID NO: 88588 - DNA, 1969 bp, Oryza sativa
caaatcgtttggaacttaactgcatataccgctattgctttcaaacatttgtggtagataacatttcaataacagtgggacatgatgcaagcaataagactagcatgttatgtttaatgctatatatctaataggcattgatatgtattagaaatctgcaagagttcattcctcccccatgataaaaggccgtgtgttgtttaattgaaaaagaatccaccaagtgtgttttgcacaaatattttgcaatagtacttactggatggcgaggatcagcaagcatcggaaagagacctctaactatgagtgattgtcttgcctgaaagaaaagcatacgagaaatatgagatacaatagtcaggcataaaccagataacagaaagcatgttacatgaaaaaaatcagaaaaaagatcataaacatagaagggaaggactgattacatacttcaaatgcgccagtgaaactccacctcatatggtttgttttcagacgaggaatgacaacagatagaacaggcatggtgggcctgtacttggcaattagtctgcagacattacagataccagatgaaatatgaaattagttttgattaaactacaccattatcctgtttatattcacatctttctaccttgcagcgcgtccagatgatgtgaagcaaataatgacagaagccttcactttgatagcagctcgcacctgcaaaataggcaagaaacaatttcagactaagaaacccttgtttcatataaagactttgtgaagcaaaaaacaatggaatagtcaaaaatattttatatgtgcacaataaacgttaagaaattttgggaacaagagaagaaacacaccgcagaagaagcgatagactccaagtgggtcatgggctccccaacatatttcacagtccgcttgaagtataaatcttggttgaataccttctctgcctgtgaaacaatggacaaacaaatatgactaaatcatgttactaacagactgatatagacagaaaaacaagaagtgaattttcattgtacttgttgaaaattgtaaagaaaaaacataaaagtagaaagaaaattcacctcagcgcaaattttgcccacaattgagatagtctcaactgggtacagaccacggagagtctcagcaccaaggagaatggcatcactccctgaacaaaaaatatatggttcagatttttcagaaggcaattaacatcatcaacaactcaaacaactcaccgtcaagtacagcatttgccacatcagtagcctccgcacgagtaggcctgaggttgtcagtcatactgtccacaacacgagtaacaacagcaggctttccagccatgttgcacttgtgcagagcagacttttgaaacaaaaacacctacagtaccagaagttaaagatcagtaagcaaattacatatcaaattgaaaacagagcaattcttgctaaagaacttgaggactctgccactaaaagcttcatagccaaataaaaagaagcagagtatgtaggactattaattaatcaatgccctctgaactgctaaaataagtcaaaaataagatactaaccttttcaggtggaagatcaattccaaggtttcctcttgacagaatgataccatccgcctcttgcaggatttcatcaaaatgattcaaaccctgcaaataattaaagagttgataggtggtagaacaaatcaaagttggctaagaaatatataaagagtatgttgcaaatacctcaacattctcaattttggcaaaaatctgagtttggctaaggtcgcctaactttgagaggaactcacgtgcctgtaatgtaaggagaaattccagcactgtttagaatttcttcccaaataccaaatgaagaggtagaggagagtatatattggaatatagacatgcaatattttcactgtacagtagacttgcaaaactttcaagcacaacggg

SEQ ID NO: 88589 - DNA, 671 bp, Oryza sativa
tcctgcagcccgaatttttaaagattaaatcggattaaaacacttatattgattttaattgaattatgacgcaataaggaattatttttaaaaaggaaaagaaggattattgcgtcagcggctagggtttgcggtggaccgggtgcacggcagcggctcacggaaacgaacggccgagatcaaccctatccaaaacggacggccgagatcaaacggtccacgaccggcttacggcggacgatcccgatgacgtcagcgatgacggcagcgatgacgtcagcaccggcggcaactcgggcggctcgggcgcgcatgctcgccggcgaacgacggcacgtcggcgcgaacggagggcaccaacgggtagagggcgacgcggcgaactcaccggtgaccaaaacaacggcggaagggcaacggacggcgccggcgacgaggaagaagcggcggcggagaagcggacgaggacggcggcgacttgacgaccacgatggcggcgacggcgaccgacgacggcggctgcaacggcggcgcgacgcggctgaaccgacggcaacgacggcggcgactagggctacgcggaggcggcgctagacgcgacggcaggctaaggcaaaggtggcggcggatagaggagagctcgggggtccttttaaaggggctagcgagcg

SEQ ID NO: 88590 - DNA, 1616 bp, Oryza sativa
attcacagaactacaaaatacagcaaattctataatttagaatagcagtgagctttcacatattagagtttcatcaccaaccatgcaaatctcatataacaaacaatataatggtgagaagaaaatagtagaagctgaatgaagatttcaagtatgcattaatatttaacaacttaatttagcaatcactgatctggatatcattaggaaactgcaaggaagctaaaagtaagtcctaagatgtacaccctctctttggaagatttggaagcatagaaaaaattgtgtgtttaacagcattaatctcagtgtaactacagttatccaaacagtgaccaatgaatgttggatcatgcccagggcttcttagggagtttcctaataggtcgcttgggtgaggttgttttttagtttgtgtgtttttcatgtaaaggctaaggtttgttggtggtttggatgagggtgggcgttgctcccttccttgttcctgttttctcatgtattcaagaaaaaaagatgcactccctctgtttccttttatgaggcctaaagttttttcaatcttgttgaaaaacagaaggctttcatgtgaatttattgagccttttctttattttgccccctttatcacatactctctcttgcatataggaagcatcacacatgacactaaccatccactctcctattcctaaggtatttaattaagtatgggtagcatggtcattttaactcctcttcttagtattgtaccgccttagtcctcttgcccacccaaaataagagctatattttcaaatggaaggagtacatgaaacatcactaataaaacttctatgcatcataatttattttcgcaggaacttgtagcatgatattttcttctgcctaggaaaaaaattaatttggaagtcagaactttgctggatagtagatcaatcctattcctatcttcaccaaactcatgagactgtttagcaatgattgaaaggatgcgatggcaaaattatcaaggaacaaaatagatattatatgacgaaggcacaaggccattttaattccaaagaaaatggctgaaacacaaacggtagtcattcagttttaccctatctatattttttaaccgccctccaggcagccacaaacttatgtctccagtgtgcaaccaaccgtcctcatcaatgacctctctcttgcatgttttcaaatgtaatttctgaaactcatttaatatatttgaacttaaataggagacagaaatacatagcaagatacgttacgtttggatttcatccttatagtaaccaaaaaatatcgtagttcccctacacaaatttctccacgaggatatggttgatcctcagaggtgtaattcatttctgggacatccactagcttaatctctgaaaaatggcaacaggatttacattatgagagtgtgatagcacgcaaaaaaaaacaatattttagttgaagatgaaacctagacttatttggggttaagaaaggtaaatatgagatgtcacatgttttacatcagtgatgggttactatgcactacaactatatgaagcagacttgacttgatgggcgtcatgaacactaattcatagata

SEQ ID NO: 88591 - DNA, 1021 bp, Oryza sativa
gatcctaccctcgcggccgcggcccagcgcaaatcagacggactcccctacctcctcctccgacgagaaatttcccatcggaggccgtcgtctccgtctccccgtttgctactccggcgccggcgaggccacctcggtcgtttccctccctcctccacccactcgccttcccggccgccgcggagctctgcccccccccactctccctacgtctagctgcgctacttgttgtctcccccacctctcttcctctgccgccgcacagcttgccttcctcgtcgtctcgtctccttcagcgccggcgagaagccccccggccgccgagcttgccccgtctccggcggctaggcgctgccgcctcctgaccacgcgggttttctgcccctgccgctgaccccacccaccgccggcttgctagggcttattggataagatgtcgtccaagaagaactactacaaggagaagatgatgcggcggaagtaagtatcatttcatttgaaagatgtatttatgcatttattttgcaatatttcaactgattcgatgtagagacataatcgatatgttttggaactgtaggagaaatttattagaagttgattgttaaaaagaatatatcagaagttgcaacctgtgatgatatagttactgtttgcttgcaaaatagtttttgagatccagattctatgtagtagtgtgatttcgtgaatttttggaatgaaaacaaacgactgaagtcattgttcttgcagttaatcctatagccaccttgttagactgtgattagggtctaagggatcatacaagttgcctcactcactgaaccatcccacttaactagatgtctcgttcgctttcaacacactgacttgcattactataaaaagaaaggaattaggttcagtggtgactcctttacccatctgaaaaagttacctgcatgactgcccttatgtgtccgtattgtaggagtatatacatatcacaagctgttgatccagcagaatggcatttaagtgg

SEQ ID NO: 88592 - DNA, 1487 bp, Oryza sativa
acaccatctcctcctgcctcaaggccggcatgtcgggtaacggatcagccagcttcgatctcctcttacctccacccattgcgcactgttctaatctaatcctttcttcgtgtgtggcggaaattgcagttgccaggttcgatttctcgtggggagacgctgagtaccaccaggaaaccctcgaaaacctcaagctcgccatcaagtccaccaagaagctctgtgctgtgagttctcctgacaattcattcatgatctactagttagtcttgctgtctactaacatttgggagtcctctcgttgttgcgcaggtcatgctcgacactgtcggcccggagttgcaggtggtgaacaagagtgaggctgcaatctcccttgaagcgaatggcactgttgttctcacccctgaccaggggcaggaggcctcctccgaattgctgcccatcaacttctccgggcttgctaaggtataccttcagtagttcagtgttatttatatgaaatattatgattgtttttacttttgttgcaatcagatcggtccttgactgtttcctagagaaattttgtatgttaccattacgtcaccgcaatttgtagcatctgctatgtgaaaaaaattgactctttttgtcctttgcaggctctgaaaccaggtgctacaatttttgtggggcaatacttgttcactggcagtgagactacttcagtttggttagaggtaaaaatcttcagcatgctaaaactggtgttctgtgtttgtgatgtgtaatgtgttacgtccttgttagtaggatgtgcttgctgtctacattttctgatacctaatctccattctgcttgatataggtttctgaagttaaaggagatgatgtggtttgtgtgataaaaaattcggctactctggctggttcactgttcaccctgcattgttctcagattcatatcgacttacctacactgtctgatgaggacaaggaggtaaggatcgatcttatctcttagctaactgtagcaatatgaatatttctagtaaaactattattatttctgaagtttgattccctcactcaaaccatctgtagtagtggtattaaagcttaagagtatgcactgattccaggttatcagaagatggggagctccaaacaagattgacttcctctctctgtcttatacaagacacgcggaagatgtgcgacaggttagtgactaattacagtatggatagagatgcattttcctcatatttcctgtttgcccgttgtgcttgaaagttttgcaagtctactgtacagtgaaaatattgcatgtctatattccaatatatactctcctctacctcttcatttggtatttgggaagaaattctaaacagtgctggaatttctccttacattacaggcacgtgagttcctctcaaagttaggcgaccttagccaaactcagatttttgccaaaattgagaatgttgaggtatttgcaa

SEQ ID NO: 88593 - DNA, 506 bp, Oryza sativa
ttgtttactgtttcatatttgtactttgatcataactaactaatgatcaaaattatgatattcaggagaaaaacgaagttttgcatgcacgggttttttttattgaatggaacgagtgtgccactattctgacttcagcgaacttacttagagatcctcgtgatgcagacaagattatcgaaaacttgagggttggtgcttctaaatattctatgatccctgttcatttgattaactgctaagagtctcaattgtgttgtttgcagattaaagtgttgcttccaaacaatcggcgcaccaaagggacagtacaacattataatttacgttacaacgttgctctagttagtgtgaaggattaccgtgttctccaaccagtaaaaattcaaccttataggcattacgctagtgaattactagctgtagggtgtatcttcaaatctggcagattaatggcctcaagagggcgacaacttcccatcggtgtcacacatgaccgcaaattt

SEQ ID NO: 88594 - DNA, 2767 bp, Oryza sativa
tatcttaaaggtgatctggaacatacacatttggtcaaaggcttggactatgctctacttcacaaagtacgaagtgaaatagaaaagaagcctgaagcagaagatggaaaggatacacagtcaaggtacttcccaccatactgcagctttagtttcacgccatttaattatactttctcttgatagttttgtaataatgagaagtattgtagacaagctatcagatccatgtttcatttcaaatgctgtaatatattgaaaacagtggctatcacttgcataatttttatgaaagcgcagagttgattccattaattattttgtgatacaacaaattgtcaaccttttttaggcctagtcctatttcttgtaatgggaggtgaagttaagagagagatccatttttctcttgttggaattttagtaggtgttttcctgttttgttgtggatgaatactgtcaagcagaattgttctgcgcatttcaattattcataattttactatgctttatagtggctgctggatcattctcagtgaaacatgatgttctgtacagcattctcattggaataatacaacaattgcttataggcatttctcttgatttgggatgtagcactatgaaaatatggtctcatgtccttcgtccttgtctggacgcacttcgtgagtttgtatttaactaggatacatatatttagcctgtgaatttgtgttgtacaggtctacaaaagaagatcaagcagtctcattccgcactgcagctgcaaaggtaggtttccttttaatttacaatagaattgatgttggctgcttatattattgaccatgtaatgtaatgtaacatggacactaaaagcagttcttggttcattgcagtctgtctatcaatggatcataaagccacaaagcatcataaagtcgaatgaaatgtttcttcctggtcggatggcatttatttacaacatggtacctccttcaaagttcccccttatgttaattacattttttttgtaattggtggtggccattttccttcataatatgatactacaatatattattttattttcatctctcatcaggattcatctgtacgaaacatgatgctgctatgttgcaaataaacgttattgctatttcaatttcgaatttttcaattctgtgctagcatgtaaatgataacatgcttatgttttgtcagcttttatagtatacatgatgcatgactatgtttcatgatgtattattgtttgtttctctgctcatcacctggaatgcagtacaatcaacatgctcaaactctcacttcactccacaatatgcaaacaagagaagaaataaaggaaggatgaaagaactcttcaaatatcatacttatagactatagtatagtattgcggttacatgtgtctggtgcaatgatttttatgtcatgcacatttaaattgtgattgcgatgcatcatggcttcaatgattactaatatacagtatgttcactatgaccatgatccatcttacaagtcagaaatcatcactagatcatattttgtatgcataatgttttcatttaatggatttaaccttccaaatgattttctgataataagagtaaaggtgttcgcattgcctattattgtggcatgtccagtactattgatttatgctatttgcaaataatttttttcatcattccctgctttgatttgaactacgggttttagctggagagtgattaatttcattaatgaaaccaggaggatggacttaccaatgatattccgacaacacttcacaggagcaaagctgattgctctgttccagaggtattatggcaatacatcatatgccacattgaagtttcctgaaatttattattttcctcagtattcttcttgcttatgcaggagatggtaactgtcagtgtggatggttctgtacttgataggattgctaaaatcatgtcataccttcgacttggatcatctgggaaagtcttgaagaaaaagaaaaaggagagggacacaaaaggtatgttacttgaaaattaaaatggattttgtgcagtggaagttgactgaaaaactaagtgacattaggaaaatgttcttggttaagataatatgtgaaatacgctgaaatgatttgtttggaagctgatacttgcattgtgaaaaaaagaaaagaaaagtatgattggtacttttttccacaatggttgagtcttgtttcaattgttttatagtctcacgtcaataatttaagtttgggtattttaagttatgaccatatgttacacgtttgttttacattatgaacgaattaattagttcacttaatgtatttgcaatgtatgtactttctcatccatatcttcacttgctttgctcgatgaagttagatatcttgattcttgttacgcagggaagaacagtttagcaagtggtgactacgatgaggtagctagacctggccaaactaatgggtctgctctgaaacatcaatttgaaaaggatatgccaccgccgccaccccctcgaaataataatttaagcaaaaatgagaaaccgtctgctccagttgctagagcagatgaagatgacatttttgttggagatggggtttactattctgttcctaacaaggaaatgagccagagccctgtctctgaagatatggatgagtccccacataaccatcagaagcagtcctatttcactgaagagaaacctatctatgggcccatcccaccatctgaccctg

SEQ ID NO: 88595 - DNA, 626 bp, Oryza sativa
ttttaagccataaagtgacttctgcaacttaacacaatacatgttacgatttaccttctgattcgggatgtcgattccatcaggaaccttcatgtaaatatcagaatcaagtgacccataaagatatgctgtcactacgtccatcaattgcataaatagacgattttgtactgccaatgatattaaatatcggaaagttataccactcataactggagagtaagtttcgttgaaatcaacgccaggtttttgcgtaaaaccttgtgctacaaaccttgctttatatctcaccacctcgttgttttcgttccgtttccgaacgaaaacccatttgtatcccacaggaaagataccacgaggagtaggcattacagccgagaatacatctcttttgtaaagcgaggctaattctgcgtcaattgagtccttccatttgttccagtcagagcgcttttggcactcttttatagacctaggttctggatcaacttggaggcactcagcaatttgttcagaaaaattagtgtcgacaattgtagctcttctatcaaaagattctccagtttcagagtaattgatggcaatttcatcaacccttatagactcattgtgatctcccgaaacaa

SEQ ID NO: 88596 - DNA, 4523 bp, Oryza sativa
cagccggtttttctgccccttttcttgtatccctaaggttttccacaaattatgcatatatgtagcgaccactctttgcgaggttgatgaagaagccacgttgccatggcgctgcttcacgccaccctcgccaatttccttcaaaatatttttttaactaacaatgtaaaaggcaatcatagacgatcatataaacatgtacacacccaccctatgaatgcacatacacataccctatctcctatgagagaaaaatatttgtcaacaaaacatgaaaaagtatgtagatatgagagactaccattcgcaagaaaaaaacttacatacatacgtacaatccaaaatgtcatatggaactatattttatcttttttaattatgttgttctcatataaattgtgctaaaaattagtacaaataattttgacaatatagattattcctttgtatattacccatgatcatgtataggtaaattagatgtataatataagaaaaaaaatcaacactcatattatgtttacaaaggatgataataggtaagtttacatataactgaaataaagcgatttttgtttgaatatgatagacattatcatttagtatatcaaaatctatggtctattttacggtataaatattttcttcttttacggtaaggttatgaggtaatctatggttttttatgatgatatatgacttttttagtagttttttttaaaagaataataaattgcccgcgcatctgtgcgggcttccttcttggttatttttaaacattagattagatgtatgaaagtaatccctccatattaatctcccgtgtacataccacagaaaaataagtactattcatccataataagatcctttaacatttttctaataaaaagaataaataaattgcgcagatgcgcgggcttcctccctagtctatctatctatctatctattatctatctatctatctattatatactaaaagtccattaaacttcctacaaacgctcccaagccgccacgtggcgctcaaataaattagagaaatccaaaaaattctaagaaaaaaagcaaaacatccgaccgttaatttttacttaagatggtggaccattattcttcaccattagatcttatcttaaaaaaaatatcctaaaacccaatccataatctcctcccacccctaacccaccacctctcaggtggccctcaagtacgtacgagacctcctctcccctgacgtacgtacgtacatacgtctcttcctctcctgtacttccttttccttttgtcttgccattttccattcaatctaccaattttctacctagcaaaattcaatatgtaaataaaagtaaattctctaaatgattataatttttacattatattttatttatctacattggccatgtttggatatacaagaatatatcttttggaaaaaaaatcctatcttttacatgaaaaataaaaagtaattaaatattaaattaataacatatatatgatcttcgctcctctctccttgctcactttctcctccctattttgtagctagcaactcattatataaataaaaagagtaaatttcataatactatatctatctatctatctatcatatactctttccgtcacagaatataggatgggtctcatcctatcctaggttgttacattctaggacagaggcagtactaaaagtctattaaacttcctacaaatgctcctaagacacaacatggcgctctaataaattagaaaaatccaagaaattctgagagaaaagcaaaacatccgagatgaaccaccacacctaagacagctaaggtgatttaccaaggtcatcacgagtgtcgcagcaatactgatttgccaaggtgaagatgaatcaaatcatcagtgtataatgtttgttttgttaataacacttcaattttaatttgaatttaatttattaaacatgatttcttaacaaaataagtctactttctttctcgataactggatggataattactcatagggatgaattaaatattttgttgtataaaactaacaaatagcttataaaaattatcaaagaatatcgttgaaaaacaatcgtagagaaatacttttttgaaatttgaagcgtagcatatactgtctggttaatattccaatcttataaatttcttgaacacaacttacgatacatgcccgcgtatacgcgcgggctaccttcctacttcctagttatatataacaaagtgcatatgctatatatagtgatgtacctggtgccatgtaaccaaccgttccagacatgctagcaacaatcatcgagttgtcatcgcctaatagcaacttcgcaatgccaaaatccgccacatgtgctgtcatgtcattgtcaaatagcacattactaggcttcaaatcacagtgcaaaaccacctcgtagtgctcatggtgcagataatgaactgccatggacacatcgagcatgatattcagcctctcgaggaatcccaggtgcattgtgccctcggagcagtgtagcagtttctctaagctgccatttggcatgaactcaagaaccaatgctttgaagtccatgttcgaacaggtatttagtatctttatcaggttgcggtgtcgcaccatgcgtagtatatgacactcagcatcaaagattctgatcgaatgctccagcttcatgtctagaacttttatagcaacaaccaaaccactgccaagttggcctttaaatacttttccaaatcctccagatcccaacaggttatcatcactgaaattctcagtggcaaggacgagatcatgataggtgagtaactgagggcctatgacatctgccatatcaccataagctttggccttcttgtgtttcttttcaaacattaagtataagaaaacagcaaggatgccagaagctaccaagatggctgggagtagaagttttagaagaggtctgctataagggtgagactttttaagacagggtgaaaatccaagacgtggagaaccacataacccagcattcccaatcaaagattgtctcgtaaggttattagagaaaattcctccctctggtattgggccttcgagcctattgaaggagaggttcagcatagtcaagtcggtaagattttcaaggaacatgggaatggaaccagagaggttgtttgaggaaaggtctaaccatgttaagctagttagactttggagagtgctaggaattgaaccttccaaggagttgtgtgagagaatcagataggttagcatattgagctgtcccaatgattctgggatgcttccattcaagaagttactagaaacatcaatttggtcgatttgtcttaggccagcaatgtcggctggcagagcaccgacaatggaattacaggaaagatttatttggataaggttatgaagttggaataagcttgctggtatctttccacttaactggttgttggacaagtcaatgtaatctaacctgctaagattgccaatgctatctggtatggagccagagattttgttcctttcaagaaatagtcgttgtatactcaaaagcgtgccaatctgtgttggcaaagggcctaaaatgtgattgttagagacatcaagcaacccgagatttcccatcgtagcgattgattctggaattgccccagtgagttggttgtaaccaagatctatcagttcaaggctgcttaagttggacattttttctggaagactacctgccaacttattatgatctgcaatgaaactaattaaccgtgccgagagattacccaaatggtctggaagggcacctacgaaagaattatggtccaagataaggtcttccagctgcctacattctgaaagagatgacaagaagcccatattcccctctaggttgttgtggggtagaacgagcttctgtaaagcagcaatgttccccagtgtccgcggtaccgagccagacaactgattagctgaaagaagcaagtacacaagtttctgaagtaatcctatctctggtggaatatttcctgtaaggttgccaaaagagagctctagtactgtgaggcgggtgaggttgctaagaacagctgggattgtaccaacaagcttatttccacccagtgaaactacttcaagtcgtgacaatttagctaaccatgttgggagaacatccacgaaagaattgctatataaatagatttcccttaagtactggcatgatgcaagccccgcaggaaaccgaccggcgattctgttccgggcgagggaaataaatcgtagcatagggagcctgaatgtctgattattgtttggtattggtccggtcaggttcccgttgcctgccagcgccatgactcgaagccaggacatgttgtacagggcttgtggcactaggctggagagctgattgtactgcatgtctagaatctcgagttgagacagggaggcaacaccatccggtataggacctgataggctgttgtttccgaaagataggtacc

SEQ ID NO: 88597 - DNA, 2065 bp, Oryza sativa
gtctatatttaatactctaaattagtgtctaaagacagggactaaagttaagtccctggatttaaacaccacctaagtaaagctggtccagattaaccggaatgtgaagcacccggaagtgacctgcaaagaagcgatcaatttccaagaagctgcctgcagcttcacgcgcggtcccttctaccaaccacccaaagcgaagataacaactatttcttctctctatccgataaaaaactactccctccgtcccataatataagagattttgagtttttctcacaatgtttgaccacttgtcttattcaaatttttttaaaattattaattattttatttgtgacttactttattatctacaataatttaagcataacttttcgttttttatatttacaaaaaaaaattaaataagacgagtggtcaaacgttgcaaacaaaaactcaaaatcccttatattgtgggacggagggagtaatatagtattggatatatgttgacatatcgcagtactacgaatctgaatgtctactaggttgagtttttttggaggattaattaattattatattttaagatgaaggtaacaataataatagtacaatagtcagaaattgccgtgctgggtgaccaagaaagtccaacaaaacaaataaaataaaataaactgagaatgtgaggattgaataaacaggcgaacgttcaactcgaggcgaggatagcagcacaatgggacggatctagcgcttggtgagtggcgcgcagtgggaaaggatcggaggagtgaggggtaggatgttggtgacggcgacgatagatgtcggagaatgaactcctccatcaaagaatcgtgaggcccccctttgtgagttcggccggaggcagcgggtgagattcgagggcttggtgagcgaagctgtgtgatcttgagggggtttaatcccccaaagacgatgagacaaaaggggtttatacaggttcgggccgctgagaagcgtaataccctactcctgtgtttgggattatggttgagtgttacaagggttcctaaactccggagagcactctcgctcttcttctcctagagttcaggttttctgtcagttgtcctctttcccggcgggtaaggtcatccttttatatatcaaggggttaccacataggcccaaaaacataacttagtggagaaggattacaatctttgcattaaatgcatgtcttgtctcttaatttgggaagcaagcgcacgtcatcttgatgatgaggcctgtcaaatcttgccgcctgacacggggagtgcccctgtcagtcaccatttaatgggtgaagacttctgggctcctattacaccggaaaacgggagccttgctttgaccagagcaggaggaccgactccttctgagataagaggatgaggacctctcaccatcattatttgatgagacatgtcagactgcacgttgcctgacacacgagcagcgcacaggcgcactaccccagtcctatcggtcattcgaccggtcacagaccggttgagtgcattgcacaccgcattaatgtggcgtggcgtgactactcgggccgccataaatgcgggtaggtgggcacctgaggcggacacttaacccaacgtacatggtgaccaggagagggggtcgggggagcccgaccccaagtcacgggagcgggcggccgccgcccgacctcgggcccgatcccccctcgggggagggccacgtggcgcctggggcagccttctccctctagtctcggccagggagtggccgccgccccacctcgggcctgactcccctcgggggagggccacgtggcatcggggggcagcctcctccatccagtctctgggaaggagtggccgccaccctacctcgggcctgactccccccctcgggggagggccacgtggcatcaggggcagcctcctccgactagtctttgggaaagagtggccgccaccccacctcgggcctgactccccttgggggagtgccacgaggcattgggggacagcctcctccgactaatctttgggaaagagtgacc

SEQ ID NO: 88598 - DNA, 775 bp, Oryza sativa
catacagaagttgccagattccattggtcacttgaagcaattgagatatcttaaagctcttgggatcaaggataaaatgatccctaattgtataactaagctctcaaaattaattttcctcagcatttctgggtcttcggcaatcttgacactgccaaagtcaattggagaaatggagagtctgatgtacattgacttgtcaggttgttctggattgaaagaactgccagagtcatttggcaaactaaaaaaattgattcatctggatttatcaaattgttctaatgttactggtgtatcagaatccttggagagtctcatcaatctcaaatatttgaatttatcatactgccggaatattggacaactacctgaagttatgggtaacctctcgaaactggtatatttgaacttatcaagttgctcctatatgaaagggaggttagaaacagaagttttgggtaccctcaccaaacttgaatacttgaatctgtctacagaacacttttatacggaaaggctagctcaaggtttgaacagcttaatcaatctcaagtatttgaacttgtcaggctcgctgaattacttgggttcttcaatagatatcagtttcctcggttgtctgaacaacctagagcatttggtcttgtcgaagaacatatatcttaatggcgtcgtcttacctgactgttttgatacactcaaaaagctacatacacttgacctctcggattgcccacttttgagtagtttaccagcaagtataggtaaagct

SEQ ID NO: 88599 - DNA, 3276 bp, Oryza sativa
gtcatctattaaaaaacagaggtagtataaaatttaaatcctataaatacttacattttgaaataaattaagtatttagttagagaggtaagacacgcatacatacaccaccacttggaacgcacacatagcacactcaaatggtttactcagagttgcggctgcgctacatccaataggaacattgccacaagcataggcggatctaggagtggtccagtggtctcgatatgtgcctaagagcaggtccaatagcatgctataagccagttataaacatattttaaagagataaaggaaaagagagaagagcggcgggctaggactataagacgtactgtgcgtataacatgtaggaccaggtattaatagtatagtaagcaactattatatgaattggctattatgctggctatggatgatttgaagctagtagttggctatactattaaacttgctctactagcttcaattcatctatagctaatctaatagctcattcatacaatagttacatactacacttttaagagcaggtacaatagcaggctataagccagctataaacatattttaagaagataaatgaggtgagaaaagagcagctggctataaagatttgtagccagctgtagcacggactccaagacgcagtgtgtgcatgataggtgggaccatgtattaatagtgtagtatgtaactattgtatgaacaagctactagattggctataaatgaattagagttagtagttggctgaactattaaacttgctctaatacatggtcccacttaacatacacacagcgcgtcttaaagtccgtgctacagctggctacaaatctatagtccactgctcttctctctttttatttatctccttaaaatatgtttgcagctagcttatagcctgctattgtaccttctcaaatagcgccaaagcacgctaactagggctgtgtttagatccaaaatttggatccaaacttcagtccttttccatcacatcaacctgtcatacacacataacttttcagtcacatcatctccaatttcaaccaaaatccaaactttggatccaactaaacacacagcctaggtatgtgccacgcaaacatgcagcacataaatgggaacgaaatactctgtccatgactataaacttaaaatcagctctgattgattgagctacacaatcgataagccgtagaagaaaaaagtgaagcaaaaacaatttgttgtaaaattttatatgtatatcattctgatatagaaaatagacaagaaaaatagataatcaactataaaacaagtttaaaagtctaaattttgttggaagcataagccaacaagcttgatgactttgttggcttatttgttttttaaataaaatctctacttatacttttacgtatttatactaaaattttaaataatatgaacaatcaaacattataaaaaaatcaacattaactcatattttagaacggatggagtaccatactagtccaggctgtgttcggcagggagggttaggaattctccctccaaacacgcaaaacaaagtggttaattagcatgtaattaatttagtataagctattttttaaaaaaaatggattaatatgattttttaaagaaacattcgtatagaattttttttttaaaaaaacgttcagtttagcaactagcagtttattaggaaacgtggagttgggaactgaagctccagggagactctacaaccaacccatatacgaatactacaaacaagattgggacagggcacctggccaaagctgctggagtgtggagcacgcgcatgcatgccgagtggcgtcctttttccccaaccccaaccacgcgctcttgctgccgcctgccgccgcgcgcccacagcttcttccgctcatccaccagtagcgatcaccgcatcagaacaaaaccgaggaagatccaaagattcagacggaacggagttacggaccccgcgatctgattccaacgcttcagaaacccgcttgctgctcggtcaacatccagcggcagcagggcagcaccaaagaaaacatcacgatcgaaagaacaagaaaaccatcacaatcctggccaaggctcgcaggcgcgacgaaaaccgattgaaattcgcagctttcgacctacggttttttttttttgctatttcaattatcagatatttacatagatttttttgacttccatcttactctctccttgcacatgttacttttgtcatcaagactaatgaaattaaatcatcttacatgcaacaaagattaagaagtgaatgcaaccaataagtatttagatgactccttaggttttattcaaacatttaatttatctcttcgtttatgttatgaaatatttgggtgatctcatccatctatatggatagagcagcaataaatctaggacaggtcgtgccccacacctcttctcgcctcacggcgattctaacaacggacgcgatggttcccaaaccatcgcgtcttctattaccgcctctctccccctatatattgtaaccattgttatcaataaaggatcgctcattcattctctacattcttgtgtgcaattctctctctcactcaatctctctcgctcaatcaattctattcacaacacgttatcagcactttcgctctcgcgaaggagatcgcgaagtgaaaggaagaaacatcgcttttgatctaacagaaaagcgaacagaagaatcaacaaagaaggtacgatgcctacctttcattggatcatggatgtcgttctcggcctccctcgccatcagcgcgcacgcaggcttcaccatcttcttcgtcgatcgatgaggagggcgcgccggggatcccgcggaggcagggctagggttggtggccgccgccattaccctcgtcgtgtgcctgcaactccggttgtggcccccccgcccgtccctgtcgcacctcctcctccgcctttggttgaggaagcacctcgtcggatccttgtgcaaggggtacagtacggtgcccaccatggatgggagatggcggtggaggcgaatggcggcggcggagaaggtggaggtggcggtgcaattggtggcgctccacggcggcggttggcgacgtcggcgcccccacagcgacgcccccacggcgacgccccacggcttccccatggcggcgtcggcggtttccccacggcggtgtcggcggcggcgaactggcggcggtcggcggcggttggcggcgaaatggcggcggtgagcag

SEQ ID NO: 88600 - DNA, 745 bp, Oryza sativa
atccaggcaagggtgggcgtgatggagcgggatgggccctgcgacggcctttgtcgcttccggattcacctaggcacgagaggggactgcccgctgccttgcgagtagtgggggtgaaacctgaggtgtggtgtgtttggttagaggaggttatgcaaagggtcctgtcacggtctctttccggtatgtcgtggtggcatgccggcggacggaaacgtgttgtggggctatgtcttgtgggtacagttgtacacctctgatcagagtaaaactattcgaatagccgtgcccgcggttatgggcggtcaaccagattcactgtgattagtctcaccctagtttagtctaatggaattgattagttcaggtggatggttgggcctgttgcaacatggtgtagcattggacagtggatggttaatattgattaattattagaactgttttactgctttcaactactgtttataaatgctagctttgtgcaaatgatccccttttagccttcctttggttatatattgcatcataccctccgttccggtatgacttgctgagtacagtaggaagtattcagtcttgctctatctcccaaccctcagagttcgagtatgcgtccaatggtggtttctccgaggagtaggctttgtccgtgccgtcgaggatgcctgtggagtggtgttcccgctgctatccaagtccagacttagctctagttatcttttatatttccactgcatttatg

SEQ ID NO: 88601 - DNA, 748 bp, Oryza sativa
cagagattcttgtgggcgctgcgcgcgcccgcgggcacgaagccggacgccgcgatgtctcttcttcctgacggattcttggcgcggacagccgacagaggcgtcgtggtgaccgcgtcctgggtgccgcaggtggcggtgctgcagcacgcatccacgggcgcattcgtgacgcactgtggatggaactcgacgctggaggctgtcgcagccggcgttccaatggtgtgctggccgctcgacgcggagcagtggatgaacaaggtgttcatcgtggaggagatgaagattggcatcgaggtcagagggtataaacccggggcacttgtccaggccgacatcgtcgatgccatcttgaggcggatcatggaatcggatgcgcagcagggagtcctggagcgggtcatggcgatgaaggagagcgcagcggcagcatggaaggaagggggatcatcgtgcactgcattcgctgaatttctcaaggacatggaggaggggaatgttgccatggcgcattccaatcaggttgaaacttgaatttcttcctgagcatggctcttgacctttgcatttgtcttccatcaattaggatccatagaaaattgtccaaacccatctgcaagcaccacagttggtcaaatgcttgtttatgataagcttaagttcaaatgaaattcactgaccccaaatatgtgatgacaggtctcttacctgttagaaattcaagcttttcaatttcgtagttcgt

SEQ ID NO: 88602 - DNA, 732 bp, Oryza sativa
tgagaggcctcccactgctcccgagtgagatggagcttcccgccgatggtgatgggccccgagagaggctgtggctcatcaccatcgacgaccttgaggcgacctaacgcctcctcgatcgacattgtggagaggtccagcagagattcgatcgagcgagcgatctgcctgtacttctcagggacgcagcggaagagcttctcgacagctctctcctcgtcgtaggtgtcgtcgccgtactgcaccattttctgcaagagagtgttgagacggagagcaaagtcatcaacatcctcacctggcttgaaggccaggttctcccactccttgcggagtgcctgcagtgtggacttgcgggcgcggtcgctgtcgatgcgtgccgtagtgatggcgtcccaggcctccttggcagtccgcttctgggaaagcgagaactgcatctcgggcgggactgcagcgatgagggcatccagtgcctgccgatcctcgtcgtagtcgacgtcgccgtaccggactgcctcccacatgtgccgcacctggagcctcaccctcatcaccgcggcccactcgatgtagttggttttggtgagggtaggccacccaccgccgggaccaaagtccctgaccaccgtctggacgccgtggtgaccatggcgccggtcaagggagagccgcgctgtctgtgagggccacgtgtgggctccgggctgccgccggcacgcccgcgcccgt

SEQ ID NO: 88603 - DNA, 838 bp, Oryza sativa
aattcctgcagcccctaagtttgataaagatgtgatgttttggcatcatagacttggacatgttggttttgatcatctcactaggttaagtggtttggatcttgttcatggtttgcctaaacttaagaaagatcttgatttggtttgtacaccgtgtcgtcatgctaagatggttgcttcttcacatgctcctattgtttctgtgatgacggatgcaccgggacagctattacacaaggacactgttggtccagctagagtgcaatccatggaggaaagtggtatgtattggttattgttgacgatttttcttgatattcttggcttttcaacactttcgtggtttgtttgttcgattggatcttgaatttcctggttctttgaaaagaattcgaagtgataatggtggtgagtttaaaaatgcttcttttgaacaattttgaaatgaaagaggtcttgaacatgaattttcttctcctcgtgttccgcaacaaaacggtgttgttggaaggaaaaatcgtgttttggttgagatggctagaacgatgttggatgaatataaaactcctagaaaattttgggctgaggctattaacgttgcatgctatatttcaaatcgggttttcctgaggtcaatacttggaaaaacttcttatgaacttcgatttggacgtcaacccaaagtttcacatttgcgtattttttgttgcaagtgctttgtcttgaaatctggacatttgaataagtttgagtcacgttttactgatggattgtttcttggttaccccgaacatactcgtggctatcgtgtacttattttggagactaacaaaatcgt

SEQ ID NO: 88604 - DNA, 1191 bp, Oryza sativa
tgaacgaacagttgattatcaccatgcttaagaacaaaaagcgttttgtcaacctttcccattgtaaaacctttcgcaagcaaaaagttcttaagcctatcataccactctaggtgcttgtttcaagccatacaaagctttagacaatttaaaaacatggttgggaaaatcaggattttcaaaacctggtggttttttgacataaacttcttcctgtataaaacgatttagaaaagcactttttacatctatttgatataatttaaaaccttttgaagcagcaaaagccaacaaaagtctaattgcctcaattctagcaacaggagcaaaagtttcattaaaatccaaaccctccacctgggtaaaactttgagcaacaagtctagctttatttctcacaatcaaaccatcctcattttgtttatttttgaaaacccacttggttccaataatattatgtccagaaggtggttcaactaaagtccaaactatgtttctcttgaaattttcaagttcttcatgcatggcgttaatctgcgattcattagttaatgcgtgtgacacatctttgggttcaaaagaagcaacaaatgcagaatttacataaacatcatgagtcgttaccttagaccttgtagtccgctcacctatattactaatgatttgttctggcggatattgtcgttgaatgtgcaatggagcagcgacttccgaacttgattcacgccctgtatcaatactgatcaaagttgtagtctccggaggaccatctcgatcagcatcaacagtacccgaacccgatgagcctggccggtctgactgcacctcctgtgtcagtctgatcggcggcgtgccggcagtctgaccggcctagcgcctggtctgactggccgagccgaccttatcgttgtcgtcattgctctcgtcttcaaaaatacgaccatcctccccctgaacctgtgacaatgtacctgcaatatcgggtctagtacctggactagcctcatcaaaagaaacttcgcaagtctcaacgattttgttagtctccaaaataagtacacgatagccacgagtatgttcggggtaaccaagaaacaatccatcagtaaaacgtgactcaaacttattcaaatgtccagatttcaagacaaagcacttgcaacaaaaaatacgcaaatgtgaaactttggg

SEQ ID NO: 88605 - DNA, 4507 bp, Oryza sativa
ttataacctgaaacggaggaagtatattttttttatcttgttgtcaaaactctattttcatccagcaattccccccctagggtttgctgtgccacgtaatttggacaaagaattggctatatataggagtttgtgtaatgtgccaaagcattctttcttttcacttagttgctttcctgctttttttagtaaattcatgatgtcatctcagtcacttccatacaacaatgccactcttatctaccttcctatttgagcatctgaattataccacacatttctatgtgaatttttatatctttgaactgaaaatgtaacagagacattgccttcatttgtaaggtgtattactaattgacatatttatctacttgattcaattaacatttttttaaaccttgtgtgcatatcatgatgttgcttaggccttccaagttaaaaaaggaaaacataaaatttataagttcaatctgttgtcccttttgtgttgctaatgaaactatgtagatggatcgttaacgttttttgttgaccatccttgtaggaagagttcgatgcaacacggtggcttgatagatccctcatacggctttgttcaagatttggggattatcggaaggatgatccatcttcatttagcttgcattcaaatttctctttgtttcctcagtttatgtttaatctacggcgttcacaatttgttcaggtgatgtgttgcactttttttttttggttatctttaggaaatccttgccttattaatactagcattttccttgtcacaggttttcaataacagtccagatgagacagcttatttccggatgttactcaaccgtgagagtatcactaactcagttgccatgattcaaccatcattaatttcattctcttttgatttgcctccatctcctgtattcctcgatgtggcatcaatagcagcagatcgtatactgctacttgatgcatacttcagtgttgtcatcttccatggtatgacaattgctcagtggagaaacatgggttaccagaatcaacctgagcatcaggtgagcatcctttctgcatttctacccataagaacttattcctcctgtgattgacttaagggtgtattggttatatagccgtctcaattgtactgtagttatcacttcagaagaaacattggtcagacttcctaggctttggtagcagcatattctagttctagaaactggttaactacatgtttgttggtttcaccagttgctctaatgacagtgtatgctctagttatcactcagtatcaccagtcccttattatagaagaggttacagcatgcgttttgtagccattagctgtgtggacctgaaacccttgccacaatctctttcagtgacggccctttataatccatttgtctagcacaatactactgaaaacttgtatatattacataaaaactcaaagtcaacttgagatttgaaaatgcgaaccagaggacgaaaaaagctgctttctgtgttattattaatctgaactctgaactgtccagattcagtttttactgccaaaatggttttcaaaactcttctatgaagacctcgcagagacgttacatatttgataagtccgcattgttgaccacacatgtttaaatatattggatctatgttcttctatgattgtcaattgaactttttcgtgtatataggttagctgatgttttgatgcaacctattgacaagctagaacttccatgtttatgatgcttaatataactctccgtatttgtttcagcaatttgcacaattgttgcaagctcctcacgaggaggctcaaataataattaaaggacgatttcctgctccaagactagttgtctgtgaccaacatggctcacaggtatgttatcacagttgttatttttctttcttaattgttcctactaccattaatggcttgtactctccatgcagttaactggaaacaactaaatgctcatggttaagaatgagcctacatacatgtcctatcaccatctaaaaccatgaatattttataaaattataaaattgcatacatacgttcatatgccttaattgtaaaattatcttgataatagcataaatgtgtgaagttgttctcaaacttttatgtactcaatttggatagtctaaggccaaataagaaggcaacaaatggaagaactatttgtgtacaagttgtggtagataagctataaagcataaagatatgctatatccaaagcctttatgacaaataagtttgttaaaatcgcaatcctgaatcagaattgggggtctctaaccaatcacagaatcacatacataaaaattgtaaaatcgtagattctgcctactagaatcatagaatcaggcctcttgattaggatagtaaattcgtagaattgtatggaagaatcgagttacaaccttgatgataaatgcgtggaaaatttgaagtatttgatcatgtttgccatgtttacctgttttatttgaggaactgtataatttggctctccttagaattcctcacacaaaaactcaaagaaacagtaacttcattatgtgatagctaacatcaaatgctcctccgttctatgcaggcaaggttcttgttggcaaagctgaacccatcggctacatataactcagcacatgatgttcctccaggttctgacatcatattcacggatgatgttagtttccaggtcttctgtgagcatcttcaaaggctggccgttcagtcctaaggacatgtatgcaaagttgtacaccgtatctgatagctatatttactgagtttggtaggtctgagttgtgggagatttctgctttccctttttttgacctcatgtgttcttattacatcgtgtcaggttttccgacatcagacaattttttcgggaaataatcttgaaagcatgtataagttgtccccataatattatttatccatcatatatacttctttatattgacctcactgtcatcttaaggtgtatagacaagtaagatttttgtggtcggatgttgtctcattttggcttccaatgtgttctggcgtggtgttcatgtttgttttcctttgcgacacaacgtcgatctgtgacttcattgtgatattgttagccatgcatctgccatgtatcttacaaacaagttaaaaacttttgaaggggacaacaatggtacttttagaaaacaatgttccatatctacggtcttccgtagtgaaaagatgttcaaaagcttcgatctttaacagtttaatttcattaattctaatagccttaaaattttcataaaaagtcgatgttgatagataaactatgatgagaaaacatcgaatctagttttaaaatatagccgtggcgatagtgaacattgtcctgttgagaatttcattgttgattttcagactgatttggtctaaccacttcaaatgtatttctgttcaatgcatgtaattgttagggcctcatcatttgcgtcataatgtatctgccgcggttaaaatttgaaattaaagttgattttagggtatttatggctaaggataaatggtctttacaacatggggaaaaatattgttttcttaaggccttccaaaattgaccattaatataagattgaaaaatttgatcattaatatcaccccaatacttacagtgtccaatagtttgttgaaaatgaagcttgggattcatcgactcaattacaagaaaatatattatcaaaaacgtaccaagctaagttatgagctaccttattacctatcttaaacagtgcgctaccttattataccttggacaatgcgagaattcatctttctcaattttgaggatagcattagtctatataaattgcccttgcaatgccaaacgaggagtcatatcgacaacatacattcactacttccgtacaatcagatttcgcttggatttgctacatcccaagtttacagccaaataaagaccaaccaacattggcattagccgcattacctctaccatcgcagttgaagggacgtatgtggtataagaacacatggcaactaagaaattggtatgcttcatcacatagtaaaatagcggctacgcttgattattcgtccgcatgaaaagctacatcaatattaagtttcacatatccatggaaatgttccatccattgttttttaagtcctctaggattgaatattattgatcttttattttagtgttatcttttttttccttgcatgaggactatacttcctcatttcattaagaagaagaggaacaaatacacgggagaggtcgaaaggatcatctccaaaacacaacacacaacaccaccaaacctcaactaaaacacatcgtgctatcaacctcacaaggagctccagcaaagcatgcgctccaactaaacaccataactactctcatttgctatagaacatgacctaaggatgccaccattaaaaacacagtcattatggtgcttccaaatatcc

SEQ ID NO: 88606 - DNA, 637 bp, Oryza sativa
tctgccgccaccttcaccacgcgccgccgcctcgcgccccgagccaccgcgggccgtcgccatcgtcgcctgccgccgcgccgccgtcgccatcgccgcctgtcgccgtcgccatcccatcgccgctgccgcgccgtcgccgtcgcgtcccgcctcgcgccgcgcgtgcgtcccatcaccgcctcgcgcccagagccaccgcgcgccgtcgccatcgtcgcctgccgccgcgccaccgtcgccatcgccgcctgtcgccgtcgccatctcattgccgttgccgcgccgtcgccgtcgcgtcccgcctcgcgccgcgcgtgcgtaccatcgccgcctcgcgccgcgcgccaccactgccgcgccgtcgccgtcgccatcccgtcgccgcgtgcgcgttccatcgccgcctcgagccgtgccgctgccgcgccgtgcgccgtcccgtcgcctcgcgccgcgcatccgctgcctcgcgcccagcgccgctgccacgtgccgcgccgccttgcgccctgagccgcgccgcgccgtcgtcatctccgcccgcgcgccgcgcgccgtcacatcgccgccgtcgcctcacccccctccaccgcccttcccttctcttccctctcccccttatcctctctttccc

SEQ ID NO: 88607 - DNA, 599 bp, Oryza sativa
agtaagtgtcaaagaaatcttcgccttctttctgagtatagcccttttcaacaagctgagccttgtacttttcaatagtaccgtcaggcgtaaacttcttcttgaacacccaattgcaccccataggtctacacccatagggtcgctctgttacctcccaagtcccgttagcgataatggaatccatttcactacggacaacctccttccagtagtctgcatcaggagatgcatatgcttctgaaattgactgcggagtgtcattcacgaggtacacagtgaaatcatcaccaaaagacttagccatcctttatctctcactcctccgacgagcttcactgccatcctccttaatgacatgttcatgtgtatgttcattttgttctggtggtgtgattgaactgggaattatttcagagggttggctagaagtactatgtgtatccttcattggaaaaaaaagctctcaaagaaggtagcgtcacgagacaccataactgtaccaacatgcataaaatgtacctcagatttaactattaaaaatctataggcagtactgtgatgagcatatcccaggaagacactgccacagtcttagg

SEQ ID NO: 88608 - DNA, 739 bp, Oryza sativa
gacaggaatacacttatctagacactagcacagagaattccaaacgagcaaatataatcttttactaagcatttgcatttctaaagaaaggtatgttgcagtgtaatcactagcataatttgtgtagttcgcactaattccctgccccttccaagaagaatacttaacagcagttgagagtctaaaggccagttatgtttccagatcataaacaagagcttaaactttaaacacatcgggagagattgtgtgcgccaaagaagcttaagagaaaaaaaacgttgaacaagcatgctaagtgaagctaatgtaaactactatacagaaaatgggagctcctgaaagcattagtatacttttttaatgtaactgatttcatatgtttaacagatgaaagttggcattgacttttgtaacaacctgaacgctggaaagcatcccacataatgtcttcgtgctcttggatgccaaagagacacaagggtgcagcttggatgccaaatacttgccatagtaactatccggtattgctttggcgcaaaaagtcctgcaacaatagagtattagagatactggcatacccagaagaaagaacagaacaagaaattcaacataaacccctttgaagagaccttcggatgcatatatagccagaatctaattccctgccatagattgcaagaaccaagcttcgcacacatacaatcttccattggcagccaacactgtagttttaaga

SEQ ID NO: 88609 - DNA, 2126 bp, Oryza sativa
agcatactataagccacttgctcctaaaattaaataaacacaacaaaattatcaaatcacacaaagcatacatataaaattgtcctatagaagccaatagtgataaggccgtgcctgtataaaaacacattgtggtggagcgctgggccttagaagtgggggagggagttggagggtaaggggagtgtgaagcgatcgggaggtcatgtgggagagtaggagatgccatttgcgctcgtcatggcagagtatgaggccggtggctcatgctgggtgtggagaaggagaggaaaatatggattgagatgggtccaattacaatagtaagcttgtgaatagagagacaaagtatttattaggggtatccagattcgatcgaacgggcaatgcatttcttgatgatgtggaagcacggaatatcaggaaatagctattaagtacactaagaggggatgaattatataggtttataggtttaatgaatgtaaatagagattgcaagatatatatgatgtgttatactgtagtgaagcagacatattggaaagtacgcaaagggttggagagtttttgcagattatgaagtaaacaaaccaactgtaaggttactctaaatatatttagaccaggaagtaatagaaatgctaaattaaataatagctaagaattctgtgtgtgtcaaatgcacaaattacccttctagatcaaaaaacaaagagaatgatcatcttcgttactaaagaaagtaaaaaaaaaagtaggtaagcaaatgcatcctatatctattaacgttatgggattcaaccgcttgcaggttgtctcaactttgaaatatgagtatgcgattgagaagctaaagagtactggctttggaattttagaaagatgcggtggtttacttgtagctatcaaagcgattgcagggcttttgaaccataaagagataaataaaattgagtggggaaagtaccaagtccttcatggtcagtagatggaatgcccgaaaagataaaccatgcaatatatttaagctatgatgacctagctagcccctcatttgaagcaatgcctcaataaccatttgattgttgaaatttggataagtgaaggttttgttaatggaaaatcaaatgaaccggaagagctaggaaaggagtattacaatgagttaattataaggaaccttatacaggcaatgcccaatagtgaatggagcatgcatgatgtcggtcgctcattttgtcaacatttggctaaagatgaagcactatcatctcaaatgggacaacttagagtcagtgacattttgaaatggagggagtatgaagtaaacaaccaactgtaaggttactctaattaaatttagaccgggaagtaatagaaatgctaacttaaataatagctaagaattctatgtttggcaaatgcacaaattacccttctcgatcaatcgcaaatctagcctatatgtattaacatcatgggcttcaaccgcttgcagattgcttcaactttgaaagatgagtatgcgattgagaagctaaagagtactggctttagaattttagaaagatgtggtggtttaccgctagctatcaaagcgattgcagggcttttgaaccacaaagagataaatgaaattgagtggggaaaggtactaagaagtccttcatggttagtggatggaatgcctgaagagataaaccatgcaatatatttaagctacgatgacctagaccctcatttgaagcaatgccttttgtattgctcactcttccctaaatatggtaaacccaataaacatttgattgttgaagtatggattagtgaaggttttgttaatggaaaatcaaatgaaccggaagaactaggaaaggagtattacaatgagttaatcataaggaaccttttacagacaatgcccggcgacaataataattggaccatgcatgatgtggttcgctcattttgtcgacatgtggctaaagatgaagcactaccctttcatatggaacatcttagagtcactgacctcgattcaaatagatatcgttggttgtgcatacagaatgaattagattggagtgcatggcaggaacaaaactcaattagaacgttattttttt

SEQ ID NO: 88610 - DNA, 2261 bp, Oryza sativa
acaaaacacatttattagtaataatagttttttcgaggtttattgatttatcttatttagaccgtatttcttgaaaaaaaaactatgctttcattttagatgatgaagtggattgtcgataattgctcacagagatgaattaaatattatataagatgatgttgataaatagcttggaaataatatttgagagatgtccattaacaaaattttagaaaaaactatatttttgaagattgacacaaataatccaaatgatatctagcccttaataagtttaccaatcataggttaagacaaatgcccgagcattcaagtgggctacttttctagttgataaaataggagcgtaacagcacctgtaaaacagatgtgttgtatatatgtgcaaattgatgggagatggagcacactacaccacagcaccaaataggaggcgttgtcatgcgcatgggttccatgcctttgaaacataccttcatggtatatcatataggaaactattctaatccctcgaggggatgtttcctcgtttgtttaaaaaccatttaaacggttatgaaaaattatggaaaaatttgacaatatttatacaacacatatatacaactccacaaaatcttaagtccaaactcaactcacacgtcgagatataaaaaagataaattcagcgtatgaatagtagagtactgtttatatctaaatttgttttttttttctcgatgtgtagatcgaatttgaacatgaattttagtggattagtaggtatcattatgctctacaatgtcaattttttttcagattttttcataactatttgcatcgaatttggaagaaaaaggtagacgagaggatatcccctcgagggattagaatctactcccatatcatatatatacttatcaacttatggatggaagggatccttcggaacctcgtctattctatccaagataacacagctgtggcagataaattctactgttttgcagcgccatatttacacaccatcatcatcttgttgctgccatcagccatcatatatttcacaagatacagtagggtggcaccatcaaacaaaggagcagtgcaataaagttttgctagagagctacttatcattatcactattacaggatagattttcctagacgccaccctattttgtttacatgcggtccataaatagaactgcatgaaaaaatagggaaccagcaccgagctgtttttcacacgggaaaacgcattatcccgtgcgggtggcttaactcacctgcacgcgatagctcatccggcctctccctctcaaaatttcaaaaaaaattcatcctctcaactctctctctctccttccccaccacttcatccttatcctcttctcactgcctcatccttatcctctcaactctctctctctcccctctcctctcctctcatgcgcgggccagcaggcgcacgggtgcggctcgacggccggcgcgcgggcggcgtcggggaagcttccggcggcagcggctccgtgccgagcgcgctggcggcggtggaggcgctgtcggcgttgggggccgggagagggacgcggtggaggcgggtgcagggagtcgcgagcggcacggagcgaggcggccggcgcccggatccaccctccgccgcccagatccggcggcggcgtccctctcccacccttccccacacgagggcgacaacgacgacgacgacgaggcgggagcagcggcggctctcctctccctactttcgtggggcggcagcgaccgtgcgaggcggcggagagtgggcgtggcggtgaccggtcgaggcggcgacctggcgggcgcggcgaggcgactaccgggcgggcacggcgaggcggcagcggcgagcggactcggcggcgagtgggcggccgacgcgactgtggccgcggcggccgtcccccgcggcggtgaggggcgccggcgggtgtgctcaacggcgacgcgatcgggtggccgtggctggtcacgacggctaccgaggggccgtggctggtaaaggaggcgaccggggcggcctggctggtcgtggcggcgcgacgatgtcgacgatgagttgcggcggccggttcgcttgtgggccggcgggcgggcggcaatttttttaaatttttggttttttcgattccgtgcgggtggtataatatgattattccgtgtggtcctcctgcccacacgtgaaaatactaattttcgcagacaacggtgtgcaggtgggccaaatgaccg

SEQ ID NO: 88611 - DNA, 685 bp, Oryza sativa
attggtagggtgaagatttacctgaggaatggcatcagggaacaggtctatcatatacatggacgccaattgatggaacaagtgcagcttccattcactccaccatctgtcaagtgcccggctcctgaaccttgccaactttatgttctcaatgctgcctaatggaggtctggggatgttcagtagccgatccatcattaaggttgaagagatgtcacctctgcactggatcttgtcggcaaagtacaggctgatcggcagctgtcccattccgagttgtctagccgatgacattggatgatagaactcataggagacttgaatatttctcccttgatggatgccaacagggaggatgcacgggctgatagcagtagtgaagacttctcgagattgctgaaatttttcgtgattgatgtcttcaaatctgaaatcagctggtagttcaaagtccattgaatcggcatagaagaaccaaactcgggcatccttctgaaacccatcataaaaactgaagaaccagtcctttagaagttcagccgatagctttgctcccgcatcggctggcatagaggcatattctccgtatgacatgcatctacaatgagtgcgttcttctccatcatcttccacaatcggctccaaccttggaaattcggcttccgtcacagatggccgattgaca

SEQ ID NO: 88612 - DNA, 587 bp, Oryza sativa
aaatttccatttggaatggaaatgctccgcatcaatatataacctagtcgacattgtttcattgtgcaggaaggaaaagattcagaacttcatagactgccaggtgaaggatgttgaggaatttgaagccgaacgagacaaactgatcaaattgcatgaagagaagaaggtgaagctcaagaaggagtacctggcgaaggaatttgagcttgagaaggagctggacacagccctcacttccctgatggataaacacaagccggacatcttcaaatcctccacctcgccttcgacatgaagaactgcggcttaccatacatttcctgctcatctacaatagctaagactcccatttcctaagtacccgtaaaacttctagcgatgcgaaagcatcattctgtttgggtggatgcatgcctttggaaggaaacctgaaccagttccgtattatatggagtactatcagtttatggttgctgatgaactgatgactgtgcgctgcgcttttacagcaagcgtggaaatcgaatatatatctagtttatctcatcattctgctctgcgttgcatcaactgctgattgagtg

SEQ ID NO: 88613 - DNA, 1009 bp, Oryza sativa
tgatcaaaaggtgatgcctgagggagttaatactactgcaattgttctaatggctaagaagaaggagtcaaaagagctaaaagatttcagaccaatcagtttgtgcaatgtgatatacaaggtggtagctaaatgcctggttaatcatctccgaccaatcctagagagtattatttcccaggagcaaagtgctttcattccgggacgcatgattacagataatgcgttaatcgcttttgagtgtttccacaatattgcccagagcaaaagggagtctcaagagttctgtgcctacaagttggacttggccaaggcttatgacagagttgattggcagtacttggaaggggtattggataggatgggtttcagtaacacatggattcaatggatgatggcctgcgtcacttcagttcgctatgctgttaggtttaatggatccatgctgaaatccttccaaccatccagagggctgagacaaggtgacccgctctccccataccttttcctgttcgttgctgatgggctatccaccattcttagttcggctgtaagaactggggatttagttccgctgaaagtgtgccgacaggctcctggaatttctcacttattgttcgcagatgatagtctcctctttttcaaagcaaacgtggaacaagcgacggttgtaaaagaggctcttaacctgtatgagcggtgtactagtcagttgttgagcccggcaaagtgctcaatgcttttcggcaaacactgttcagaccagactcagccgggcataaagtcactacttgatgtccagcaaaactcgtttgaagacaagtacctggggttgccgacgccagaagggagaatgaaagcagacagattccaatcaataaaggaaaggttcttcaaacggttaattgattgggcagagaagcatctgccaatggggggcaaagaagtgctgattaaatcagttatccaggcgctgcccacgtatatgatgagtgttttcaagctgccg

SEQ ID NO: 88614 - DNA, 571 bp, Oryza sativa
aaacccaatcaccaacttgaaattccctgaaactcctcttcttatctgccaagtgtttcatttgttgctgagctctgttcagatgttgttgaagcaggtgttgcataaatttgcgctgctgcaaccattgagacacatttggtatggcacagtcattgaggctgatgccaaagtgactaggtttatagccatacaggacttcaaatggggacttgttcaatgtggaatgataagaagtgttataccagaattctgccaagtataaccattgggaccacttagtcggagtggcatggacaaagcatctcagataaatttcaaggcattggttcaccctttctgtttggccatctgattgaggatgatacgcggagctcatatgcagttttgttccagacctcgcaaaaagttgctcccagaagttactggtaaagactcgatctctatctgaaatgataatgttgggtaacccatgcaacttggtaacatgtttcaagaattcaagagcaacagttgcggcagaaaatgggtgtgaaagaggaacgaagtgagcatatttagaaaacttgtc

SEQ ID NO: 88615 - DNA, 626 bp, Oryza sativa
gggcgaattcgagctcggtacctgatgttctcaagttcaatgggaaaatccaaacccttaaacttggttggtgccaggtaatcttcataactgaatggaatcgcggatgcagatttaagttatatcctcttcagcctggttacatattttgcagataggtgtatcaggtgcagaatttgttgctgattgtttgaagtacaacacaacattatctacattggatttgagggcaaatggacttggagatgatgtatgcacaatcttcgttgaattttatttataacttgcgctttgattcatacccatgccttctgatccttctctttttgaagggtgctatctgcttggctcgaagtttcaagatcatcaatgaatctttgacttcacttgacctgggctttaatgagattagagtaagtaaacactaaatgcagtgtctttttctttttgtattttctattggtgggtctatgcagatctccaccatgttcaataccctttatgctcctaacaggatgatggagcatttgcattggcacaagcacttaaagctaatgaagatcttgcagtcacatcattaaatcttgcaaacaacttcttcactaaatttggacaggtcagttgcc

SEQ ID NO: 88616 - DNA, 594 bp, Oryza sativa
tcctcgcaattaattctgctaattttgtgcagtgaatttattcacagttagcttaggtgaagctgcactcgggtggcggcactgggcgcttcttgctattgtcggtgcagtagtcataggtcaggttccccctcacgccatcgtacgccgcctgctgcgccgccgtcagcctcctgtactcgccgccgttccaccaccacgtgtccggcgacccgcagtcgtccgagctgacgccgccgccggcggcggcggcgcaggcgtcgacggcgaaaccctggaaggccgcggtgaatggcgcgcgggcccagtcgaccttggtccggccgccgttcgtcgcccagtcggaggcgtcccacacgctcccccgcggccgcataggcttcgccgggaactcgaactccgggccccggctcgtcaggttcttcagcaccctcaccgcgtctcgtccacgaatattctgccaaataattaatcaaatcgatggcttgacatgtgatttgtcttaacttctacagaattcaggtggccattttgtagagttagatttatccaggtttaaaatctccgtctagagctgcttgaaagggtcaactg

SEQ ID NO: 88617 - DNA, 544 bp, Oryza sativa
ccatgtggttgcgcgccagcgagtcgccgatgaaggcgaggcgcttgccgcggacggcggcgaggaagcgcgccggcgaggagcgcggcaggtcgtcgcagccgccgtcggggcgccaccgccagtagaggtggccgggatccttgccgtacttgtggcagttcttggaggccggcagcgtcgggcacgtcgcggccgtgtacgccgggccactcggatcccgaacccatctccccaccgacgtgtcgcagctgttgttgttttcctcggctcgtttttgcaccgcacctgagcaaagcacagaacgcactgaatgactcatcgactactggagtgagcaaacaaataagttcacttgcggtctctcatctttaacgtcgagtttaagtcatatccttaaaccgtaaaacatgatacaatatattccttatggttttttatttttctttcttgtaccacgttatgagcattctccgtattatgccttgaagaggactcgaacctccacgctctttgcacgagattttcagtctcgcgtgtctac

SEQ ID NO: 88618 - DNA, 705 bp, Oryza sativa
cacaacccgtcggacaagatcgataaaccagcaccagtctcgtgaattctctttctccaccaaggcaaaagctaaaggtacaagttggtcctccgcatcagctgataatgcagtcatcaaggcaccaccgtatttcccagttaggaaggttgcatctatagctagtactggcctacaatgcttaaaagcctcaatggaaggaccaaagcaccagaatgcacgcataaaaattttcttggtcactccatcaacgttgacaaccctatcaggatgagtatcgatgtggtagaccatactgggattcctctgcttaatggcttgcagcaaagtgggcaaacggacatacgcttcaccccattcaccgtaaatgagcttcatagcctcctctcgtgccctccaagccttgccatacttcaccctatactggaaaacctcaaatatatacaaagctaacgcagaagcagagagtgtaggttgcagttttatggcattgcataacctatttgctatgaactttgatgtcagttgccggtggctccctgaaccttcggcagtagcacaactatgttccttacctacccgtgatatcctccacgtgccactagacctcttagttgcatggaccttccatttgcaccgtgggttttcacatttaacagtgtacctcctatttgcggcagaattgacaacacggggtgcaggaat

SEQ ID NO: 88619 - DNA, 656 bp, Oryza sativa
atccatatcgccgaagcaatgtcacccccagcatcaggaaacagaacctctcccaacaagtgcaagatgtatgcacgggcataacactcaacacgccatggctcagcatcgtcgtcaagatgtgagaagttctgactcagccaagacaggggtattccattctgcttcttcttccccccttgcccctgctcatgttcagtggaatgccaaacagctgctgcacttgtgcatgccatccaggagtatctgtcctgcccgtcacggcatgcccccgtaatgggagggccaagatcatagccacatcctgtagagtgatggtcatctcaccactggggaggtggaagctgtgtgtctcaggcctccatctgtccacaagtgctgtcaacgcaggagcgttgaacactggcattcctctgctcacgaccaaggccaccccgagcaacccggcagcccttaggtacgggatgtacctatcgtcgaacactgggggggcatgagctctgactcggagcggttgaagtacctgcattagcaattgtaaatcaattagttaatataatgtcaaatacacgctaccgatacttatgcacaagtgaatcaatgccgattcataccctccccgcctcgatcgcagccccgcgatgacgggcctcgta

SEQ ID NO: 88620 - DNA, 681 bp, Oryza sativa
tcttccgccgccggttgccgcctccgcaatccgccgccgtcgagcgacctccggcgaatccgagccgttggctcgcctccccctgtcacgaacaactgcccggtgtgctcgcttttgcccgtatctccgtggttcgctccgccgctcgccgccgccgcccgccgtccattcgcggccgggtcgtcgtctacctcccgccgtcctgcgtggcagccacgtaggtgccacgtcggcgccagctcagcttagaccgggtcgagccgaccccggtcggtccctccccgtgcgcgcgttccaccgcaagccgtgaggctgcgcgtgggcccgtcgcatctgcgtccgccgcggaccgcgcgcatgcaccgcgttcctccccgcccgcgtctaaatttcctccctccttccttttctttctcttttccaaaaaggatttaattaaataatctagaaattcaataatcttagaaattctatatcttcccaaccgtaaatccgtttgactccgttcaacttccaaaattcatcaaatctcgagatctatctagtggcacgctcagaggtcattaatagggctttattttcgctgtttgttgagttgccccgtttcgcgtgtagtttcggagcccgaagccccgcagtgcgaggatttcgaggatcaagctccagatctgggctgcagga

SEQ ID NO: 88621 - DNA, 2111 bp, Oryza sativa
taatctagtgataaagctcaaattataagtaccacatctcaagagatttgtgtacatatgttgaagagtggtgatttcaaagttcatagagattccaaatgcacgcacatgtcaagaatcatccccctcatctatgcaaagtataagtgcttaagtcttgaaacaataatgccatggtaagctgatagaacggataaaaacatccaaatacgccaatttccccttaaatacaatttatgttacacggtaacatgtggataacttgttcacattaaaagtaacataaaacatctgcacatgcatctaaataagcatgtttctgtgcaacgagcatccattttccattcatgtgccatcacatgtgcccccttaagtttaactcccaaagaactaaatttcatacgctaagaatataaagatttacctgtgtactccccagatttttcgtagtcttgaatgaagtgattaatcactggggtgggtatgacgtagcctatgttttctacatcttcgtgtttaagagattgaaaagctatgcccacacacttgcccttatcattaaaagcagggcccccagagtttcctgaatttatagctgcatctatctgttccatgaaacagtgaaaacttaagtatgctcccaggttaagagattattagaaataattccaaagagaagtaaaaactatgtctacaatatgcaaaatatagacaatcaaaagcatgcaaagatcttaagagaaaaacctgcaatcctagaagctccgttgaaccatgaacatatgaaagtatctctattctagatacaacaccacttgtgactgagatcgtgtctcctccaattgggtaaccaacaacagtcacagcatcttgaagtgcaggcaaagatccaaactctaggggtgaaacccctttccagaattcatcatcctctacagttaacattgctgaaatggaaaggttatattaattatcaaataacataagaaagctaacttcttgaattattaaacaataaattgacaggcaaatctttgcaatttaataataaattgcttgaataatacaatttgactcctgcccttgaatttttttaggtcagggcaacttccaaacgatcgacccagtacctccaaaataataacccacataggcaggttcctgataacattagaccaagaataatagaatattgttcacttgtaatcaccatcaagcgctcaaattagcactagcttttggatttcttttgcacaagtactataacaatttcacaactgtgcatttatgtgcaacgaagcaaccgtaaagccttaaataaacaagaaagggcacatgagatttagttgctatccctaaagttatgtggcattactttagctactccttatcattccctatcctgttaaaaatatcacaaggcattctacacaagcttgatacgcactctgtccaatctagattgccacctattatcacactactccatgtgatgaccaaatctgttgaaatggtatcatcgaactcaaacctttgtgattagagtgaacataaataaaaagattacaatgctaaacctgactaatctggatttctggtatgccaacgtgaagatttgtaaaacaaccgaacatacaaaatctgcaatagtaaatagcaagtgtttctagctattttatgagcagtgcacatctgcagttttcaatctgtttcacaggacattgccattttaccaaacattgcaaggattccgattgccaaaaactagtccatagtcctagtaaagtcgcacgagtgtgggctatacataccaatgtcacactcggtgccaatagcgagaacggtggcaaggtatttggtatccgatcccctcttcttaagcttgacctgggtgtagtgctcgacggagtgagcgttggtaagcaccctgtgcccaccaatgatgaacccgctgctgctggagctatattgccgcttgcgctgccacggcagcgagaagttgggctccgtgtgcacgcagaacaccttcaccacggcgtccatcgacggcatcaccttcgccacctgctcccaccgcaacggctccaccacggggacctccgccgccgcct

SEQ ID NO: 88622 - DNA, 651 bp, Oryza sativa
caaagtggtactccttcagatatagcaactagttcagctttaacagtgtcttccttttgagaaagggcatcagcagccgagttgtgaattcctttcctgtaacatattttgtactgcagtcccaacagcttggtataagctttttgttgccaaggtgtgtgtaatctttgctcagacaagtgcttgaggctatgatgatctgtgagaatgagaaattctgcatgctgcaaataaggtctccagtggtccacagctagcagtatggccatatattccttctcataagtagataaccccttagacttgggacccagagccctgctgagaaatgctataagatgattgtcctgtgatagaacagcaccaatggccaactcactggcatctgttttcaggggtaactgttttgtaaagtcagggagagctagaacaagagcagataccagagccttcttgagatgttggaaagcattgtcagtgtcctgagtccattgaaatggaccccccttccttagcaattgatttagggatttgttaatctttccaaatcccttcacaaattttctgtagtatcctattaaccccaaaaattcccttagttttttgacagtatagggtacagcccagttaaccacatgttgtattttttta

SEQ ID NO: 88623 - DNA, 618 bp, Oryza sativa
ctccgtggaccccggcgccacggtggcgcggcgcatgagccccgccaccgccgccaccgcgccgccgtcgatgagcgcctccctcccctcgccgcagccggcgaggttggccatgaccatcagcgccgggcggcgcagcgcggcgtcccccgcggcgccgacgagggccgccaccgcgccggccgacctcgcgagcctcgaccggttcatctcgtcgagggagaggtagtacagcgccatgccagcgtcgcgccgcgcgcggtcgccgtcggcggcgctcgcgaggaggcgcagcaacggcgggacggcgccgagcacgccgatcgggatccggttcctctcctcgatcgagaggctgtacaccgcgccggcggcgtggtcgcggagctccggggacgccgcggcgagcagcccgacgagcaccggcacgagctccgcgcgcaccagctgcacccggttcgccggctccagcgagaggttgaccacgcacgcggcggcgctgaccctgacgccctcgtggccggaccccatcaggcggcgcagcccgtcgagcaagccgaggcgtgcagagcgcgcgcctcaccccgttctcgccgccgcgcagcgtctgcttcagcg

SEQ ID NO: 88624 - DNA, 575 bp, Oryza sativa
ccggtttcgcacggtacagttcagcccagatattagttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgagcgcgttcgccagctcttcctctcacggagcgtcgatccctcgcccacacggtactttactttttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtacccccggaccaactcacgtactcccacgggcacattagggggtaccgagctcgaattcgccctatagt

SEQ ID NO: 88625 - DNA, 571 bp, Oryza sativa
aagcgatgggataaatccagtgttttaaatagcgggctataacatttagcagttgacccttctcaagcagctctagacggagatttaaaacctggataaatctaactcctacaaaatgaccacctgaattctgtagaagctaagacaaatcacatgtacaagccatcgatttgattaattatttggcaggatattcgtggacgagacgccggtgagggtgctgaagaacctgacgagccggggcccggagttcgagttcccggcgaagcctatgcggccgcgggggagcgtgtgggacgcctccgactgggcgacggacggcggccggaccaaggtcgactgggcccgcgcgccattcaccgcggccttccagggcttcgccgtcgacgcctgcgccgccgccgccggcggcggcgtcagctcggacgactgcgggtcgccggacacgtggtggtggaacggcggcgagtacaggaggctgacggcggccagcaggcggcgtacgatggcgtgagggggaacctgacctatgactactgcaccgacaatagcaagaagcgcccagtgccgc

SEQ ID NO: 88626 - DNA, 508 bp, Oryza sativa
cgagctcggtacccacaacgccggcagtgtagccggcaggaaccttgatcctcatgtggaagaaccctgagccgtacatcaacttggacctgaatccagcacctgcatgcatgataattaatttgcatgatcacatcaagctagttaagcataaaatagagagagaaaagaagcaaaaactatgatcaagctgatctaaatgctgaatctaacagtgtcatatatataatctatctgtgtgtataccagagctcttgtccagggtgaggctaatctgcgtgccctggttgaccaggtggtagccgtctccaccatatgttgccacgtagttgtcgtcgaacaccgtcgccaccgccggcggcggcgccggcgccggcggcacactatccacggccaggaggaggacggcgatggcgatgaggtggaggaggagcagccatggcggctgcacttggaaaaccatatatatactttagccaatgtttgctagtactaactaattaattaa

SEQ ID NO: 88627 - DNA, 786 bp, Oryza sativa
tatcggttccgtcatttagtccgcggcaactggagagaaagacttaggcggaagtttaaatttcctgtgagtacacatgctctacatttatatttctccgattaaaatacatacaagtgtatattaattagatctctcgtcgtttgtcttttatttatagtgcgcaaagcaaaagcagggaactaacttgtgcggctactacgtgtgcgagtattgccactgccttgcagaccaaatcatcaccacaagagagctcgatgtacgtacaaataaattcaaaatttcattacgtatcgatttgttgtttaattactaatcaatttcatacattcatatagtttattcgcatgagggataacctgatcacacacaaggaatttatcgcggtggttcaagaacaactcatgggattcatcaacgaacaaatccttaatcccaagggtgaattctactaggacggaaacacaattcataggttcttagcttttgagctagcgactactactacgtcgaaatcgtagctagctagaacatataatggattgtaattaatacatgactatgtttttatatgcatgtatacacattttctataatgtaaatatatattttggtcatatatatatatatatatatatgcatttgcataacatatatattatacatctacatatgtattgaaacatatataaatataatataatatatatatatatgcatggtttatatatatatatatatatatatatatatatatatatatatatatatatatatatatatata

SEQ ID NO: 88628 - DNA, 682 bp, Oryza sativa
gcttgcctttgccgccgccgaatggtgtttccgcctgcacggttggcctttatccccccgatgttgggcgtctacgttatcacagactggcttgctttcgccgctaccgattggtgtcaccgcctacacggctggcctattatgccgccattgttgggcgtctacgtcttcaccgaccggcttgccttcgccgccgccgactggtgtttccgcctgcacggctggcctattatgccaccattgttgggcgtctacgtcttcaccgaccggcttgccttcgccgccgacgactggtgtttccgcctgcacggctggcctttatgccgccgttgttgggcgtctacgtcttcaccgaccggcttgccttcgccgccgccgactgggtgtttccgcctgcacggttggcctttatgccgccgttgttgggcgtctacgtcttcaccgactggcttgccttcgccgctgccgattggtgtttccgcctgcacggctggcctttatgccgccattgttgggcgtctacgtcttcaccgaccggctcgccttcgccgccgccgactggtgtttccgcctgcacggctggcctttatgccgccgttgttggggcgtctacggtcttcaccgaccggccggctcgttcgccgacgactggtgctttcgcctgcacgggtggcctattatg

SEQ ID NO: 88629 - DNA, 560 bp, Oryza sativa
cacccatttcagaaagggctgatgccatagcattataatcgtcagttgcaaatgaagccaaaaagacctccattgcagcccaggtccttggcgatatccggccaacaattcctgtgaaatggtattaaccaatagtgataaactttcttgaccactttgtgttttgactaatagataatgtaagaattaaaaggccagaatatttccttttttagcaaatacaaggtgcatcctaaattgcctaatgagatatagagcaaccgtgccaccgtggagattggagaatatgttacataccaaaatcaagaaatccaacacgtccatctcggagcaaccataaatttcctgcatgcacatctgcatggaaggattcacatgaaatcaagcttccaaacctgcacattttgcacatatgtcaacatgcctattctgaggattgaataaggcaatgaatggcagaaatacccaaatatatgatgtatggaatcacaaggacgcatggagcataccagacattaagtgcagtgactaaagtcagctcaggatcaggaacaagagac

SEQ ID NO: 88630 - DNA, 691 bp, Oryza sativa
gtcatcccactgtcatcaatcattacgcctccactagtcaacctaacccattggtaccagaacagagagaccttgagaggaccatagtcaagttctcatatatcctcgatggcaccgtaatacgtgccagttgttccatcgtgtcccatggcatcgacacaaacatcgctgttttggttcgtgctcttcatgtcttgggctctcgtgtagaatgtatacccattgatctcatatccctggaatgtcgcgatcgacccagacggtcctctcgccaggaaggcaagttgttggttgatcgactcgttacccatgagatattgttgtagccacgcggggaaagtatcaatgtgatgccgtgtaatccatgcatcggacttaccgatgttcctggcgcgaactagagccaagtgctcctcgatgtaaggagctaccaatgaagattgttgcagaaccgtgaaatgggctttacggaataaattattgtctaccttcattattgctttccttctgagagttccctttccccgtagtctcccttcatggcgtgattcaggtaccctgattgggcgaaggtcttcggtaaattctacgcaaaattcgatgacctcctctgttccataacccttggcgatgcttgcctctggacgagcacggttacgtacttcttcagaacgcccatgggctgcaggaa

SEQ ID NO: 88631 - DNA, 1081 bp, Oryza sativa
tgtggttcatggaaagttgcaagctgacagatttacttcctgctatatctgacagttcacaaggcaaacagtatctacggctaccattatgtaattaaaggaacaaacatatggttcgtcatctcaagaaataggagcatggaagtagtagctaattagcaatcgaatgttaacttgaaacaagtttaactgtcttttcaaattgcatataagttttgatgatagatataccctgaggttcacaaagaagcccggacaaggagatgcatataaatgtggatgctgggacatcgatgtgccctgaggaagcacaggccactgaggacttattggctacagaaaacaatcacaaaatgatacctcagttaacgttatcagaatcaaggtaaaagagctttgtggctttggaactgttataggttataaaaatacacagataaacaaaatatctagccagtctcttcaggtggtagttgttcggcaatttctttttcaattcaatgaactggagaaattgaataaaaagattggcttttcttgatttgggaatacatcaacagtgagttgtcatttgtcaataagctgcataagatggttcccagatggtttcatacaacaattctagtgacacatacaattagtgtactaattattttgaaagtgatagtataatgttatgaaaaaggactaaccacctgatcaaaagaatctgaagacggtcaaatctcaaatggtatagcggttacaaacaccaaatattgtagcatatttacctgagtaacaacagaacttgaagcttcaggagaatcacaattcaactggaacccagttagggtaccatcacttttcagctcatgaacgttaggctgtgaaattctcagatttaagtcaatgatgtctccatcaaccactgctaagacaatccccagtgtgcttttgttaatataaaatttggatttgtcgttctagtggataaagcacaatatacatagtacaaaagaaataccttcattgtcggtttcaggtagaacatctccatcataagaactaggatcaaaattagtaacagcttcccttccat

SEQ ID NO: 88632 - DNA, 546 bp, Oryza sativa
atatcttggtattcaatgcattttagaaaggttagttacaaagattggaaagttattgaacaaagaattgagaagaaacttagtagttggaagggaaaacatatatctgttgggggtagactggttttgattaattctgttctttctagtttagctatgtttatgatatctttttttgagattccaaaaggggttcttcaaaaaattgattattatagatcaagagtcttttggcaaggggatgatcataagaaaaagtacagacttacaagatgggatattttttgacaacccaaagatcagggtggtttgggtgtccataatttagaaatacaaaataaatgccttttgagtaaatggttgtttaaattaataaatgagcaaggggtttggcaagacttattgaaaagaaagtatctttataatcagtctattacccaagttgataggaaactaggtgattctcatttttggtcaggtcttatgaaagttaagaatactttcttaaacatgggttcctggattctgaataatggggaacaagtc

SEQ ID NO: 88633 - DNA, 714 bp, Oryza sativa
tgtgcccctgctcgcaacctgagtacaacgatgttctgtggtcctctaacatcttgtccaatttatgggcccccttttcactttcgcagtcctccttggcgtcctgcaacatctgaccaagatcatccgcaacgtcgttaccatcagcatccctttcctcctcgcccgtttgatttccttcaaatccaatgtactgagcaaagtctggaatattgtcgtcttccacttcattttattccatttcaacaccttgctctttgtgggatgtctaacaattatagcttggcatgaaccccgactcaaacaagtggaaatgaatagttctagatgcagaatacttcttctgattcttacacttattgcatggacaacaaataaaactcctttgcctgttagctttggccactctcaaaaaacagtgcataccgtcaataaactctttggaccgccggtcagcatacatccattgccgatccatctacatgagtcgaaaaaaaatcgtacacaaataattattcttataataatgacagtcatacaataattataagataattacaaactctttcaacagtcatacaataatgacatatctttattcatacaaaaatcataaaatattacaccaaataattcttatttactatttctaaagttttaaactaattttaatgtgttttacttcttttaattttcatttttgttttctattat

SEQ ID NO: 88634 - DNA, 3698 bp, Oryza sativa
aagaagttgagagtatcctagaggtgctcaaaaagaacatcgatatcttcgcctggagccctgacgaggtggggggtgtcctggcggatctcatcatgcatcacctagcagtcaagccggacattaagccaaaaaaacaaaagctgcgcaagatgtctgccgattgccaagaagcggcgaaagccgaagtacaaaaattgctcagggcgggggttatccaagagattgatcatctggagtggttggcgaatccagtgctggtgcgaaagtcaaacggcaaatggcgcatgtgtgtcgatttcacagacctgaataaagcatgtccgaaagacgacttccccttgccgcgaatcgaccaactctgggggcgaagaggggcgcgaagtatcgctcgaactcttagaaggagtaagggtcgaagcgctcgagcacatgcacaagtacgccacaagcacttcggcaacttacaacaaaaaagttcgacccacgcagctgatgcctggtcatcttgtcctaaggaagaaggcgaatccagtagtggttggtaagcttgaatcaaagtgggaaggaccatacctcatcaaacacaagtctaggacgggatcttttcgcctagcgacactcgaaggcgaggagttcgaccattcctggaacgccgcctctctcaagcgcttctatgcctagaatgggtgtcacccaaatcgccaacttgtaaaaatgtacatacagttatgtaagcccttcggcaccatgtaagccattcggcactatgtaagcctttcggcaaaaaaaaaaaactggatgtagggctattatccccatggaggcccaaaccagtataaattctctgtgccctccgccttctttttatttttcgtgtgattgataatttgtgaaaaaaccccaaggcaaacgcctgatcagcgaaaaaggccagggggagaaacgaatcggtcgaagcatcgctcgccgaacgttgaaaccgcaacagcttgtctcggaaaataactagccgaacgacgttacgattcgatcaacataaaagcaaaagtgtctctttcgacacagaatgctacaggtcgaaaacgaacgacaaaaagctgaaaagtcagtacacctatttcgctaatatgcgcataggggccggcatgttccgacctaacaaaagcacaaaatgtgacaatgcgaaaaatagcgaaaaggaaataaagcacgttctttattaacttcgaaaaaataatcgaagaatacaaggtctacaacacgatacaactcactttacaagtaaattacatcttcgcccccgtaatcattatccctccctaaggaatggacagatgaactaggttcgtcatcactactaatatcatacacaaccttaagaggagtagggggcgaaacgcagaccaaactgtaacgacgctgaaagatcatttcctgacgtttagttttctgatggtttcgccaaaagcgagccatatcctccaaacgtcttgaatgaataagatcgtaatcttctaaggttcgcccggggtgcgcccgcagccagtcggcaaccttgaaaaccttatagctgcgaccgtttatctccatttcgcgataaacagggagaaatggacatcgcacctttggtaggtccttcaatgccacaaatttctcgttttgacttcgccagctcccggaagggggccgaatgcacaactttcggtgaaccccctgatagacaacgcagaaaaagcaaaacacagcttacatagtaagaataggcggaaggagggggaggtatggcataatgcgagatgagcgaaataataatttgccaaagacctcgatcatcaaaaagcaattaagattgtgtcatatattccaaatgtacaaaaaagcctttttaaggttcggcggcagcctgccgaatgtacatcattcgccttctccaggcaaacgcaaaatcgggaggaaaactacaaaaatcaaaggaaagggcggagggcctcacacctctaggtgatcctgggcatcgcctccgaccccttcgcctaccgcgccctcttcttcgccccgatctgccgcctccgccttcgccagttgctccagaaagcgcgctttggcagcggaccggccatccttctgccagaactgttttcgccacgcgcgaagagcgggcgaaatgttctgcgcactaatctcccagtcccccttcgcataggtagggaactcggcgacgtgctcgcagccgaactgttgcaaaaggcctaaggtaaaggccgccgatacgcgtgcacagtaatcgccgtacgcggtggcacagtccgaaaccgatccgccagcctgctgggtccactcggagaagtcgaaggctgaggcatcctcggcagggaccccccgcaccttcgcgcccatgtcggtaagggcgaggcggagcgtttggcaagccgttctcgcggattcggtggtcttcgccatctcccgtgaaaaccgctaagactcctccgctgcgctcgcttcggccctgccagccttctggcgaagagcctccatcttcggctctgtaaggttgtagtaatcaatgagcaccgccgaatgggccttctccttctccagttcggccttgaggcgatcaacctcggcctaggcctctttccctttgtccaattcggactgaaggcgtttgatttcaattttcgcctccttgagggtgtgggccagggactccacctccaagttcttgcggcttatttcatcatccttggcccgaagacggctcttaaaatcgtcaaaacgggcccgcacggttcgctctatcgaacagtgagccgcaagaatctagatgaaagataggagcgggcgaaaagaacaaaaggttaattgcgaaacgtaaaaaaaagagggaagaggaaaacgaaggaagagaaggcatacccgaaccgccaaacttttaatggaggaacaccccttgttgaactcgttaagttcggtgaacaggctcggggtgccggcgggcaagataagattacttactccctccacaaagggaaaaaggttcgcccgggtctcgaagtcaccaggggcgaagtggggcgccgcgagggaatactctgaggcagatgcttcggcggccgcacacttccccttcgccttgaccagcggcgaaatagctggctcgcgcacagggctcccgaaaaccctcgccacagccgacacgatccgttcggcggaggcggaagccccggcggcggcgctacgcctgccccagcaacgctgagcggagcaaggggagcagtcgaaaaggtccaaactgcggccagcaggtgaagtcggagtctcgtcagaagactcgtcgttgctaaaaacgcgagcgatgtcgacgagtcccttcttttttgagatcttcttgaccagacctcctttcgccgccttgcccgacgagaacgcaactaaggccttcgccccttccaaatcctttcgtcgaaggggggagctgttcgactccaccccggtctcgttgtgacctggacttggggtaggagtgtagccgggggtgtcgacgtggtcttcgatcgcctcgttcacggccttatcagccacagcctccacctcctcttcttcctctccttcctcctcgccgtcacgttcttcggaatcatcctcatcatcggcatcagagtccgacgaagcaggaacccttcgcttcctggggg

SEQ ID NO: 88635 - DNA, 2469 bp, Oryza sativa
cactgagagcgaatgccaccgaagagagtcgtgaaggagaaggttgctaggcggaaggaaagcgacgccggaccgggcatggccgttgaggaaggagcagagccatcggcgcccatggccgaagatggaggaggacaagcaccatcacaaccgccttcggcccctgcaacctccgtgcaagtgacgaacgcggccgacgtggtgaaggcggctgcggcggcaagggcactccagactagggcggagatcctttcgacaagccaactggtggtgccccaagccgctccatcgcagccggtagcggccccaactgcgctcgccgttgtgcaggcccaagacagccctgaccccgaagcacaagccgaagccgacatggaagccatgcggcagaacatgacacggctccaagacatgcttcgccaaatgcaagaacaacaataagcatacgaggcggcaaggcggaccaaggccacgtcgactccaatccttcagtattcggcaggatatgtcccatctcaagtccatccgcaagtgacgacccagccctttccgccacaagccgcacaggcaccggtgtacttcgacgggcagcaatcggccgcagcagtgtattcggcccctcacgtgcaactgcaagctccagtcgctgcccaagtacaccatcaaccacctggtcaagcgccacaaacagtggcagaagcggcttcggctctgcaggcgcaactccaagctttccttcagcaactcaaccaaccccactgcatttcaagtacaaccccatcggcccacccggaggagaatacaagtcaaggtgcgcctaattggttgccaccgattcagccgggcctgggagcttcgccatggaatcaaggaccgcagttcgacttcatcaatgctgctcagagaccaaccgttcggcagcaagctccaggcttcggaacaaaccaagcaccaatccaagctgccacgacgtggtcgcagccaatttttgacccatccatggcggctcagcaagtacctccagttggagccaggcagtcgaatgccatggcacaacctcacgcacaagatgcgattttgcccttcgccacaccgtacccgcagcaaagtgcagtaaacagggcgggaggcgaaaaggggctaccgctgagcgggggaatcaagactcgtccaatcccaccgcagttcaagttcccacccgtcccacgctattcaggcgaaactgacctgaaggagttcctctccatctacgagttagcgatcgaagcggctcatggtgacgaaaataccaaagcgaaggtaatacatctcgctctagacggcatcgcccgttcttggtatttcaatttaccagccaatagcatttactcatgggagcaattgcgtgatgtttttgtccttaactttcgaggcacctatgaggagccgaagacgcagcaacacctcctcggcattcgccaaaggccgggggagtccataagggagtacatgcatcgcttctcacaagcctggtgccaagttcaagacataaccgaggcgtcggttataaacgccgcttcggccggtctgctcgagggcgaactcacaagaaaaatcgccaacaaggagccacagacgcttgagcatctacttcgcatcattgacgggttcgcaagaggcgaggaggattccaaacgacgacaagctatacaagctgagtacgacaaagcctctgtcgccgctgctcaagctcaagcacaagttcaagttgccaaaccacctcccctctctgttcgccagtctcagccggcgatccaaggacagccgccaaagcaaggccaggcccccataacttggagaaaaagttcagaacagaccatgcgggcaaagctgtgatggcggtcgaagaagtgcaagccctccgcaaggagttcgacgcccagcaagcgagcaaccatcagcagccagcccgcaagaaggtccgaaaagacctctactgcgcctttcacggacgctcttcgcacaccacggagcaatgtcgaaacattaggcaacgtggcaatgggcaagacccaaggccgcagcagggaacaactgtcgaagcaccccgcgaagtagttcaggagcaaacacccccagccgaacaacgccaagatgtacagcgaagtgtaatccaagtgattacaagggctgacccgccaagccagttgtccaaacggcagaagaagatgcatatccgtatggtccacagcatcacttcggcgggtgaaggggcgccgcagtatctgaaccagctaatttcttttgggccggaagacgcagaaggagttatgtttccgcatcaagatcccctggtaatctcagctgagatagctggtttcgaagtccgacaaatcctggtcgacggagggagttcggctgatgttatcttcgccgaagcatatgccaagatggggttgcctacccaagcccttaccccagcaccagcat

SEQ ID NO: 88636 - DNA, 4242 bp, Oryza sativa
ttcctgcagccctgaccaagatgtcgcgtcgtgtacgacggcgacggcgagctcacgtcgccgctcaccggctctctggctgctacaaggtctcaaggtctgagaagtacagtcgtcatatggcagcgttctggatgtaacatgcatacgcataattactccatcaattctaaaataaacaaagctaatacgaaatatgtcatatcccgtactttattttgggacggaggaaagacctaagttaagacggtccattaagctttacttcattgtactctgcctttctctcaatgttcttgcctcttaaatgaggccatttactactatagataccggtactataggtaccgaaaatgcacaaaaaaagcacctataaaccctttttcacctccgtagtctgaaaaacaaaaaaaccagcaccactaaacaactataggtgtcggtttttcaaaaactgactcccacagaaaccaagccgagcgggcagccggattttctcattagcgcggggggatccttatccatcccatctctctctcggcccctcatcctcacattccctctcctcccccctcgactaagatgatggtgggcggagccgcatccggcgatatggcggcctgggatccggcggcagcagtggtttccgtggtggatccgacgtcagcggcagccgttcccgtggtggatccgatgtcggctgcgtcggcggtgagcggggcagtattggcggccattctcacggtggagacggtgtccttatccacactcgtcaccatctcgaccaaagtctcctccctttccatccaaatcgaaatccaagtcctagccctttcaaattgaaatcccacgtaggcaccagggctggctgctctgcgcgtgccggttgccaaatccgacacccatgtggggttggcaaccggcacctaaagttggttatgtagtattgagtttagtcggttgctctattaataaattgattaatataatattgttcatagattgcatatatatactttatatatagttgatacgcataagtaattgttagaagctaaagctcaaaatacaagtatgctatctcattaccaactagcaattagcatcttaaatttcatacaagacacatcatcttatctccatatatatcatttttcataacattttaacatcatcatttgttcaatatttcacatatatacattcatcaattccacagcaaagcgcggggtatcacttagtatatctatatctctacctacttaaaaaattatgtaattattctagaattttttcgtccgtcctgctccatcagtgcacctcgtcccatcctacgcgcagtgtgcctctagccctgcccaggctaaaccctagcatcgctgccatatcgatctacctccatgtgcatttcctccaaatgattgtaaaaatcgattgcctactccttccttaaaatttaccctgcgatttccctttcaattcggttttaattcgtcatatttatttgatttcaacgatagccgacaatgcttccctcagccgtttttatcctgaattttgcgtattcgctttgattttgggaaaaaaagaagcaaagagtatatcgagtggataaaaaccctcaatcaattttgaaagatcgagaaagattcaaccggatttgggggaagatcggctacaacatcatacgggcatgggacaggactgtcttccggaggttgaagatgctagtaggctgtgctagttgggctttcggaggttgaagacgctagtaggctgtgctagctgggcatatgactccatttatgggctgggccaaagaaagccagatcacgcgaagggaggtagcgggttgggctggggctaaaaaaggaaggaaaaaaaagggattttggctcaaaaccaagcattgttattattattatttttgactaactaccaagcattgttattaactttttcaattataaagcgatactaatgtttcaatttattactcacctcctaatagttgttgcaccactggaaaattacctgttgcaatgcatatgtatttttagtggtatatataaatatataataattcgagcacattgtcccgtaggattaaggctgaaacacaaacaatctgtcccaatataacaatcgatccatgtgctaactccagccgtccaccaaaattgaacctacatatctgttctcctcttctatctagtggttgttgaaatttccctaaaacgggaattttaatttacacaactgttaatatatcggataacgcatataaggatggtaagaatggatcatttgttctcataaaataacttggacttgtatagttgtataatttcttctacatgcatattacaattaagtcagcgtagcagtacaaactagagtaaattgcgtttagggctaccttttattaccaaagtttcactttggactgaaactttggaccaccctttaacacatttttttactttgggctaggttactttacctttcattcactttgaaccaccccatataaactttttaggaatgcataaatgacttttcctactttaaagacatcagcaacccgtaacccggtaatctttttcaacttacacaggcaattgtttacaacattatagagtagatgcagctaaagaaaataacttggggtggtccaaaatgcaccaaagataatattacctaatccaaagtaaaaatatgagctggaggatagcccaaagtgaaactttgataacaacaagtggaccaaagtgcaattaactctataaaccataaagcctgcaactgccagtagcaaagtgatgtttctgcagtgaggtttggcattttccccagaattttgtactacaataaaaaaattgaaaaagaaatcatggaaaacacttaggctcggtcgcccgacacagaagaaaattcggtcgttctgacactggcatgcatgcaagattacatatagttaggccttgtttagattttaactttttttttctttgaattttcaactttttcgtccatcaaacttttctacatatacaaacttccacattttccattcacatcgttccaatttcttcaaacttctaattttggcgtgaaactaaacaaccttagttccttatctttctctccttctcactttaaatattttttctcctacattacttatggtctgatcacaccgatatattcattgtaatcacatgattatattctgatgacagaaaaacatatgtatcaaaccgtcaaaatgcaatgtttcatatgtgatagcgacatgcttcaatgtgtttcacaaagttcaaggaagtacatgtcactactccctctcctctctctctcttcacaacatccatgcatgcattttagcaatatttaaaatgatttttttcctaaactacttatccaatctacgatccactcacacttttgtatttgttttaactgaatctttatcgtacgactatattttgatgaaaaaaacatatgtttcattctgttaacacttgttttttatacgtggtagtgacacgtttcaatgtgtatattttctgtgtttcacaaaatttttaaatgttttagttgctgagtttttttattatatataacttaatattttatttgttgattaactgaaatatgaccatccaatttttttaagggatcggacgatccgtagattccacaaaaatcatgcgtgatccttacgtagtcctgagacaaccctcggagtttcattatttttggacttgtgtagtgacctatagaaattccaaaatgatcctgtctagaaatagtcgagctggaccccttcttaccaccaggaagtataacgaaacacatcaaactgggcctgtttgtgcgacacacgaataacaaatatcaagcccaagaagaacggagcggggatccaatggtttatagttgaattaacgtacgaaaccatactcggtgtgctggcccatggtgaggatgctgctgccgaaggcggtgaactgcggcaaatcgctgactgtcggacgctgcagccggaggagcggcggctcaggcagccgcgggagggtctccggccaagccatgtcgtcgccggcggccaccttcgatgtccagcttgtggatgctgtacgcgtttcttccggtcatcgatcgccaggtacaggtgcttcttcgccacggtctcgccggcggcgccgttgtggcgtccgaggcgtacctgatcgtggg

SEQ ID NO: 88637 - DNA, 512 bp, Oryza sativa
aactatggcaatagcagccttcattgccaagtcttgatcagttataatagtagcaggagccttgccacccatacaatcaaggaacgtattgaacaaccactgaaaagtctcacttgtttcatcttgtaggaatgcataaccaaataggcaattgtcaccataactagttatccctacaaatggagcaaagggcaaatcatacctatttgtcttgtacgttgtgtcaaaactaactatgtcaccaaacatctaataaaattttctgttgttcccatcggaccaaaacaaactcttcacaacattgttctcatcagttctgaatctgaaatgaaacaatggatcctctgatcttttcttctcaaaaaaatccaaacactgcatcatgtcatttttcccactttctcttctaacaaaatctctataattactcacaaccttttttgtgtaaggaactgcagacaagccacccctaacatatgacaaaacagacataatcattcttgtgggcacat

SEQ ID NO: 88638 - DNA, 678 bp, Oryza sativa
tcaaggcacctagctatacaataagcatgccctgggattggcttactcactctctaacactcatagataacctaagtgccaagggtgtagagctcttgcagggttcaagataatgcaatggagtgccaaaaccttacccttactactggggagtgggtatatatacccccaaccaccaaaactagccgttggagtcgaaatactcaactctgtgctccgccggtcagaccgccatagagtggccggtcagaccggactactatgtaacggctagttacagggcaatcattgagcccactcaacctggccggtctgaccgcagtgtagcggccggtcagaccgtccacggctcggtcagaccgtcatcggctcggtctgaccggttgcagctctggcggctctgtatcgccaccaaaaaacagaccagtgcaacagaccagtggggccggtcagaccggccttaccaggtcggtcagaccggctaacagctccggtcagaccgacctaaggcccacggtcagaccgcaggtcactttcaagcacaaccaaccgttagtaaacggacgatatctcttgactcgagtctcggaatttgacgttcttggactctatggaaagcttattcaaagggctatccaacccatgaaaaagcaccctgacaggccctgtcctttctgg

SEQ ID NO: 88639 - DNA, 603 bp, Oryza sativa
  unsure (1)..(603): unsure at all n locations
gttttgnatttgaatgcgcatgagtannnnnnnnnnnnnnnnnnnnnnnnnnnnnnnnnntgaagttgggtacaattcatgcgtcagaactcattcgctctttactgaaaagctcgcgcccatcaagactggcacaggcaattatggaagtagggcgtgtaaacaaaacgctatatctcctcaattatattgatgatgaaaattatcgtcggcggatcctgacgcagcttaatcgaagagaaagccgccacgctgtggctcgtgcgatttgttacggacaacgcggagagatcagaaagcgttatcgtgaagggcaggaagatcaactgggggcgctgggcctggttactaatgcagtggttctgtggaacacgctctatatggaggaagcgttgagctggatgcgccgtaatggcgaagaaattatagatgaagatatcgctcggctatctcccctgatgcacgggcatatcaatatgttgggccattatacattcacgttgccagaggatattttaaaaggggaactgagagctctaaatttaaatataaacaacgaattatcttcttaacgtacgttttcgttccattggccctcaaacc

SEQ ID NO: 88640 - DNA, 705 bp, Oryza sativa
gactcccattctcgcgactgctgcgctagcgcgtcctggatgccatgatccagctcttccttggcacgccggagttgcctgacgcattccttgagggcgccgtcgaggtgaacgattctgtcttccagtgttgagttcttggcagttgcagcgttcagctgggtcttcagtgatgctatctctttctcggccttctcccatcctagtaggagaattgcaggtttttgttatgaagatctggcttgtcagttgtcagttctatttatgcatgtgtagaaataacactgtttctaggatcagattaaaaaaagaactctttctaggggattaagcttttgcttcaaatcattagtacattattcgtgaaaaaaatattagtacataaaacttaaggattaggttgagaggaccttagaataagaatgttctttttctaagtcagggaattgataaaactacaaatgagcttttggaccacatgatcagtacaaaaaattaaaagcaagagacaaggaacatatctgcatatgatatgcagtatatccaggtccaaacagagtcatttcttaaattttttggcccagcgaaaaacaataatttgtttgaatttttgcttcatgtactgaacctgtacgattcagtcatgtttaacatcatacttagaacagcttcctccgcaacttatgaatgctgcggggtgcagga

SEQ ID NO: 88641 - DNA, 677 bp, Oryza sativa
ctctcctcctggattttcagttccaagatgctaacttgcttcggcagagatgcaatttcctctcgtgccgactccaactcatgctctgtacccttcttcttctcttccagagcttcgattccatggcacctcactgcgagccgggttgaaaacgccttctcctcctccagcttcttctctagaagagtgatcttatcaccgagatttttggcttcagattgtgatgcttccaggtgaccacgcagctctctcctctctgcctctagtgcatccatctgctgatacttagcagccagctccagcgtcagcgccttttcggactcgagacgttcctccagaatgcggcccttgtcgagcaagctcgtgatctcgccatgggcgagctcaattctcccctccagttcattcctcctgttctccatggcttccatttcggtttccatggaatgtttcactcccttgacaaggttcagttgcctctgcaattcgaccgatttctcctctgccaccatcgcccgatgccgggtgttcctgagctctcgctgagcttcgtgcagcgccttctccctgtccgccttctccattgccagcctcttgatcttctcctcgagcttcaccagctggacgctagcggcgtcctcggcctcgctcttggatgggctattcgccgacgcgat

SEQ ID NO: 88642 - DNA, 683 bp, Oryza sativa
  unsure (1)..(683): unsure at all n locations
cccgtgnaactgtagatcctctnnnnnnnnnnnnnnnnnnnnnnnnnnnnnnnnnnnnnnnnnnnnnnnnnnnnnnnnnntagcatttgacgcagatgtatgtaaaactttgcattagattgctgatagtacaaagagaataatttcttgccaagtgtcgactgactccaaagtgctggcgaaaagaagattgattgagctaccaccgtcaatgagaactcgcgctaccttgaagttccgaatagtaggttcgaccacgatcggatattgtcctgggataacggcggtcttggggtggtcttcttccgagaactctatcttctgctcagaccacttcatcttgggtgcagccccttgccatgtcgagcagacttcacgttccactttcttatattctcgctttgaggagtacgttgtggaaccgccgaagatgtgtgagacgtggaggtcggagtctggatacgctgagtccggttcgtgaggagccgtctcttcgttcatctcgacaacgcgtactcgcttgcctttttcaaatgccatgtgcttctcgagcgactttttgaaaacaaggcaatctttcagagaatgtctatccggcttgtgtatgaggcaccatgatttctttgtgtcgctgctttgggggtctagacgtttgggaaggttcgcgtattctgctgcgagga

SEQ ID NO: 88643 - DNA, 9497 bp, Oryza sativa
cagaagaagttcatgtcctttgccactgaggttgagaaggatgctgacaacataagtgactgtgagaggttgtacaaggcctttttacaggaaattaatgcttttgtgttgcctcttcttaagagcaaggccgtggttgatgcaaaccttagggagaaggagagcttcaacgagctgcaagacgagattcagcgacaaatcttgcaagctcagactgatattgaggaactcaaaaagaaactggaacagagcagaattgagaggctgtacaaagaggagtgcgaagcgatcagaaaaatgatttctttgcagcctccacgatcggaaacagagaagctcatcgcgggtcttgagaaggagattgctaatttggaggccgagaatacagcatgtataaggactctggaactaaggaagaagcagctttctcttcttcttcatgtggtgagtttattcgtcaggttccttttgcttttctgaatcatgccttttccctttctatatagagtggtaagaggatactcattggaatttattaatctgcatggtaagcttaaatgatatactacttttacaaacattgtttcccgcaagaccgcaacacaaaactacgtttaggaaaaatatgactgtttctgatttttatcaaattataactattagcatccatttgtctaagaaggaacttggaagactatatgtagctattttaatcatgccatgcagttcattgttttggctgatgcctattgatttctgatgttgtatctattacaggtcgaggaattgcagatctcaatcgaagatgagcagaggagcatagcggatgagctgagagctggcgctgaagagcagcagaacatgagcacagatgaaggtagcggcgatgcttcagatgccatggctttagactgatcctagcagaaaagcgcgatgcctgcctagttccacaaaggcagatacgttttcttgtggctatatagcacttaattgccttggttagacttgtaggttgcttaattacaccctgacacatgatgactctcgtgtagttttttttttagagagaaggccagagtctctcgtgtagtttcagttgtaatttcagtcctaagttgtaatcgtgtgccctttgtctgaaggaacagaacatcatggtgtgacatatactcctccagattattccaacatgtatggttgttattatttgctaaacaagcccctaactgaatgctaatcgacgcactgtcgacgtggaaaccaaattctagtccgagtccagctctgcccttgttgcggctaataaaagggctgaagttacggccggtgagcgatcgatcaggtaattttaatttacctttggttgttggctgcgttaggtttttaacccaaggagcaagaagctaggtacatagagacgatgaagtacgtggtggtgatgggaggcgtgatcagcggcctcggcaagggggtgacggcgagcagcattggcgtcgtcctcaaggcgtgcggcctccgcgttacgtccattaagatcggtacgtactggagtactcctagcaaccaacgtgctgctaattcctccttttctctttttcctatatatgtttgtgtatgttttagtttactactgtactaacctccatccctaaattaataactgtaattctaacgtataccttttttgtctcaaaatataacagaggtagtatgtttatttgaatcctagaagtgcatgcacttgttaggtcaagtttgacacattatacaacgaattgttacataggattataaaattgattgtagggataaattaaatattccttaaaataaatttaacaaatagcttagagtaagtagactaattaatgcaggtgaagaatcttttcagaaaacgtatttttagagaagtagctgaaaagaacaaggccttaagtccgacctaaagtcacctcttttctttgtagatttaccgattgctgtttccttctgcttatcgatctgttttagaggattttctagaaaaagaacacttcatatcagcgaggcgtattgccttgtagaataatcatgccaacttttatttaatcaggcgtttgatggattgaggtaagacgtacttgttgtaactgtatcgctcaaatgtgcagatccttactttaacgctgatgctggaactatatctcctcatgaacacggcgaagtgtttgtattagatgatggtggtgaggtattggataaattgatgttcacgtcgatgcatccataataggagtcatttttgttcaattgatgtatatattatcttgcacttgttgcaggtggacttggatcttggaaactatgagaggtttctcgacattaaactaactcgagaccatagcataaccgccggaaagatccatcatgtatgtataaacttttgaataatagagtgaacacatcatttcattcactcccaaacattgatttactgcctagaacccacatgcatgtctaagctatggccaataaattgttggccacatttacacttaaaaaataacgccttaggcagagtttgaaaaataaatggatgttatttttttttagaaaatgggtaaaacccaacctctacatccaaacagatgtacatagccaaatgttatgtatgttagattatgatatactcccactatttaactaaacaaaaatcaatattgtaatatgtaagtacttagaataacataatgaaagctatgagctttcgcaaacaaatgaataaataaataaataagtctcattttttaagcaatatgctagctcttgatttgtttacttaaagccatgttcttgtggtggttgacgacagtatgtttacgaaaaagagagaaggggagactacttgggtcagactgttcaggtgccaaccacttctcctcaattcttcttaatttgtttttcaatttttggtaaatttaatatctacatttcttgaaaatccaaccaatcatcatttttttaaggttatcccacatattacaaatgagatacaagattggattgagcgtatcgcgatggttcccgttgatggtgaggtggatcctgccgatgtctatataatagagctcggtggcactataggtaacaagagacaattaaccagctgcattttattcttaacaaattcttagagttacataaatttttggacttacaagtcaatttaaaagctatatatcatgtctttattttcagtttattaacagtatttgttcgacactatgctgcaggcgatattgaatccacgcaatttattgaagcctttagtcaattctcctatcgtgttggtaaataaattgaattattgcataacagatattttaattttctccatggtgatatgataaccttatttgcatgttatttttggacaggtgctggtaatttatgtgtggtgcacgttggtcttgttccagttttgaacgttgtgggtgagcaggtcagaaaaatcatgtctattaattaaccacagctttgctatttgctaattgtcgtcttcgtcttgaaaataatatcctacatcttttggtttatgttcttgtgtagaaaactaagcccactcaaaacagtatacgtaagtagagaatatggtctcacgccaaatattatagcttgccgctgtaccaaggtttgtattatgaacccagtaaccttcatcttgcggttcatttttagttttggaagttgtggtagtcttttatttattaactaagagcgtgtttatttattaataggaactggagaaaaatgtgaaagaaaaactctctctcttctgccatgtgccggtaatgaaattttcttggcttttagttaatgattattttcagcaactaattgctctagttgctaatgaactcttgtggtcatcgcaggtagctaacatttttactctgtatgatgtttcaaacatctggcgtgttcctctgttattgcgggtaaacagctttcttatacaccagacgaaaattttcacccttgcactgtgctgaatatcttcctccatcgttttaggaccaaaaggcagatcaagctattcttaaagttttgaatcttgaaaggtaaaatttccatgtgtcatatatatatgtaagttgaaggtgtcatgctgctatacgcaatcctaaattctcctttatctcatttgcagcgttgccgaagagcctaacttggaggaatggatggcaagggctgatctatatgacactttacatgaaacagtcagcctctttttcatccttttttaaataacggatttttcataaatccggtctttatatttacgaaagatatacacatccaatattttttatcctcgtgatggaaacgaaagggatatttgagattacattaaaaaaggaaaaatatatacgttctattgtttttcttactaacactgatgtgtcatggtgtgagtacatctagatttatctaaatcaaactattgagatcattgttagtaaaagttcagtaagaaaaatttagaaagacctaagcaatctgtgtactcttttttcaggtcaggattgccatggttggaaaatataccggtgtatctgatacatacctttctgtgatgaaggtgggatgcatggatccctatggtgttttcttccttcagtccattacaaacctcatcggttttgtccaacatattttttgatttgcaattcttgtaggctcttctacatgcttgtatagcttgtggcagaaaacttcttgttgattgggttccttccaccgatcttgaggattcaactgccagtgtggtttgaaaaacttacactatgcatcatattttgctctgtagtatatatatttgtctccttacatgttttttgttaaattttaataggcacctgatgcttacagcacagcatggagtttactgagggtgagaagtttactcctgaaatatttgctacatgtagaatttttattatatatgctttatctgaaatatatttcatttcagggtgcagatggcattttagtacctggtggctttggagaaagaggtgttgaggggaaaatattggctgccaagcacgcacgcgaaaacgatgtccctttcctgggcatatgccttggcatgcagctcgccgtggtagaattcgcatgccatgttttgaaactgcctgatgcgaacagcacagagtttgatgccaaaacggagaacccatgtgtaattataatgccagaggtaattaactgtcaaaccctcagtctatatatatagatatgattgtaacatttatatccactcgtgaatataaatatcagatttctatttattgtgtaaaaacgtgtatttgcctttagttttttttttagaaaaatgtgttgcatttaggtgtatgtactggttagctataaacttaatttaggccattagttacttgtttccttaaataagtaacttaatttacttgcatttccttcagtgctccaacgaaggaaagggtggtaccatgcggcgtggatcaaagaggacatttttcaaggttgcaaatagcaagtctgccaagctgtgagtgatcatgaacacttacccttactgtaattgcattgtttctgttttaattttctgtgttaattacgttgcaatcactcagatatggtagcgtcaaccacatagatgagaggtttcggcacagataccaggtttgttgttcaatatctttagtgtagttcatcataatgttactcatggtgttttaattgcttttttaccttttttttaaaaaaagaactgtgatattgactaacttcccaggtaaatcccaatgtggtgcaattatttgagaacaatgggcttcaggttgtaggcacagacaagaccggagaaattgtgcaggtacaagctgaagaacccagcttgcttgaacaaatttcaacttttcacttttccattattcatgcatgctgatgttattgtttgtccaattttctagatcgtcgaaatacccaatcatcgatttttcgttggcgttcaatttcaccccgagtttatgtcgagaccttcgaaaccttccgcactttttgtcggtaagctacttaaacctctgtaaacgacccaagggaagttgatatatatctttcttttgaaaaaaaaaaaagttagcgatgtaatatcaacataccgctttctcgagtaccgtcaaaatttctctttgacaatctgatcaacatgtataccgacctgcaggactaatcgctgcatcgtgtgggcaactggatggtgtgctgcaagatgcggcttgtaaccatgagccacagcagaatcagcgtgcagagaagcgtcctgctgctagtgatctaggagattgaacctgccgcagcaagcggcaagtgacggcgtgctctgattcaaatgaccctgatgaagcaccggatgtcaaaagctgttaattgtagttgccgtttcttgatatcattgttagtaagaattttgtaaaaagaaaaaaaataagtatgtgtagcagtgttcttataatggaaatgggggagaataatcctctcttttttaaaaaaaaaggaaaaaaaaagtaaaggtgtgcaacacatgaatacatgatgcattgcatcgtcaccagtagttcttcatgtcgagatacggactaggggtttttttgtccgaccttttctccgctcttcacaaaaaatctggtttttttgggaggtccgtggatgtttagaaaaaaaaaagtaagctcttctaggttaatcagcatatctactggaattcaagctaatgcaaccatcggattcttcaataaatatgtgtgctaaataggaactgttttacatttgctagcatcggaaggctacatgttactgctataattgacaataacgatcgcaacagactttgcagacaaaatgaagtcgctgtgataaccttatggtcctcactaatcctttgttcagtattttcaccgttatctggtcaggctcaataaagtcatccagaagttcagtttcatcagcaccgccactgttactagatcagaagttaatttttatagttgaaaccagtgcatcccttaataagatactcttactgtgtatttagtcatgaagacaatgaggaacaagcaatttgtttaattgtttgttgaaatcatcagtttgtcagattgagacacatactacaagttattcattggccgtcaagtgctttaattggaagtaaatttcaaactctttgggagatttctttggaactggatcggctgaaggacctgtggaggcgataccgaggcactgaggcagtgctggcccttggcgtagccctcccaatccatggcggcctccccctggcccctgggtaggttttaggcgcctggtggtggtggatcggtgccggtgggggatttgccgggtcggcgaaagaatgccgaccaaatttcattaagattgagagtaaaatacatgtattccgatattaaactgtcgagtcaaggcaaaagccttgaaacaaagtgagaaaaagaaaaggggaaaactatgccggtggggggattcagcgagttgaatgcggacaaggcggtttaataaccggaatcagggtacggttatgtatgggttatcccgatcaatcgtattcgtgtccaattccaaatggacaatgcgtgcctacttaaattaagtaaggcgcgtttaataaccaattaagacaaggggatatactacaggacatacagatcaatcatggcggcagtcttctgcggggacatgatcccggtaaagttgtggtgggagatcctgctcagggcaccaaccaaagacgtcgcccggtcaagctgcgtgtcaacgcagtggcgcggcatcgtcagcgacccctcctttcggaagctccaccatgacaggcatgccgtgcccaacctcaacgacggcatctccgacactttgctcgtcgccacgtctgacgtcgacggtgaaagcgtctccagcgtcttcccggctgcactggtctctccggcggtgacgggccaggcgcccatctgccgggtcaacaacccatacggctacagcctcaccaacgtctgcaatggattcctctgcttcgcctcctggagcagagccaaggtcatcgtgtgcaaccccgtcaccggcgagaagctggcgctccccagggctcctcaccttggactcgagaagcgtcgacgttactcgcggccggtcacgttcgccttggggttcagcccgaccaccggtgcgtacaagctgttccgctttgccgaccgcaggatggacgtgtacacgcttgccgctgctggcggttggcgccaacacccgtttcctcacccgtaccgcgtggtacaaaatacgccaactattgttgtaggtggtaagatatgcatgctgacagccaacccggcgtcgcatcagcacccaaacgatgttggcaaacccggtccggtgatggttgtcgatgtcgcaagcgaggagtaccgcacgtacaacccagcggactatgggtgcctgtgggccgacatggcagtgagcggctttgagctgcacggacggctatgcctggccatcaggtctgatacggaaatccatttctggaaaatgcctgttgaagaaatatccatgcgtgcttggctcgatggtgatacccacacgttgtgctacggagtggacaataagttgtactccaggtatgtcggcacaaccatgacgatgacaacatcgctggcggcacggtgtctttctccgaccgaggttatgtcatgggactgcaaaatccgtctccctacgactccaccgtggttagtgtcgtgcaactggaacatctacacgggataccgccccagcctgctctcgcctctcacctttgcgtcccagcaagataacaacgacgatgatgaagatgaaggcgacgagtcccgtccattcgtccgcagattgttgtgtgcactacgacaccagaaatcgcagaaacgccgcatgtctccaacatcaaccgatcataccaacggcaagagagtttgctatagaaatccatgcatatgctaatgtaaatatgtaattccccgatcctcgttgacaatattcacatagaaattgtattttaagcagtacaaacaatacataaacttatttatgtggtggattcaatcaatcctttccggcccaaaaaatatggcccacgtagaccacatccccttttaggcggcccatcgagctagcggccagaccgtacttgtaccgtctatttgaatttttttcatttttaaatttttttcttttaatatttacagaaataatctatggcgcaaaaaattacaaaaataaacagtagagggcggcaagctgacgtggcagacggcggctgccgccatctgcaaaaattacatttagccccttgccgccctctgtaagggttgcaaggggctaaatgcaattttcgtagcgctaaagagcatttggctggtacttttgcatctggg

SEQ ID NO: 88644 - DNA, 510 bp, Oryza sativa
agaacgctcgactcaagaaggaggtccctaggctttagggacgtccaccgccaggaggagcccgcatccgcaccacgccaaggaagtcgaccacagctccagtgcgcatccagcttgcgcctaggaacccgccgcagcctccacctctagcaccgcctgcagctccggcgccagctccagttctagctccagctccatctaccgcagcatcttcagcccccgtgctagagttcggcttcactttcgtgccagcttcggcctacaggggtctagcaggtggcagtggaggatggctgccagcttctcccagtggtggtcgtgtggtcatcagcagttccagcttggagtcaggcaccggcagcacctatcagcctgagtactccaggagccgctcagaggggccaggcgacgagcaggaggacgccttcgactccaccgaccgcaggagccgttccgagcattagtcccattatcccttagcttatcgactgcttagtagttgtctgttag

SEQ ID NO: 88645 - DNA, 657 bp, Oryza sativa
aaaacttaagattttgtttagcacctcccttgaacatggtaaatttaaaattttccataacctctggcaaacaaaatttatagtgagtaacatgttcctctgttacaaacttacaataatacaatccacactatgtttcttctggcaaaatcgcaagtataaagtataaacacgttacacgtctgctgcaagtctgcaacacatatacacatgtaaaaggtgcagcatttgtgcagtactgaagcttccacaacagtttccaggacaaagttctgcatcactttgtaaaatcaagtagtactaacgcgattaattaagtattagctaattttttttccagttaggaacccctcctcccatgcacgcaaaacgatgcttgcattaacgcgtgattaattaagtattagctatttttttctaaaaatggatcaatttgattttttaagcaactttcgtatagaaatgttttacaaaaaaacgcaccgtttagcagtttaaaaagcgtgcacgtggaaaacgaggaagaagtgttgggaaaattgggtgccgaacacattgcagttgagcatggtggccgtgtttagattcaaacttttttcttcaaactttcaacttttccgtcacatcaaatgtttggacacatgcatgaagcattaa

SEQ ID NO: 88646 - DNA, 724 bp, Oryza sativa
ccaggtgcccgccgatggcttgttcctgtccggattctcgctgctcatcaacgagtcgagcctgaccggggagagcgagcccgtcgccgtcaatgccgagaacccgttcctcctgtcggggaccaaggtgcaggatggttcttgcaagatgctcgtcacgacggtcgggatgaggacgcagtggggtaagctgatggccacgctgagcgagggcggcgacgatgagacgccgttgcaggtgaagctcaacggcgtcgccaccatcatcggcaagatcggcctcatcttcgcagtcgtcacgttcgccgtgctcaccgagggcctcttccggcgcaagatcatggacgcctcgtacctgagctggaccggagacgacgcgatggagctgctcgagttcttcgccatcgccgtcaccatcgtcgtcgtggccgtccccgaaggcctcccgctcgccgtgacgctcagcctcgcgttcgccatgaagaagatgatgaacgacaaggcgctcgtccggcacctcgccgcctgcgagaccatgggctcggcgaccaccatctgcagcgacaagaccggcacgctcacgaccaaccacatgaccgtcgtcaaggcctgcatctgcggcaagatcaaagacgtggagagcgcctcggacaccaagagcttgttctccgagctgccggagtccgccatgacgctgctctcgcagtccatcttcaacaacacc

SEQ ID NO: 88647 - DNA, 1001 bp, Oryza sativa
aggcctgtcccagatgtttctccacataatgttgctgatgaagttccctttccttccaacaggagttctcttcatcagttcatcgtttggaggttcagttgccaatgccagtgctcctagtgtgtccatgatcatgttaacccagagcagttggacagcagtaagaggagcactccctgaatgccaagcagaagtacaaagaacagtcaagagtaagttatgaaacaaactaggaaattcttgattttccacattaataaattttatgttagtttatttttttaagttttagcacatctcttctgccactcatttgaaatctaacgaaaaatttctgctgcactaacactaaacagtatttgaacttagaaacagtaggcagcagactaggaacagtggtgaaggagaagtataaaagatgaacatgtatcagcagtgcagttattacaagaaaccaacatcaaaggttattttaatcggaacgaaactatcaattctatacagtagaatgaggtaaaaaacatcaacatttagctgtacctgtcaagcaagctgaggagaagttcactatcagagcgaccacattgactgtcagctgaaactgcacaaacttctgaatattaatgtacactgaccgaccccatttagcaacagtgactatagtggagaagttgtcgtcaagaataatcacgtcagcactttcttttgccacctgcaaacagatagcacagtgagaaagtttgggagtgaaaaagtgcatagaactatgagggcatgaaatggatggtagtacaactcaagacaactaaattagcggctaaattgccacaaaaatacacttctaaaaaaatcgaagtgatgcaattcattaattatattgttcatgcaaggggaacactatcaactatctttgaggaaaatcacctcagttccagcaatgcccattgcaagtccaatatcagcttcatgagagcaggagcatcatttgtgccatcaccagt

SEQ ID NO: 88648 - DNA, 662 bp, Oryza sativa
ccatcttacatgtttactgacaaggagcatcgtggaccatttgagtactcggaggatcttacgaatttggctgtcggggcagaaacgacggaaaacaccatctcagcccaaagatatcaagaaagtgataatgatcttttgctaagtacttcggataaagaggacaatgcaacagctaccagcaatggttcttctgcctctacctacaatgctccttcagacttgagtggtccttcattgcttagttcacaaataccgtctgaaacttcactaataaatcctggtgcacctacatattcgtcacagtccaacttcagtcttgatgaccttcttgggcttggtgttccacaatcctctgcacctccaccagctccagcattgaccctcaactcaaaacctgtgctggatcctggtactttccagaagaaatggggccagctggccttatccttgtctcaggtatgttgcttctgagttctttcccatgcattttgtgattatttgtacagcaacatgctcatgtagcctttttgtagttgctcactcaaatttgaactattttagcatgaaattatggggtgctgctattgtctaaatctaaatactaagtgtcttcccatgaaagtcactctgatgaggtgtttgaaatcagcagttatatg

SEQ ID NO: 88649 - DNA, 1574 bp, Oryza sativa
atttaatttaatagacaaccaacctatgctccataatagatcttgcgtagaatgaatcaattttacgagttatagcttcaatttttgacttgctaggtctttgaagattatattatgatttccccttttagaaatgattcaaattaagatatattttcgtatcaccaccaaccacctaaatctacaatagttcctcagtacttttgcaaaattaacgctgatcttgccccataacatgcaatccaacagatatctagctagctagctaacttattagaccctaattaatactatatatcaaaataacaactatttctagcaaaacctggtgctaatctaacatgaaatagctagctattcccatagtccaccatgatcctacctatctagcaagctagttagctagtttgattgttggtgctctgaaaaagcccaaactaattaataattaggcctgattgagcttgtcaccgcagaaatatcaactgatcttctgaatccatatcatctctctgtttctagctaatccacctgaccttatttttgatattttgtaccatgcatctacacaggaacaagcccaagaagaaagctgagaagaggcagcggcagcctcgcgtggcgttcctcaccaagagcgaggttgatcacctcgaggacggctaccggtggcgcaagtacggccagaaggcagtcaagaacagcccatacccgaggtacacatctatatacatgtacaaaccttaatttcacccagttgttgtagcacatacatatatcgtagtataccatgttactgtgccatacaattgcatggcacgatggtgttcaagtactccaatttcaaaatgcaattcaattcgaattcgaatattgcaggagctactaccggtgcacgacgcccaagtgcggtgtgaagaagcgggtggagcggtcgtaccaggacccctccacggtgatcaccacgtacgaagggcagcacacgcaccacagcccggcgagcctccgcggcggcggcggcggcgtcggcatcgtcggagggcaccaccaccaccacctcttcatgcccggcgtgcatggcctgccgccgtcgcacctcatgccggcggggttccaccctgagctgatgggcctcatgcaccaccacccggccatggccgccgccgccgcaaaccctagcatgtacttcccgggcgtagctgcttctgctccgccgcctcctgctgtggctggcggcggtgcaatgccgcccaacgatcatcctcctcttcagcagcatcacttcactgactacgccctgctgcaagacttttcccttccacaatgcccagcagcaacccatgatgatgactgatctaactgattctgcacaaatatatactactcaatatttaactagcacccggaatttatcaagatgcttttcaaacattggagtcgttgcgccaaaaatgtgatggctagggagtgcttgatgatcagcttggtcttggtgagaatatataattgttattaattaattgattttctgcaagcttttcatcttgaacgtaacttgtgtgtgttgtgcactt

SEQ ID NO: 88650 - DNA, 654 bp, Oryza sativa
agaagaacattactactacctcaggagagtgctcttcctcccaattttcaacgagactctcaagaatgtatggagcatcatgcatgtcttgtgaatattctcctaacatccatataagagctgctttgccttttggctcctgaatatttttgctactgatgtttccaacaactgctatacaatcatggctccattgaggatatttcctcaaaagatctttcaccaagacctacatttaagtttttactcaggaacaaagacacccagagttgaatgtacttcatccttagtgaatgatgaacagttaaaatactatcaaaaaaacttacaagagtttcagccgtcacatattccttgtccatttcaaggaattgcagaagcctgtcaacaatagcattcacatcatactgctgcagcgctattttcccaactgctcgaatagactcacgtgcgattggtacatcaacatttccagcatattcacacaactcagttactggaacgaaagaaggccacaaaattttataaacataatgaaaatcatggagttaaaaatatatcacatatgttgtgagatatgccgatgtataatcaatggaaacagatatctgctgtaccaatttcataggtgttgctctcgtttgctatagcagt

SEQ ID NO: 88651 - DNA, 2385 bp, Oryza sativa
tatgttctagtgataaatcataaatggcaaaattgagatgtctttaaacattaaatataactaaaaaactgcaatataattcttggtaaatactatctctgaagtaccctatctagtttggctagtgaacactatgtaaacctattatgttgtattatactgttgaaggcattgtgagaaaacaagaacccaagggtacaagcaaaatgctgttgaatctagaataattgcacaaactgcagtgtttagtgtgtgtgaatatgtatattcaggtcaggatttccttcttgaccatgtgtactttgttttttcctccttaatgaaataacatgcagctctcctgtgttgttccaaaaacaaattgcagtgtttagtatttctcctatatgttcatgtgagaaaatccatagccaatcgtgcatttggagtggaaaggcggagtatttgttagatataaaacagcatacgctgagacgactgacactactctcacaaggtacaatcatttgagacttaaagtgtgtgaccaatttcttaagttgtacacatctgaataatattaagagttgtgtaactttattcaaaaggtgtatagaagaatagcatcttatacaggcagtcaggaacaatactgaatgtagggctgcaatcttgtaaaatgtggccatgtatgggtttttcacatcctatataatgtttctttcagtttgggatatggattcgtataatatcaaatacaaattacatgcagatagatttaatatgaatatggtcatgaatacatgtggatattatgcatgaacattccagaaatgttaagcacataatagaaatatacatcaatagtattgtaggaatttatgttggcaaatactgaaacaattgttccaaaatttataaatcatacgcatgtaaaatgtagcagacaaacagaatatcaaaagtacacttcaaaggtgtggcggcatggtgaggcagggactctcaaggtggcaacagcatgcaacaatgaaaaatggacaagagcggtagaaaatggggatagcgagttagaaacagaaccaataaaggcagccaaggtatctatcctctcagtaccatttttacctgtgttcagactcttattcttgcaaggttatatttgagtaccatggtatctattttcccagaaccacattcatatgttgagccctgcttgcttcagctaattcgctggcttataaaccaaaaattctaagccttaagtaacagacagctttaccacagggacttttaaaagccaaaaatcatgatagaactaataaccagaagaaaattatgactctacccttcaacttgtggctgaaatcttaaaagcctaagccaaaacaagaatgttttgagcaaaaatatatgaattcacctaatagcctccaaatccttcccagaaatcaaacccacatagatgcatgatcagattggttcagagttgatttcttccattatgtaaccttaaaagaatagggtgtatctaggttcagtagttttgtcttgactagcattgtggtttcacttcaaggcttcaagctacttcagcaatgttaagtcactatactttccatcacaaaatatgtcggtccaagtaattaccaacaacctatatgatcaatcagatcaaaatcaaactattatcaatgaagattaatatcactagcatgcagcttcattaggcatttccctccacctgttctattagacaaactgcaaagtagaaaacgattggccggctgcatgctgaaccaaatttcaagttacagctcacattggcatgcaagaagtattaaatccttactgattgtctaccagttccaactttaaatcagcactacagatgtcatagacttttcggtggtaattaaacggtattgtgagcactataatctacagataatgaatcattgcaacaggtagcagcatcatagttgcatgataatcacaacattgtttgtggaatggcaactcacctgtgcatcaggatcagagagcataagcgctttgagcgccgcaggcaagtcagcatcaaggcaggcggtggcagatatgtgatacagcttcgcagcaccaacagcagcgatcatccggacgtaagcactggggtccttgagcccagtggcgagcggcgagacaaggtactcgacgaggttgggaacgcggagggagcagaggctgcggagtgccaggccgcgtatggtggggtcctggtcgtggcagtcgcgctggaggaagttgatggtgaggagcgcgaggtccgggtggttgcgcgcgtggacgccgacgtagaggtagcacatcttcttcagcacgacgtcggaggtggcggagcagagcaccatctccccgaacgcc

SEQ ID NO: 88652 - DNA, 1016 bp, Oryza sativa
aatgtggcttctctattgatatccttgagtgtttgaattatgatgtcacccctgatcataggatcttcgactttagctggaaacatctttgtacaagcttcaacatcacgctccacaagttgattgttcaaatagcagaactccaataatctccatccgaaactgacagttctccttgacagcatccttataccaagaactatgtcactcagtataatgtcagatgcagtctctccattgctttgggaactggacataacttgaaacccatgaagcaaagatggcaacaatgagtcatacaatcttggaagagtgttcagtagttcctcaactccatagctgcaaattaagtggtagataagcatcattgcctattaagggaacagcgaacaaatattgtgttggatgagtagaagcgcacctcgtctcaaaagaggtacaaaataataaagcagcaggttgataagcatcgacaaaggcatccagagtgacaattgcatcgtttacaaaatccaacacctgaaggaagttggatttacaacaatatagaaaaatcagatgaaaggacagcagacatatcataaactatgcagtataggtaaaacttgcctctgagaaatctttctgaagttgggtatatccactatcattcggtccagatgaagtgagcgcctaaaatgaatttattatggttaagttctttttatgcatagttctccaagatcttctgtaaactactaaactgtcatcagatcaggaaggtgtgaaactacaagatcaagtttatatcaatatcataggtcctcaacttttaatcgtggtgagaaaacatacttcaatctcaatttaggataaaaaagaaacagagacaaattaatagtaaacatcataatcgtcactttctatctaacctaccaagcaatgtatcatggttgttgaaaggaactgggaagaaagtatttgaaacaataacagatataacaagtaataacaagtatattcgtcaatagcacaaa

SEQ ID NO: 88653 - DNA, 648 bp, Oryza sativa
tagaatcacaatggcacctcaagctcttctcttccagaacctcaagtttttcatttgcgtcgtgcagtttctggttcacggtgttgagctcatcctcaagctcaagaactctctggtgcaatgtgtaggcaatgccatcatcctcaccatcttcagactttgcatcagattctgactgtgaagccaaatcctcaggctccttccttgaggccggtgagggtgagccattgctcttgttggacaggaagacgtcgaaaccggcggcccttgggctctgctcccttgtccaggacttctgtggttcaggagatggtgagggtgacctctgcagctcagagtctgaacctgccaaggatccctgatactgcagccttgtagggatgttcttgcgcaattcaccagtgacattgtcgtatcgctcagctagagcacggtacatccggtagaaattttctgcatgggttatgagcaatgatcgcttctggtaggacatatgagcgttgttcgcgaaggtctagccatcttcttcaattaggtgcagcatttcattagcttggttgtccatttgtgcaataagtaaaaaggttcagggagagttagataaggctacagtatatatgaacaatagtaacaacgtacagcatagca

SEQ ID NO: 88654 - DNA, 1345 bp, Oryza sativa
gggctggggcggccgctggacgcggccaagaacgcggcggcgaggtaccgggaggccgtggggctgcaggtggaggcgttctggaggcgcaactacatgctgctcgtcggcgccggggcggtcgtcgtctgcatcgcgctgtggagggtcatgttcggcatcgccagcaccttcgtcgggctctccgagggcatggccaagtacggcttcctcgccctcgccaccgccatggtggcgttcgccgtgagtgcgctcctccctttctcgctttagctgctatgaactataacaagctatgatagaatgcgcatgcggtgattggtgaatatattctacatcattgtggtatgaatgtttttgtaccttatgactgtctaatgcttaattgtatgcaccgcttctcgaattctggaacttcatcttgatgtttatatcaagcaatacattttttgctgatcatatgaaccgccagcatacctcaatgtagcacttaccatgctaaatatgtcgacactttattatcctgaaatatgccactttgtctgaactaccacccgccttgagcttaaacctcgggttaccaacttaccattagtctattagttttattataaacttaactttggttcacctgagaaccagattcactatttatgatcatagttttgattgaagaattgttacgcggaaatgctttaatcatacaggaaacacaagtacaacctaaaaccttgaaagatgatactctaataaaaaaaatcaaatgatttctagttgatcatgcaccaaagtactaggtaggtgtgctttcaatattacccttgtcttaatgttcttttccgatccgtgtaacatgaacaatattgacttgtggtagactggtatattattttatctaccgaggtgtagcaacaatatggattgcagagaagtatgaagtgaactgtagagatcttgctaacttggaaattatcagaagtctagtttatggtgaacattagagctttatgccactttccatgatcaactttctgtagaggaaacaatgactaactttttttgtttgcctttaagttgtcttatcattttaaatgctcataacacggtgctaccgtcaatctaatatttttagtgcaactttgcttgacagatgcctaagttttgggaggagcaactgatttgtattgtctatttttgttatagggcatgtacacacgctcaagattcaccataaatcctgataaggtttatagaatagcaatgacaaagctcaacacatctgctgcaatccttgaagtcatgggtgcacccttagccggtactgatgtcagagcatatgtcatgt

SEQ ID NO: 88655 - DNA, 665 bp, Oryza sativa
atatctttgtcatgatgtttatgattgatttagttatcatcactgaccttgtacatttcctttgttcaattggttgcttgaatctgttacatttatagttttgaagatacctgaacaatgaagccacctttggagaggaaccctaccaagaagcgccactcgtggtggtgggacagtcacattagccctaagaactctaaatggcttgcagaaaatcttgaaggtgagctgaaacttttacagggaaaataatgagattgcattgtcttagtactcctactgttatgcgttttttttgtggagatactactcatatcaatgcatgtccaggtacagtaccatttaccaatgtttactgcactgagatgaacataaatgagcaataaaccagtggaagtacatcatcaatttacttatttacttaagtcaaatgctcttgacgcactcatggtatctgatggtactgtagcattaactgattgtacatcaaactaatgagcaggatggggtagttgagtaaatggattcatgaatataactagagatgtagtagacattcttgattgttcattgttcgtatattcgtgcttccatagacaagtaacagaaatgatgcacatattttctttattataaattgtcagtgaagtaaaagtaatactgct

SEQ ID NO: 88656 - DNA, 673 bp, Oryza sativa
tcatgcgagtttcttcatagttttcttaatcaactgttcgtgattgatggctgtgtttaatgacatcaatacccatactcattaattttcttatgtggggaagagtgctggcgtattggagccccatgtgctaaagaaagttagccccgaggaggacaggagtaatttcggcacggttaccatggcagacattgatcgaaccatgaagaaatattctgataacctattgcatgcactggaaggtgtaagttcaaggctttcgcagctggagggtagtacacaccatcttgaaaattctgttgacgatttgaagatatcaatcggcaactataatggcagcactgatggaaaactaaggcagctcgagaacatgctgagggaggtatgcttctctctccctttctctctgacaatgtttatacaaagcaactgaggccatattgaaataagtgtattttatgtaaaggggaaacatcatatcttctcctgttgcacatataatagtacctttctatttattagcttctaccccccatatattatgaatgatatagctaaaaacgatcaaagatcttggtattcattaaatctgtgactcatcaaaccctcgtggtggcatagatgagtagtctacctggataacttttgcctatctgacttatttgtatatgcc

SEQ ID NO: 88657 - DNA, 1166 bp, Oryza sativa
tgaggatgatggcattgcctacacattgcaccagagagttcttgagcttgaggatgagctcaacaccgtgaaccagaaactgcacgacgcaaatgaaaaacttgaggttctggaagagaagagcttgaggtgccattgtgattctaaagaaaatggaaacggtgctgatcaaagtgcaataaatgagaagctacagtcttcacaagaggagattaacaatatcaaaaacagccttgaagttttgtcggaagagcactctaggctgttgggacagaacaagaaactggaggctgaaattgtcaatctgaaggaagaaattgcttcagatagacagcaatatgaagagaagctctctcgtagtgatgctgaaattgacaagtgcaggcaagaacttgctgatgcttctgagaagttgctgcaagagaagttgagcaacagttcggtgacagctgagctgcaagaaacgattgaaagcatcaggatcaaacttgaagaagtttctgaggagaaattacttgttgagaacaagtttaagcagctggaggaagcaaactctgaagctgaaaagtacaaccaagaactgtcacatgctaccgagaagctttcagaggagaagttcagacacgaggctgagattcttgcattgaatcaggccattgaaaatctgaaatccaaactggagagcattgctaaagagaaatcgttgcttaaatcatggtttgctgacctagagcaagtcgtggagcgaggaatgagaattttccccgaatagccggaattccgtcagaaaaaatcatagcttgcatttagcgaattagaacttttttttcttcttctaatacaccatgatacacacttgagaagtcctaccatgcatcagcattgtacttttcctgtctgattcttttccttgctgaggcgatgcatggtggtgatgtgctgattgcctgcgagtcttttgcgcggaacgtatttccctcggcaataaaatggttctaaatccatgtaacttgtatatgagcaagcaaaagcgatcatggttgctagaatagtgctttagcacagaccaaagtacaaggatacagtcttatactaatatgctttatccagtgacatgtcagattataatccgctcaagccaataccctgttctgtttagctcatca

SEQ ID NO: 88658 - DNA, 2221 bp, Oryza sativa
gccttcaattccattcgaacgaaacgaggagaagagagaggagagaggagagagaggggtttgtgtggctgcgagtgggccccatgtcgacgtcggcggcggcgtcggcggcggcggagcagcagcaggaggagggggagcacgggccgttccccatcgagcagctgcaggtactggctcgtcgtaaccctagcggagttcttgtgctgtgtcttctcttcttccgccccaaatggggggttttccaagggcgggtgtttcttggggattctgatccgcgtagtggtggggtggggggaggggggaatcgtgatgggttcttggagatttggtgtgtggtttaggttcttgcggtgttgtgggagattcttggtggaagaaccctaggttcttggaatcttggttcggtttcttgcccctggatggcgtcaaggtcgcgtctttcttggaattatcgccatttgtatgtgaaattgggacgggtttttcctggtatttttgttgtgtttgggcggattaggtgtttccgtggattcttgccggggaaagtgaaaccctatgttcctgattcgccccttctcccaaatgtgtcaagattcaagaacgagcatttcttggaatttccttttgtgtttgcggcttacgaaagaggggatattctcccagttctgtattgaagctggctatttagtttcttttttttttgcccttttttaggtataggaaacataatctttattaggggcatctaggtattcatggttcgttcttccccaaaatggattaaggttaggcttttctgaaatctgtgcagtttattgtggcgcggtcatgattcgtataagtccaaagagggggattcttgattaggcttttggggaggcgtttcttgggagttcataacttgccttttctccctgtatttggcagtaagacgatttttaattcactgtttagggcatgtgaagccagcatttaaaatgctaattctctcaatttgccatcatattttaaccgtaggctgtcctgtggattcttgtgttttcacttttggaacttgtttgcaaatcggtctggtggtaggctgtagcagcttgtattaattaatttattaattcctgaaagcctattatacgtatgatgtttcaggttgttcctttatgaataacatgtaaaaaaaagaggaaatcgttgtttgatcatagtactgttaatatggtaaataagttaagaatggatgcactcctattccttagtgatatactattttctttgcaatacaagtgacctgctgtacaaataatatctcatgatatttctcctcatcaatgatgcctagtagaattaaccattcttaatggtagttgcaattgcaagaataagaagtgccattatttcttgtattgttgtatgttcagtacttcagtgccatctaaaaagcttctgaggtgtagctagtgacaagctagtgtctgtttctatgtaaaaattatcatagtgatcgctcttctatcattaactcttgtgtgtaatttgtggttaaggcatctggaattgctgctctggatgtgaaaaagctcaaggattctggtctgtacacagtggagtctgtggcctatactccaaggaaagaccttttgcaaatcaaaggaattagtgaagccaaagttgacaagatagttgaagcaggcaagtaattatgaggctcagtacgactttgtatttcacactgcaaagttcctaactgtctaaaattttacagcatcgaagctagtcccattgggatttacaagtgcgagccaacttcatgcacaaaggctggagattattcaagttacaactggatctagagagcttgataagattttggatggtattgaactgttaactttcatggttttctttaatttcttcagaaatgtactgcttgtgatcattgagcaattctattttgaccaaacaggggggatagaaactggctctatcacagagatttatggtgaattccgatcagggaagactcagctgtgccacacgctgtgtgtcacatgtcaggtgacagcttattgatccaactcttatttcattgcgcacctgaatcctgttggtaagctaaattatgttaatgattgatattgcagcttccattggaccaaggtggtggtgaagggaaggctttgtacattgatgcagagggaacattcagaccacaaaggctgct

SEQ ID NO: 88659 - DNA, 650 bp, Oryza sativa
gaggagtgggaacttcttctaacgaacgcagccaacttgtgcaaacatatgtggcaaggaggaatggtcatcttcttgagatctaaaggattccacgaagacaggataattcgcttatcatcaggattattcttgatcttgtcaatcacatccattagctgatcgaagacttgaacagtatagtcagcatgcatgctagttatctgttacatacagaaatagttagtcattaatcctgagagatccagatggagagcacatcaataagtacatagggaggagagaaaaacttactcagcaccaaagtatcaccattgaaatccataaactggacctaaatcaccttcctccctatgtgctaaatcaacactagaatgcagtaaaaattttgccaaatggatcagagcacaagaatcaagaacaccaatatccattctttctttctcaaatagtgtggaaccaagataaatacctgtcaagatactctctcgaagcatttttccatcccaaatatgaatgcctttttcttgtaaaacctaaaatgatgtatcatcgttcgtaccaaagtgataatctaccatggaagctcatgtgaagaaattaaagtataataatattcacttctgcctcgtgtgctagctgcaattaat

SEQ ID NO: 88660 - DNA, 661 bp, Oryza sativa
aggagctcgtctgataactgcaaatgaatgtcaaagaacatcagagagcataatattaaagaaaatacattggagtctgcaggagatagtttcagctttcaaccaagtaataaccaaactgtaagcatttatcaaattgttggtaaatagggagagtgggcaggagatagtttcagctttcaaccaattaataaccaaactgtaagcagttatcagacgtaggggggcactcactgctcaccttctctgtaaagtgatggaaatagcccatcaggagatatcacaacagggccatcaggaagagcttttccatcctgaaatccataatcacatgttcatatgagatgaaatagatgggaatctagagtagtttaagattatctttatgtgtggctttccaaacacatacaaccaattctgctagttcattggacataaaagcttacaaagacgagaccaatcctatggttctatgcactagggcatatacatatcaataatggaaggcataaggatagaactaaactaaacctgcttaaggttgaaaagaaactgccttgtcaggtgagcttgtgaaatagcacgcgcactcaagaaaagcaactgatatccattttcctgcagaaatggaaggcaacaagaacaagctcaagtcaataac

SEQ ID NO: 88661 - DNA, 4206 bp, Oryza sativa
actatatcagcaactcttaagagtttacaattaacacacctacaaccaccaaaagtcaggagcatttctcattaaattttcctagaagtggattattagtatatgcatggggtaattcaatatgaaacaaagattcaggagaaccagataaaaagaaaaccatcagtatttacctgaagctcctgtaatttattaacacgatttgacacaaaactcccatagccttttgaagaaatttctcctgactcaaaatgtcctataatatccacaaggtgcggccttatactctttggaataatctcatcaaaaagatatgccctttctgatgtatctgctgcaggatcataaggtggaatgttccgtacagttggttcttgactttcattagcacccacactggtatcagcattcccaaggtcaaggtccataaaagcagaaggatcattcctttgttcatttaatgactgccacttaatatcctgcaaggaatatatagcatgaatcaaactcatgactgtatccaaacaagcaagcacaatcatgtcatggtctgctgcttcgttatgcacttaagatgggtgtaaagtgaagaaattgaggtgatgtatccgttaagcaactcttgatgaaaaaagtatgggtatgtaatgtagaaaatgcaacagtataagcatccacggtccaaaaaaaaaacagattttagttttaaaccacctgtgtacagatccataaaatcattccttttattacatgaaaaaaagggggaaacaaaatttctctagatggttagatgtgcaaaactaatctaccagaagtcgtatatcatctgaatttctgggcctgcaaaatcttctgatctgtaaatgtgcccagaccctttatcctataaacatattatctttaaaaagtataacaaacctaatcaacttttgagtttaaactgcaccgtgcatgcaactttatacaccacgttatcaaatataggaaacagaaagatagtaaacccggggcataaacataccttggccttgtctttctgggttccaaacgccttggtaatatcctgtaccttcaagtcagcatctcctgctgatgatactgcctcccctactgccccagagtgctgcgaatgcgccagtttctgcacttcaaggtgcggatctagcctaagaatctgttagcaaatacaaatatccagagcaaaattacatatcctcatgccgtatgaacaacataggttcttcactttgaaatgcaaataattaattaatcacaatggtaaaccaacaaatctatatttccttagcaagtgctcaaacttcataaactatcttaatatatatcattatgccacatcattggaattggtaacaccaaggaaagagctagcagcttcacagctacagtgctcaagtccattgttcaattgccactcaattgcgccgctgtatgtaatgtcacaagtagaacaacaatttctactcaacactaacacatttcttgcccattggagccagcatgtcatcaaaacaaaaactgcttaaaacactatactgtgacaggacctatcacccatttcgttccaattagtgacaacagttatcagatggatcaaagcttgggtggaaatggaatggtgctcaccttgttggcggcgatggggacgaccttgagggtgccggaggccttgtcgaggacaccgagcgcgtagccagtgagctgcggcagcacggcctcgccggcgtagctccgcccgacgaagtccggccctccgccgccaccagtggcggcgccgaccacgagctcgatgcgggatgggtgcttcgtgtggcggaacagcctcgtgcggggggcctctctacccttcctgccgccgccggcggccagggggtcgtagccggtcgggaagtaggcgacgacgggggctgcgcccgcggcggcggcgccggtgagggaggcgtccacggtgacatggacgacttcccgcttcttctcggggacattggtgtcttcctgcttcttggagtgcttcttctccttcttcttgggggaggcagcggccatggtggcatcgatggcttcccgcttcttcttggagtgcttctccttcttcttgggggagggggaggcggcggcggcgagggagtcgtcgacggtggcattgctgtcctccggcttcttggagtgcttcttcttcctcttggggaggaggcggcgggctggtggtccgccattggagacggctctagggcttttcgaggtcgccaattgtctagggttcttgaggttcttgtagcggagggaaaggggattggatatatgcatccaagtcctcctatagttttgtatttacattttggattattttccacgttttctgcacatttttttttgttctttcctaattcctactaccaattgttgtattagtagcaaagtttaggtccatcttatcagatgatgaattgtattccctctattttttaagattaacaaatcgttttaagtccatcttatcagatgatgaattgtagtccctccatttgcgcaaaaaaaaaaaagattaacaagtcgttttgattttggttaaaatcaatctacttactcttagtttaaccaagtttatagaaaaaaagtagtacttcaataaaactaatttggtgctgtagatattataatatatttgtctacaaacttaatcaaatttagagtagcttaactttgactaaagtcaaaacgacttataatctgatataggttgtatttcacactattgtcaggatatccacaaaacttggtgcttggtttatttacctcccaaaaagatctaaatagaaaaggtagagaattagtaaaaacctatcgaattttggagtttcgcggtaaattactcgaatttactaattgagcatagatacacacatcttcttcatgtacagtacttgtagtgttaccagagaatagggaaaattataacgaggcacatttgcaaatgcattattaaactgctaacttgtacaaattatacaatgtaaacacaactacatagttaaaaaaaaagagaactgaaatcttatgagaagtgacgtgagttgcagggcaacatcctacacagatttcccctccattcagtcactcaagtcagtatattacacatattcagttgcaggcttgcagctcatgttggacaacaacagattgactaattgagtaacaaggaactaattaacactgcttctgccgactcattggtcatacaggttgtaagtttttctattatgatcctatgtacagtgtcagcctcgcaagaatttatgtcaggagcatccacatgacaccaaccagcgattggtctgcataaacaagtttgtgtcaaacacacatgacgacataaaactcatgcaagaaagtgaaagaactactggacagcagatatagatgaaaagtacctcagggtgcttttgttcaacatggaagccatttctcatggccgctgctgcgtgccagagaccttgtacagcatagcgtgcactgcggctatacctcaaatatcaacagcaggtaacggcattttccagtaattccaagtattgtagtcctcctgaagtaaggaagaatttccatcaggtcaaggagcattgacaatatggtaaacatacttcgattggcagaacaatactctgtttacaggagtgctgatatatgtgcattatagaacatgacaaacctgctcagatgacgttgatatcggagggaacatcccattgacaagagcatggagggatgtgtatgattttgtatctactcgacgattcaccgcaacttcaccctgcacaaaatttacacacattttctaaatgccatctccaatatgttcactggctgggcctgatccaattatgcagatagagaaactttgttggatgtaggaagggaccatctgtctaagtgatctgttaccttgggatttataataaaaattttgcccataggaatcccaaccttgaggtaactaagctcatctgtatctctatttccaaatccagcatagaatggatttgagtcaggaggaaatagtgctttgatagcctgtgtgaaacaggtgaatcaagacttggtacgaattatttcatgagcgcaatgaagagcaagcaattattcaatgtatgttcatatatttatctttgtgttgctgagtactgaccc

SEQ ID NO: 88662 - DNA, 698 bp, Oryza sativa
ggtcaccgccagtgggttggtggcaggtggaccgaaggcggatgttcgtaatgtgggcgtcttgctcggatgctccactagttctgtatttctccatcactatctggacggatgttgtcaaggtgggcatcttgcttggatgttttgacacataatcccacaattcactcttgtcgatgccacagtgtgagaagagtgcccagatgatggtgataaactccatgttggacctgagatgcttggcatggacttgtgcatcggagctaggtgaaagatgcacaagcaagcgagcccacaccttggctaggatctcccactgcttctttttgtcttcatcgtggagcttcttggctagccttgcaccttctcgcaatatctggctaccctcctcttctgtgcctggaagatacgcctcctccaactgggatggtattgtcgcgatgagcttgtcatagatgctcttgagtgaggtacaaccatggagcatctgacgagcacactgaattgtttgttggaagtccttcttgataacccaaatgctcccgggcagcaggtcaggctttgcgaccagcaggtacgcacagtaccgcgacaaccaattcgctaccatgtaggtctcccataggtcaccatccagcaacttatccacaaggtatcctctgtaaggattgcgcctacggcgatagcatgacaaggca

SEQ ID NO: 88663 - DNA, 2681 bp, Oryza sativa
  unsure (1)..(2681): unsure at all n locations
cccacgatataaggaattttcagtgtttgtcttgtaacgtttgaccactcgttttattcaaaatttttttgcaaatataaaaaacgaaaagttgtgtttaaaatactgtagataataaagtaagtcacaaataaaataattaataattttaaaaaattttgaataagacgaatggtcaaacgttataagcaaaaaaatcaaaatcccttatattatgggacggagggagtaagaaaaaaaaagattttaaaaatatatgcaaaagaaagctgcagatatcttcgggcccaagaaagcccaattaagcagcttagctcagctctatcgcattccaggcctgttaacatcctatcgcgttctttgcgtccacaattgctcaaattttcagcccaagaaaaccagaaaaattcccaacaagttttcaagcgatcaaaactaattcaccgacattcaacgtgaagaattataaactttcaactgcaagtttccaacgtggaaattatctggagtatccactggactccggccctgtctagttatgaaactaatcaaatttctccagattaaaattttcagcaaatttgccgtgtacatatatatatatatatatatatatatatatatatatatatattatatatatatatatatatatatatatatatatatatatatatatatatacagtgttaaccgcgtaatcancgcgggtcnaccatgttagttgaattaattatctattgatcattactgcatttcagagattatgttgatgtcgaaaacaacaaatttaatttcgtcgcaaagagttattaagtaattatgtatgattttatagggttgggttcttgacgccggtggcgaacctgattggcacggtgagagggcccaagtatgacggctcgttcttgcacgacaagatcaagagccttacccacgatgtgaccattgccgacacagtcaccaacatcgtcgtgccagcatttgatgtcaagtatctgcaacccatcatcttctccacctacgaggccaagaacgagcccctcaagaacgcccacctctccgacatctgcatcagcacgtnagcggcgcccacttacttcctcgcgcacttcttcaagaccaccagcccctccggcgagtctcgagagttccaccttattgatcgcggtgtcgctgcaaacaacccgataccgagcatatatcatttagtatgagaaatttaattcttttaagaggtatcaaaatttacatcagaaggtatgatacctcctaatatcttcttaatcaccataaaatcactcgtttagtatatataccttcaatctcaaaaggcaacatatcaattgtgcacattgttggtaccatcttgaacacaactttgaccatttgttgagtgctcgtgcgtgcagacaatggtagccatgtctatgatcagcaaggaggtgttgcgcgagaaccaggacttcaaattgggtaagccagcagattacaggcactacttggtgatctcgatcgggacgggaacggcgacgatggcggagaagtacaccgcaccggcatgcgcgaaatggggtgtactccggtggctctacgacagcggcttcaccccactcatcgacatcttcagccatgcaagtgcagacatggtcgacatccatgcctccgttctcttccagtctctctcctgcgagaagagctacctccgcatttaggtgactaccatggtttgaaattttggtttgaaatttcggcccccactggcaagcacaaatttccatgaaatttttggattatttttcaaatatttgtgcatttggtaaaaaattttcgaaattcaatcaaaatatgttcaaaattcaaataattttggtaaaaaaaacccggaaatcatgagattttcaaattttcggcaaccacggtggcaaccaaaattgcaaaccctagtgactactccctccctatgtttcatgttataagttgctttgattttttttctaatcaaatttctttagatttgatcaagtttatagaaaaatataataatattttcaatacaaaatagatatattatcataatatattcagcgtaatatttaataaaactaattttgtgttgtaaatgttgctaattgttcctataaatttggttaaatctatagaagtttgactacgaaaaaaatcaaaaacaacttataaaatataacacggaggaagtattagctattaagttgcatatgcacccaactattatcggtctacttgtatcattacattaatatacttctaacaccagtaaaaattaacctagctactaaccgaccaactagttcacccaaaagcttctatgttttcaccttctcgtagtcgtgacactaaaattgagtgttcgtgtatataggacgattcgctggtggggcacacgtcgtcggtggatatcgcgacggaggagaacatggaggcactgatcgggatcggcaaggaccttctgaagaagccagtggcgagggtgaacatagacactggagtacacgagcccgtcgatggcgagggcaccaacgaggaggcactcgctcgcttcgctaagaagctctcagaggagagaaggctacgcagaaacagcctcagttcctcttgagctgagctaaagctaagttagctagctagctcagttctagcta

SEQ ID NO: 88664 - DNA, 800 bp, Oryza sativa
aacagagccttagtgtagtgtctctattttgctttattaaagtctgagaataattgactttctgcaggacattttttacttgataatataatataatgcatactcattgcaatgttaatgttttgagtcttttgctctctctctctctctctagtctctgaattacagcaaaatgatatacaagtattttcttgtggatgcaacaaacatagtttcttgcttacaacaattctctccttccagttttatgtcgagtgtggggagctatcatgccagatgtatcaactctctgttgatatgggacttggtggtgttcttttctcctgaaaatgaagataaatatgaagattaagttttttacgtaaaatgaagtggtattaatatatgattgattgagttttaattattacaaacttaaaaatagattaatatggtattttagagcaactttcatatataaagtttttgcaccaaacacaccgtttagtagttttgaaagcgtgccacgaaaatcttaatcttcatccaacttttgttggagaaaagaagaggactttgaaggtgttccattcaacattgcatcacattctcttccgacgtacggagtacatgattgttcatgtttgcggcatgttaccttgtacactgttatgtgactctgtataatcccaaaggtctaaccttgttgagttatattgctcagacataactcaagctggttggttatgatcctcaccagatagaaatgaaaatggcaatatagtggtattcctctagcattcacactcgtttcgtgtttc

SEQ ID NO: 88665 - DNA, 656 bp, Oryza sativa
  unsure (1)..(656): unsure at all n locations
cgtctcccatcacctcctcgacccgccgcctcagctccgccgcgcgcagcacgccgtcgccgccgtccacctccgcgcgcacgccgacgcgcagtcgcgctcgacgagccgcgcgttcatctgctggtccgacatccgcgggacgcccaccatgggcacgcccgacgcgatgctctccagcaccgagttncaccgcagtgcgtgacgaagcaccccaccgccgcgtgcgacagcacgcgcacctggtcgcaccactccaccaccacgccgttcctgcgcgccgccgccgccgccgtcgcgtcgcccgtctccgccacggcggccttgttgtccttccgcaccacgcagaggtacggcctcccgctctcctcgaggccatggagcagctcgtcgacctgccccttcgccatgacggttaagctcccgaacgcgacgtacaccaccgagccggccggcttggtgtcgagccactccatgtacttggcgtcgttctgcttgaacagcgcggcgtcgtcgccggacgggagcaccgggccgatggggagcacgtcgtacgccccaacggcggcgagcgtgtccgcctcgagttcttggaacacgttgacgagcacggtggccttgggtgtctccctgtcgagggcgtcgaacaggtcgcg

SEQ ID NO: 88666 - DNA, 617 bp, Oryza sativa
ttgatctgaactactacaccaaagttcaggactacactgaaatcagtttcattggaggtgatgttgatgaacatcctgcgagtgagtgtaaacctgacatcaggaggacaacagctcaagcaaatgactgcagggtgacaaccaaatgggttggctttgatcggatattgaagtcaaacaaccagaaatccgacagcattaaccttgatcatctacctccatactcctttgaaactcaagccgtttgggtacagattcctgtgtcagtaaggacgactatggagcagatggaatatcagctctgtggtggtgtacacgctgcttctcatgcgcttctaagtataatacctctgcacatgatgtgcagtggttctgatctaggaacacaatgtgcagagcctcaagaaaattctgaaactgcagacagaattctgatgtacgacaaacatcccggtggcatcggcttagcatcacaggccaagctgctctttggtgagcttctggttgctgctttagagcttgtttcatcatgcagctgcaccaactctgatgggtgtccaaattgcatccaatcatttgcatgcagtgattacaatagggatttggacaaggggagc

SEQ ID NO: 88667 - DNA, 1360 bp, Oryza sativa
agcacgatgccgaggcagtacacgtcggacctcgccgacagggcggcgcgctgggcagcggcgccggcgccggcggcggcggcggaggcggcctcgggcgaccggaacgcgaacatggcgtgcggcgcctgcgacgtgttgacgagcgggaagaagccgtagtccacgatgcggggctccaggtgggcgtcgagcaggatgttgccggacttgaggttgccgtgcggcggcggcggcggcggcgcgtcgaagtcggcgccagtcatgctcaccagcctcatcgccgggatgcccagcttctcgtggaggtacgacaagccgcgcaccacgccgacggcgatcctcatcctcgccggccaatccagcaccaccctctccgggctctggtcacctgaaccaaacaaacacatcgtaattagcaaactataatcgagattagttgattgagaactacaccctgcgtttttagattataaatcgttttgactttggtaaggtcaaactactttaaatttaactaatttttataaataaatataataatatttataacatcaaattagttcaattaaatctatagttgaatatattttcataataaatttatcatcagttaaaaatattagtcatctctccgttttaggttataagatgttttgactttggtcaaagtcaaactgtttcaaatttgactaagtttatagataaatataataatatttataacactaaactagttttatcaaatcaataattgaatatatttacataataaatttttcttgggttgaaaatttaaacttaaagtagtttgactttaatcaaatcaaaatgttttataacatcaaataaaggaagtattgttttttataaacctagttaaatttagagtagtttgattttgatcaaagtcaaaacgacttgtaacctgaaaaaggaaggagtagtaattgctgtgattagtggggggtgaattggtgattattaatcacattctattattaccgtggaggacgtagaggaggctgccacgtggcatgaactcggagacgatgagcttttcttccttgcggtaatggtagccgacgggggagaggacgttggggtggcggagctcgccgagcatccggatgtgctcctcgaactcggcgcggccgacgcggttcatgtcgcgcatccgcttcaccgccaccgtcacgccgttgcgcatggcggccttgtacgccgaccccagcgtgccgttcccgagcacctcggcgctcgccttcatcagctccggcagcccgaactcgccggcggcgttgctcatcaggacgaactccgccacctgtttccgtgcgccgccgacgccgccgacgcc

SEQ ID NO: 88668 - DNA, 10087 bp, Oryza sativa
atgggtcagtgtaggaggcggagggcaaaacggaatatgtgttaggtggaggcggccggtggtggcgcccgccaccggagacggggaaaacggccgccatcggcttgagggaggaagaggacagggaggggaagggggaaggggagggggccggccggggggacctcaccggcgccgttgactctcttctgccagccggcgaggcgggcggcgtcttgttggggcggtggcgagattggcacgcgaggcgagcggcggcggcggaatgcgcgaggagaggaatgggaggaaaaagttagggttaaggatgtgcacgaatcttaaagcatatctaacggtccaaaatttgaaagattggaggtgagatttccagtccacagatatatacagtccctaaaaattaagatgtatttagatatgacatatcattcaataaatatgcaagttaaattttaacttttacatgtcacaactgagaataaaacgcccgtacgtttacatggacgtgagggtgttcgaggcaatgctccgttacatctacaaagattcgttgtcggagatgaacgataatgaagtggcagccatggcacagcgaacaggtatgacccagagaggctgaagcagatctgggaggacacgctgtgcagccacgtcaacgccagcacagcatcactgtgatggcctcatggaggcttgcttggaattccttgagagctgtcctgttgatctggatttgatgtgagatggctgccaatcttgctgtttgatctggatttgggagcagcatatatgagttcatttttatttttcaagcatttcagatgtgtgcatttgctaatccctgaacagacataacttgtacatagcatggttagtagtcttgtataaggctgacaaggcatgccatgctcagttgctcactagtcactcgcaagtgaaacttagtaaaaaaaagaagttgtggcattcatctgtatatcaactcctttcagcttgatgtcaaaaaaacactcctttcagcttcgatgtttcaatgataagagcttcagagaacacttccagctttatccctgacaaaacaagaattttgtttctacttattaaaccggtaagcgtttaccactgtccgataacaactctgatacatggcgacttcgattaattaatcaacagcgttctacaaattttggtctatctcaataatgttctaaaaatttcgtacaccaaagttacactgttcaatttatacaagagcatggttgagaacttgggattcccttgaggactatggccaaaattctcatgttaaaaaactgagcaataaactttgatgctctcggttttgctgtaaaatgtgccatggcagacaccatgaaccagaatgtagggccttgttgcctgatcataaaaatctcaagatatgcatgccgtcttcgataaattctggagcaaacgggtaaaaaaaggtcggctcggagagataaaggtagagcgagaggcctggattctgaaaataagtgaagaagaaaaataaggctgagttacccctactcagctgacattggatctatcggaccaaaatccttcagtggccaaacctatgaaatagcaatattgtcaatgctctaatgacctgaaggcaaaactcaatagtaaaattagtaatgacattccaggggggaatgaagaatggcccccaatccctgtgttgatgcggttccattgggctgatgcactatataaatagtagcaaaacatggtttctgaatctgaaacctttggttgctataatgaacatcaacaagtagtaatttcaagcaagacttcatggtccacaccaaattagttatatgaactttaagtattaactttatgccttaccaatcaaatgatgatagcatgttgctatgtgaactttgaatgaagaaacaaaatgtcattttcaaggtacacaaatgattaacagacaaaatagcaaggtcactgaaatgaattcttttcccaattaaaactaacacccttcctacttggctttaattacaagtactgtgctaagtcatacagttgaacaaatctacagtactccagaaaccttgtacgtaattatatcagctatttcaaaaaaacctcagcaagtacctttcaagtagaaaacatttggtgtatttaggccaaataccgccaacaaaatgaacgcggccctgatcggggctcgctagttctaattgagcacaaaactgaaatctaactctgtttagaagtgatagaatcagagttgtactcaaaggaatccagagcttttaaagttcagtgggcagcatataggtgctttgcccagagttgtcctagacacggtgtaaaaattcatctgactcatcaccaattattaccatatatgggcacttgccttgaggcatttaaaatgcagagtacttaattcatagcagctcaccagttgaacatataggaacaatattctaaaactataatctaagaaaagatgtacaatgtgtttgctaaagatgacaataaaattttaatttttgtgagtaacccagattgttgtaattgagtatagcaacaagaagcaaatgaagcacttgagactacatgctgtttaccattactacacatattcacatcctagagtaaagcttttattaaccctaaagtttttaacaatcattggttgcttacacaaaatctcatgatataaaaaaattggcatctaattagatgcaaaatcgaatcaaggatgagatttcagtggcatataaaggaaccataatatagaggaaatgagattacccgacaaaagatcttccctgtaattagaccataagggacaggtccaaactgtcttgaatctctagaagcataaatattatcaccctgcacccagacatggccttttggtacctataagtatacatcatccaaattaagagcatcacaagatggtatgtctgaaaaggtagtcaactagtcactataaaaagaattgaaaatcatataaagcatggagcttgccatgttcaaaatcagttatgttattgattgctatttcaaacataagaaatgtatcttctgactgaataatagtctcagcatcctgtcgtacatatgttattcgatcatataagcagtgaactagtggttgtctttcggtgttagtccaatgccaaaaattgcacataaagcgaaacatgaagtcaccggtcataccatggggaccataaaacacagcgttccactcattgtggagacaatcagtgtgcctctcaagtatctattgttcaaatgaagaaaaaaaaatgtctgacagcgagccaggattgtttggtttaaggcataggccacacaccctcaccaccgaattgtgaactcttaatcatgaaacataagttcatccctttattttcacatgtgtactgatgctcgagcaacttaaggctatactcttgaagtacactactactgagcattctcgaaatctacatttattagcattggtaccgaccaaatctggtatcaagtggtaagcaatgacctgaggaagcctttctttttttttctctttttaacaaagggcaggaagcatatcctctagtgttagtttgcattatagcagagaaagataaattctactactaatcttttgcaacacaagagaggatcaaaccaaatctagctaattgaaacagaaactgaagaacctaacaccagattaacccaagctactcaccacgacggtcttggaggcgtcgctgttgccggggtcgacgaggaacgtgacggcgtcgccctccatcccgacgacgcgcttgacgaccgccttgcgcgggttctccggcgagacgaggagcacggcgtcgccgctcgccacccgcccgagccgcgcgctcaccaggtccaccgccaccacgtcccccgccaggttcatcgccggcagcatgctcgggcccatcacctgcgccgacgccaagagccccacagaacgcgggtggggatcaagccagagcagagcagagagagagagagaggaagaggagacgcgggcgaagtacagtaccagcgcgaaggagcagacgtgggcgttgacgacgtggacggcgcagacggcctgcgcgacgaggaagacgcgggagaaggcttccccggcgatctccctccacgggatcccgccgaggcgccgcgcgaacccggacatggcggcggcggcgaggagagctcgggagagttttttttttttttttttgggagaggtagggagagttctgggagaaaagacgagtagtacgtctttggacctgggccatggaagcccacagcaatgggccggctttagacctacttattataggaataagtttacttcaggcctctttattttgaggtcgagtttgaatcacactgtcgaaccatagtaccggatacgacgtatccctcagaagtttcagctgacgtagctgctgcggaaaagaaaaccatagtttgagccctaaggtatggccggtgacttgagatacacttatgttattgattgttacgtaagccgcggaaaagaaaaatcaataacataacggtgaaatcgagttccaatcaggattttgagaggatattgcggcgcaagacgacgagcgagctcgacgaggcagcaccgccaccatcgctcgcgcggctcaggagagaggagtcaaagcgacagctcgagcttagtgacgtcacctcccagcaccttcccgttgaccacacacgcccttctcctagtcggttctcacatgagaaagatggggaagagagagggagaggggagaaagaatgacttatcgctgaaatgtgaggatgcatggattccatactaactcagtcagattaaccacaatcgactcgttatgtcatccaaaaccaggcataacactgacctggggtcttgggtaatatgctattataatttaaggatgtgttatatctgtattgcggttgaaagatatgattcaaactcgatgtcaaaataagggacctaaagtgaccttattgccttattatacggtctgtattgcatatcaggccgtcaagccatctttatcccttctttatggaccgaaatgtagatgggcctaatcataagctgagtcagctagtacttaattggcttgaaacaagaaacaaccgttccggaaacgtttcaaatcaaagttaaaactttttttgatgagttcaagttgctttataaagaccaatcagtatttaaaacatgtctatgagcagagggagagagactggaactcgatttcacttttctcttttaaggaaatgtattatacagtttcggtagagtagacagtttcttggcatgaaaagaaaattatacatacagatatcgttaattgagagcaaggtaaaattaaaaaaaaaatgcgcatagagcaatacaatatgacaccgacatgatacgatgatagtaacagagggaaccatccaaataccaaaggtcgtttccatatctctaaaaatgcagaaaaacattatatatatgttctagatatatatatatagccagcatccagcgaagagaagattactagattggcaaataacaaaggtagaaaaggagaggttcaggtaaggcttcatctactatatgtataagggggtggaggggtcatcatcatcctccttggtcatacagaggcaggcaggcaatggtggtggtctgcttcatggggggtcaggtactcaggtcactctagtagaagacggcgttggcactctggtagccgccgtcgtagatggcctggctggctccggcgcccatccccatggcggcagcctgctttagggcggcgtgctgactcatcagggccgggttcgctgccatcttgctcagcgccagggtgcgctcgtaggctaggaggtcggtcgccgacatgccaggattgaatggtgctggtgctggagggggtaggggcgcggatgctgtccctggtggagttggcttgcttccccaggaacactgcaagtaggaacaagattaaagtttagctgaattgcaagaaccataactagactacatcctctccttacgataaaaactcggtgaaaacataacttgcggaggtaaatgccaatgaaattcagaatgttccaattattgatgttttgcaagtatttctggtatgctctctaataagcatgggcatggcaaaccatccttatgattgatctacccaaaacactcttatattaaatgtatttatggctgaaacattgaagatgaacgtaccttgatctgcctaccgccaataagttgtccattaccagtctgaattgctagagcagcttcttcatgggtgctgtaacgcacaaagccaaaacctttatcacgcgttacacgcacctcctcaattgaaccaaccccaagtgaatggaaaaatctgtgcacatcattgctgttgacctagtaaatataagaggcagaaacgttactggtatggaaaaacaacaaaatacagcacaaaacaaaaagaaatttgtttcagaaatgggagaggttacatcatgaggaagattgccaacataaacagtcgtgtactgtgggttgttttcaggaccatcttcatttgcattatcctttccaccttctgcataaaaaagaacatggaatactttacagttcagtactttctagccatttaacagagctcttgctcagttgattgttacattacatattacaatcatgtattgacttaaaccaaaacaagtgggccaggacaaaaggcatgtatattcacctgatgaaccatttgtcaactctatcatacccttggagtctgtattttgtttctcttcaccagcattagcaccctttgttgcccaattgcaacgaacttgacggttgccgagccacttccctgaagcaatgaaaagtaagcagaaatgatcaggtagctagaactaacctaatgactagtgaggcatggcaacaaacatggaaaaagactcaccattcagttcatttatggcattttgtgcgtcctgtcaatgaataacaaagatgatcaatcagcaccgcaccaaaaaaaagtacaaataaataaaaattaaactgtcacaatgacactacctgctgatttctgaaagaaacaaaaccaaaacctctggatcgtccagttttctgatcccacattaccctagcatctctggaaaaaaaatacatatgggtaagaaagaaaatgcataatcttgaacaactggtaaaatacccttccgataaaatgtcgcagctagcagagtgagaactggaaaaaaaaaatacacacagatacgtgaaacacttacgagcaactggtaaatccagcgaaaaaagcaaacaaagcagcatctgttacttccgggcaaagatcgccaacaaaaatattaaaatggcctgcaagaatgaacagacatcagcaaagctcaattttaataactcagattcacatgtacacagacagtacagaacaataattgcaaaagaacatttaacagtttttcagttcccaacctgatgtatcctctctttgagtacttgcatatgcccaattgacttttattggctggccaaacctggtaatgtaggatcataagaaaatgttggaaaatgttaagaggaaaagcaaaatattagaatttatatatattataatactatagtattgaaatacttacaattgtctaccgttgagtgatacaattgcaattgcagcagatctacggtcataatagtcaacaaaaccaaaggatgactgcgagatttaatacaaaaaaggaaatcatataagcacatgtatataaaaagtgtacggctcagccaaacctaagaagttaattacattaaatctgctgaaaacatttagccacttaaacaaactgatgcatcacattgaagctttctcaagagagatcaatactgtagttagtaacataataattgaatgaatttagctgtctggcctatgtgaataacatagcaaacattttgaaacttccttgttcagaattacggcatttgtgctagcctatccttactatgaaattcaactgaataaaatactccaaaatagtcactccagcatcatcactatagctctagtgttaaccattatgctgaaaaataaactcttgtatacatttgaactatggttcactataacagatttgcataagtcatatcatgtacaagttgtttgatgatatcggtatatcacgcttatggtactgggcagtgtcatactgtcttatagttattatcaagttttaaaaatacagtatgcgaatgaaaaatgaaattcattcaatgacagatttcagtaactatcagtttagttaattaattaagggattaggggcgggtatgcatgtgcttttatatggagatagataaaatactcagaacatcccaaacgatataaatgccttcaagtagcaacatttacaaggatacaaaaggatctagcgaaaacagtatagataatattttttttgttaggtttgtatcaaagagcaaagattccacaccttttccttcatgatgagcttgcatccttctactggaccaatactttggaagacctcatgtagcagtgaatccgtcacttgaagatggatattgccaacatacctattcagaacatcaatggcaaccataagaaagaatgaatgcagaatatctagccaacaatgcaatgctgcaaataacgaagagagctcgatccagatcagtggatcaagggcactctgcccaaaggcatagcattacccaatctaactatttcgtaatgttgcgaaatagaaccaaatcagtgaaacaacagtaacaaagttccttgggcataaacagggcaaaacaggtgacaaatacttacacactccggcatgtacttgaatcaaatccaggaggcaggttgccactaacaatgggctctatctgccagaaaataatattagtgtcaaaaaaaatggtgcacttaaatattttataatgaaaataattcaaggagatagaagaagaaataaaggagcaaaagcatacaagtcactgtaactgcaataatgtatgcaaataacatccaggttataaaaggaattcgagcataattatggtgtgttcaagtatgttccccatttaccacttgccccaaagaagtacaccttgttaaagatcagatgcagcctaaacgtaaacggtaaaccacatcctttaatagcgactgatctagcaatcaccagactagtttccactgaccttcaacggaactcatttatactagttcgcagtacaatctgacaaattcaaagttaataaatatgaaagcttaaacacaagcacagagaactataattcgtgtactataggtacttgttgggtctaataatacataaagatctgaaatttcaaccaaaacaggttcccaaagacgacaaattgaacaataaaccctatccccacaaaccctacgggaaaaaaataattttccccaatacatgcgacaagtcagagagactactacaaaatcaaaagaaaaaaactagagtatctgacaaaatcccaaccgcgaaacagtcaaatcctcactctcaatagtaatcaatcccactggcctcaaacactacaacatgaaatttaccgaatcgtgctaccgaaatccccaaaaacgaaaccctcgaccgcacagtaaaaatccaccaaaccctgaccgctgatcgaaacggaaggagagagagagggagagagattgggccacctgcggcgccgcgaggaggcccgggtgcgggtggtgcggggggaacaagggcgcctgctgctgctgcgccgccgccgccaccgccgcagcctgctgctgctgcatgagcagcgcctgctgcatcatctgctgctgctgcgccgccgccgccgcctgcttcatccgctgctgatgctgcatgtcgatcaatcaaccaatcactcaatcgatcgatcgcgatcgatcgatcccccacctcctcctccgcctccgctctcgtgtcagggatcagattattattagggtttggcctcaggggg

SEQ ID NO: 88669 - DNA, 2981 bp, Oryza sativa
  unsure (1)..(2981): unsure at all n locations
agctcggtacaaaggattcttgtacctgatcaagacgaatcaggagaacaaaatgaagctctttcgcgtgccaacctatgatgtggatgtcatctggcacactcaccaactgcatcctgctacctactgccatgatatgctgaagctcattggacgagttctggagcatgatgacaccgatgacgatcgatcagaaggaaagaagctcgatactggattttcagggactaccaaacagtttgagaatgcctttggtgcaagatactggaaggctggtgctatgtaccgtggcaacttgccgtctcctgtgacatcccatcctcagatgtttattagtgaggtggatggtgaatttagtgttggcaaagctgagtcgcaaattaccattcttgaancnacagttatagaggtatgatactctcacaacacatgattatccttgaatcaaagccacagaagtatggtggtttgtcctttttacagactcctgtatggtaatggggatggtgttaagggcctatataaaggagctgtttgacaatatggtttgaagtgtagaatgctatactgacaactgttgtttctgaaagtataactaatgtggaacatcatatccagaacctgaattcagcagttgttttacaaagattcttctactgaaattatttattgacttaaaatcttttggtcttctgcagttattcttgcaaattgtggacatcaagaacttgccacctgcaattccaaaggaaaatgtgtacatatggttcacaaagaatcaaccagacatgttcatcagtgatggtggcaggctggatatctctacaaaaacagggaagtcgattggagccagtatccaatgtgagcctactggtgaactcattctaacagtactggttgatcgggaatcatcatcgaagaaacccaaaaagattgggaagatttctatccctcttcaagagtttacatggtctgattccaagctctcctttgagaggtggtttgaattgaaacctcatgatgggcatgccagttcacctatcgtcagccttcgagttgctgcctcttccactgtcccagtgaaggctcagcaggttcttagcatgatcaggacagaacctttctctcttaagagttttctgtcaccgaattccatcaaggatcaaaagatgagctgctggactcactttgtgtatgattgcaatactgaacttatccgtcttcaaattaggtgattttctgccctccttgatacttcttcagattaattctttcattcaaaataaaagaaatggactaacactttctcactagtaacagcatggaaagcatttatggtatttatgtgtattcatttcaaatgccattgaatacatttacaaaatgttctgtttgcgattggagctgatgttcaacacttcaacttatgtggatacagttaaccatttcataaatcaaatctaaaattgttgaagcacttaagcactagtttttagtttacctttttaggatcttttgattgattaatggtactctttgtatcaaatccttcttgctaatgagtactgactcgccttcatctcagggatcagaaggcaaagaacggcatggttgtcgctcgggagttggtcggagtaacaaagtcatcaaagaaaccatttaagctagcagagttcgtggacaacaagtggtcactgagcaactctaacttatgcatcactaatgacatgaaaccaagcaaggatggctctatacttgagctcaaatgtgacaacaaaacggtaagtgatgctaatacattacctgcacacataaatctactatatatgtgtgtgtgtgtccttgtctcgaaaagaatgatctaagtcttctttgaacaaaccagatcaaactctaccagggaaagaggctagaatttcaacggaagtgctgcaacaatcacgcagaggagaatgcttcagctattactgctgtgaagttctctgctgaacatccatatggcaaagcagttgcattgcttgacaccaaatctgagctgataatggtacacttcaacccttatcttttacattttttttcagtttatgtacacgtcaactttcatttacaaagttttcagtttgcttttgtacattttacaaaattttcagtttgcttatacctgttgcattgttcttgccttctttttttttcccaggtaaatgaggattggtttctgcttccttggatcgtgatgtcgttcctgttccaagacatcaatgtcgaagacggctcgaagctcatcggtggcgccattgctcagaaaggcgcgatctctgagcccgacactgctgccatggcgatgtcagccgagacggtggctgctcctgctaactgcggcacttgcggcacggcgtgcgacagtaacatggcaggcgacaaggtggtggccgccgcgagatgcaaggccgcgcgatgcaaggctgtcgcggcaagcggcggcggcggcggccaggcagagtcggctgggtgcggctcgggatgcggcggcggctgtggcggcggtgttgccaaggtcgttgaggccaccaaggctggcgtcggcggccatggcaagtccggtggatgtggctcgggctgcggtggtggctgtggcggcggcgggtgcggcgccatggccgtcgagagctccaaggatgatgtccatgcgaagtgtgcaggttgtggctcaggctgcggcggcggctgtggcggcggctgtggcggtggcatggtcatggaagcctccaaggctggccatgtcaagtccggcgggtgcggctcaggctgcggcggcggctgtggtggaggctgcggtggcggcgtggccatggaaagctccaaggctggccatgtcaagtccggcggatgcggctcaggctgcggcggcggctgtggtggcggttgtggcggcggcatggtcatggaaagctccaaggctgtccatgtcaagtccggcggct

SEQ ID NO: 88670 - DNA, 2429 bp, Oryza sativa
tttggggatccctagttgataactggtgaatcgatgggctggagtaaataattgcctcatcaaaaatcagggctcaaatctctctgtattgttacatactctgtgctaagctccccaaaaatggcccatctcgaattaactattatcagggtcgttgtggcaattagctgggggaagggtaaaagggagaagtgaaccagacaagttcgatggatatccagagttagacccacttacatccctccctgtctgcatataattattggaattcttgaattagttggtagtgcagatcaaggtaatttcatatgccatgcaaatgtgatttttgcatgacatgtactgtggaatttattgacaaacttctatatttatcaaaaaaaaaacttcttaaaatagaaaaccaaccatcgagacagatagacaaataagtcaaacaacagtttgctacatgacataaaagattaattacaaaaccaggatacaatcaaactctgcagattaagcataaacaagataaacagaccaggattgagcttacatctgcatagctgcatatgctgaacctcagctaaaagtagctaacatgatagaaaaaatagaaatatgtcttctttccaaaacaaaatatagaaatatgcatgccaccaaacgatttgatttatctgtgtgattcgtggcagttacttatttgaacggaccatcagtcagtcaacttcatctgacccatatagacattctgacttattcattgactcaatctcaggccacacctcaatttccaagcttggacgacgtttcctttcactattgctgcatctcaggcccagtgaaaccatctttacagcatcctgtatagacgtgtcatccaacttcaattgagcatccaagatttgaagtttctccaagatcatcttttgcttgcgtgtgtccattttttccaattttttaccttccaatttatcaacgatgtgctttcttaggcccgttgcactttggcctgtgactagctgcagcagaatgatacccaacgcgaatacatctgactgaggagtcaatttgcctgtattcttgaattcagggtccatatagggaccgctaccctttggcacttctgtaatatggttaggcgttcctgtgtcgtttgtctgctgtaacaaacgggagattccaaagtcactgagcttgcatatgttttcatcatcgaagaggatgttgcctggtttaagatcaccatgagcaattggattaggcttggcgttgtggagaaatacaagagcagtgcagatgctagttgccactcttactctttcttcccatgagaatgattccctttgtttctcattaataaggcgatcttcaagggtgccattaggtaaaagctcatacatgagtgcgaatttctcactgcatgctcctctgagagtgatcaggttttgatgccttattcttttgagtatcgcaatctgaattttcagaatttttttttttggtgcaagaagagcaatagtaagaatacatgttaggtttatctgtcagacaaatattaggtttgctaaaaggtaatgcaagaagtttaatggtgctagaacttgcttgaaagggtgatgtgaactgcacattctacagaatagctttatctgtcggataaatattaggtttgctaaaaagttaatgcaagaagtttaatggtgctagaacttgctggaaagggtgaagccgggaagaaaaggtgaactgcacaatctacagaataaattgttgtggctgtcgttttattgatctattggtgcagaactgcaggtagtgtccacctctattggagtgatcgtttcagtaagtaaagtacactatttaatcaatattttgagcataaatatcgcaaatgaacagtacttgctgatgatactgtagcagcagcctcacactgagaataccctcttcagagttcagaatatttcctaaatagtgtgatttgttttctagtataagaattagttgtttgactatttcttttttttttttggtttgatcttacccatatttggtaggagaaccctttatgctatgaggctagtgctattacaatgaagcaagaataatgaatcaaagaagtccccatgatctctttctcccctccccttccagttgacaaaatagttatccacgtaatgatagaattatttacaatttatttaattggttactcacctcttgcttgaactcccgttctccttgccggctactctcattgagaatcttcatagcaacagtctcgttccgaagttttgccttgtagacgatgccataaccacctctcccgagacaatgattttggtcctttgggactgaatcatctacctctgagggattgaactcaatgaagctaaccccactactggagtttgaagctttggggctgcaggaat

SEQ ID NO: 88671 - DNA, 648 bp, Oryza sativa
atgaaggactggttagatttatataccactgaggagatagatgattgggagtgtaaggaatgttctgtttctgctaatgaaaatgcctctgaaagccaaacagattcaacagttgatgaccaaaccgagcagctgaacagtggaacacaccaaaaggagcaattcagctattcagctgggaagaaaattatcacgcaaaatcagcaccaagggaagctaccgttgctggattgcaatgcacgtcaaatggatcaataccacaacaaaccaaaggagggaaaaaagataagaagagttgcaacaattaaatatcgcattaacaaggcaccacctgtactaaccattcagctgaagagatttgaattcgttcacgatgatgggtcaggaaagatcgaagaacatgtgatctttcaggagacacttgatataaccaaatatatggacaccaggtattaatacttctacttagttgaatataacatagctcatattttttcaatactgatccaatatgatacacgataagatcatagtgccaataactttggtgataacttcttcaaaaaaaaatatttttaaccattattcatttctctgatgttcagatatctggacaatgagtacaaatattgccttgtagcggtaatt

SEQ ID NO: 88672 - DNA, 1122 bp, Oryza sativa
tgtatttggccacctttccggccagagccaactcggcctgctgtttgttgccccgaggaggacaacatggagacgatcgtcgcgcaggatgcgcttgtaatcacgtggaactcgtcgccagacaccgcagatcttgcccgtggcattctgatagacactgagagtgccgcaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaatgcatgggt

SEQ ID NO: 88673 - DNA, 4425 bp, Oryza sativa
gtacagtagctcatcacaactatagaccatgtacgaggcacccaataaaaggaaaacgtacctgtatgcaatcttgcattagcatcaaagcatatgttccgatatcaatactactttgccaagtatatgttactgtctggtgtgtgtccaccatgtctagtatcagcaagcaagtcatccacatcgttgctcatacttgttgttcacggacctgtttaagctacactatgtgcggatggagctaatatcaaactgttaattatggcaataatagccatcaaacgcgtacatggtctattctttgatgtgccaaaacatgccttttcaacctttgtttatacctaattactagaattactgtcgtgcacagatgcacttggtagatcacgaattttcaagacaaaggtgaacaataaaaatagaaaagaagtcaaacaaaaaaaaatcagaaaacaagcagtttattgctttatttcaatccaattcttaactggaacccttagccactgtgaggtgtacatctgacaaatcaatactgaaaactgcatagaaaattgaggtttatttatttaatatcgttcatgtaatatgtgatacgtttactaccttggcatcatgttctttaggagccaaacacatgttccaatggtgcataacatgctcactgctacttggtctatgaaggagtgctctttatggctcaaccctaggaattggcatggctttagataggcaatatgggattctctgattttgttgtgacttatgtacaatacttgaaaaagaattattgcttgcgcctttagtcctctgcgagcactggtctctctctctctctctctctctctgtgtgtgtgtgtgtgtgtgtgtgtgtgtgtgtgtgttgaatcatccgacatcgtgctattaaaaactacaactttaacctttttctttctgtaaagcacaggtctttccatttggatctgttccgttgaaaacttatcttcctgatggagatattgatttgactgcctttggccattcaagtgatgaaattttagcaaaacaagtacaggctgttttagaatcagaagaggcaaggaaagacgctgaatttgaagtcaaggatgtccaatatattcatgcagaggtttttctcttgatgctctttgttttttagtttatatattagttagtgtctaattcatatgcgtttatgtttctggtagtggtgtctacttatgtgtgcttatctattgtgtttattatataagatcacatgaaaccatccatgtgattcattaatacatgaattcttttcttttttcttttactccccttcttatagttgcaatcaaacatttcgcagtattcttatcctactataaaacgggaaacaacaatagagaaatccatcgtattcacatgacatcaatgaagcctgtgcatatctcaatatttcactgctagcaataaaaataaatagtcaatagtgatcaagtaaactttccaccactgtgctctattgtcatttaacaactaatgcatgcttcaacatagatttacatgttctcgcacattgttaatgtttctgatggcatcatgtttgtctaaaataagtctttctgatggcaggtcaagttggtgaaatgcattgttcaaaacatcattgtagacatctcattcaatcagtttggtggactgtgtaccctttgttttctcgagaaggtaatgtttgaaaagttgcaacaaatatgcagttgccagttctcttccttaaactgcagatctatctcggtctgatttatcacaagctaggtccgttgtacttccttgtggttcaacagttggtagatgatttctttaaggtcagactgctcaggggaaaatatatctataaccattacattttgcaggttgatcaaaaatttgaaaaaaaccaccttttcaagagaagtataatgctgataaaagcttggtgttattatgaaagccgcattcttggtgctcaccatggattaatttctacctatgcattggagatattggtgttatatattttccatctcttccatggaacattggatggtccactagctgtaagttctgacttccaactattctgcagcatttgtaaagttcttgtttctgacaccctacatacgttgccataaattactctatgttttctgcaggttctctataggtttctggactactatagcaaatttgactgggacaataagggtataagcttgtatggccctatttccttgtcttccctgcctgagctagttagtaagtggatgtggtctgatatgttacctcttttttttgtgattggaagttttcttttttcattggtcatgcaaactttattttttttcacagctgactctccagacacggttaatgatgattttactatgcgagaggactttctcaaggaatgtgcacagtggtttactgtactccctagaaactctgagaaaaatactcaggtctttccccgaaaatttttcaacatagtggacccattgaagcagagtaacaatctagggcgcagtgtcagcaaaggtttgtttcttacatctagatcatgcgttttgatggtaggattggatgattagtcttggaaatatcacaactatagtcaattttggaaaaattgatgtgtcaacttgtttgttgtaacttcacagttgttttcaaattcatcttcatcccatgattggtcactcagggaaaaatgcttgtttacttgtcaaattttagtacttatgctccagatagcttagtttttgggcatttactgtgcgtgcaaaagggataaattgtcgctgcgccccctagttcacaagctatttatccatgggccaagagattttagaacaattaagcacaaaagaaactctacgccacttaactaagcagtaacacttagtacattggatatttgcatgccagtgtatgcaacgtgcccctggaccaccttactttaataccatacatgccgcttactgacatgctgtaagttagtgattcaattgttgtttgttatatgggtatttgctcacatgcataacttccttttgctatactgcacaattgcttatgtgcattaagctgttgcagtgctatttgtttacctggcctgatcccgttgtgcaaagcacaggtaacttcctccggatacgcagtgcatttgattttggtgcccggaagcttgggaagattcttcaagtgcctgacaattttactgtggatgaagtgaatcaattcttcaggaacacattgaagagacactgcagtagggtaaggcctgatgtgcaagaaatagctctggacttcaatggtgaaagagccgacaacgatagttcgcctttatacagtaataattcctttggtgatctatctgatgagttcaataacatcagcatttcagattccagcaaccatgggtcgctaaggcaaaatggatggaattatgtggctgagaacaaggaaaggaagtctgtttctggtggctggctggcaagcaaagcaacaaatcctgcagctactaattcaactggtatgacgaatggcagtgactcttgtgagcctgcatcaccatcaattaccggagcacatagcttgccatctgaggaaggtcatgacgcactggatctctttaatgagtcagaaagtggtacgaaggctggcataaagtatgacacaaacccatcacaccatggaatgtcaacagtgagttacgcaggcagatcccaccagtcctttgaagaggtggataatgatgatagaggtaccattgatagcaattggtcagatctcaccggagactacacaacaaattttaataatcttctctatgctcaagggttccaccaagattatccaatgaaccaatattatccatttggtccagtgtactatcaaatgccttccccaccacctgcacgatatcagaataggcgatcatcaaatggtcatagcagaaataatgtgtatggatatgctggtacaaatggaataggccctgctccttgtccaccaggttatttaattatgaggacatatagtcaaatagatgattcacatcgagctcgtggaactggcacatacttccctaacccagtatgttcctcctttcacgatcttatgttcatactattaagcgtattatgcacatagaattccctgagctttgtgaaccatttaagagtctaggtttggcacaagtggtagataatccaccttctatataactcaaattgctaaggaagatgcacatttgtgaatagtattgtccttattcttttaacaagtacaactttaaacttcattttgtgtgaacttttggcactttttttcacatactatgcatatcaatgcatgaatcaataatttactattccctctgtccgaaatatagcaactttt

SEQ ID NO: 88674 - DNA, 716 bp, Oryza sativa
gactgtgattatgagggtacaactgtgccttctgcttgcattgcagacactgatttgcaaccccctccctactcttccggcaggcggcagcatatatatacatgtgttttgaagcatgtatgtatatgctccagcctccagcaataccagtatcttaccaggatgagtacagctaagctcttttcttttgcacatcacagccatatatcttacctgaagaacttaccataagatgtgagatcaaccatgaaatggttgccccttgctttaaaagcgccatcacaaataccaggcacctaacaggacatttcagaaacacacttcctggaccagatacttcaaacaatacatagaaaggaagaaagctaatgttgaagtatcatttcaacaaaacaaaacaagcatcatttcaacaggaaaataaagaatagtccaaccattgtattcagaaacttcagtccaaatctcatgtattaataagtctatactcccagcgttgcccccaattctccactcattgttttaggttacacgaaaaggctcaaacgtgaactattttgtacatttacttcaagatgtaatcctcatgttacagtcgccatcgtactacacttcaacaacagaatctaaccacaataggggttacatctggtcccaaatcaactaagtatgatatatatatcagaactccatcactggaccttctcagattcgca

SEQ ID NO: 88675 - DNA, 953 bp, Oryza sativa
cgcaccccaagaggcggcggtcggcaagaaagggggacgagaaaaaaaggaaggaaggagagatcctcaccggaagcggcggccgacgcggaggaagaggacggcgacgacgattgcccaatggcggcttgcgaggacggagggcggacggggtcgcccttgaccttccgaaggagaagagggagttcgggagaggaggaccgatgcggggtgactggaaacgaaggccgatggcgatgacaagaggtagagctcaccggcgaccgaggaaggaggagctccggcggatttccggcgaagaggggcggcggccgaggtcctcctcgtccttgcggagctgagggaggcaacggcgcggcaacccctagggcggcagtagcaggcggctggaggcggtgaatggcggtggtttcggcttgcacggtgggaatggtgctgcgggggtggaaggagaggacggagcggtggacgaggtgcgcacggcggctgcggtgctggggagggcgacggcgcagtgcggggtggacgggagcggcggcgcggcgctgctggagttcgccggagagcggcggtgcgtgggctcggcgcggggagagcgagggagggcgcggcggcttggggaaaatgggggaaatggaggaggggaggccggggattgtttttataggggaggggaggcgggatcgagccgggagaggcggagtccgggcggcaaccgccggtggcgtgggccgcatcgtggggtgtgggtggcggttttggaggggagagatgggggaaaaccgcggcgtcgtggggcggctcgggcggccatggcggcagttggagctggaggaaggggatgacaggtggggtccacggggtcccacctgtcggggagagagggagggagagctggatgggggacgtaaaccagacttcacgagggagagaagaaacgggccgacggccca

SEQ ID NO: 88676 - DNA, 3554 bp, Oryza sativa
caccccctctcccaaacaccacctacacctacaaccgagtactacaaaccagttctcgactagatcaagaattcaagatgtgtctgtaggtgttgttctgaagagctccaagcagtgttcttggtcgaggtttctgctccagaacttcttgtagtactcgtcgtaggtgtagttccggtagacggccggggagccatcggtgatgagcttctgagctgggccgatgagcacgtcgttgcaggggcacaggaacgatgcgacggacatcctcgctttgtcagagttgacgacagcacggtgccacacgctcttgtatcttccgttgcttagcgcctgcaatatatggaagttacagaggttacaaattctgctgcagagcagaaccaacacttggaaaatatttactgaataaaaaaaatacagttcagtgctttgcagttcagatttcctgcaaatatttaactactctttgcaaagtataaaccatggcaattggcatccgatagaagaatcttcatttatctactcctagagaaaaatctctgtgtgcgacgtatcacggtatcgatatcttttagtactatactcaatccattatatctggctgtttagggcctcttcgattcataaaaatgatagaatctggccaagtattttcatataatttaaattcctatgaattttttcctacatgtccctttgattatagaaaagaaaggaaactttctataagattgtattacttgtttcatatttcttaggaaaaatagcaatgaagtaattttcttttgtttttcccataacactatcaaaagactcatattgtttttcctgtgttttttatattcatgtaagatttgagaagtgttactaccctaattcttgcggtttttctattcttgtgtttttcctgtcctgcaaatcaaaaaggggtccttattggtctttttctattatcacagttattataatgttggtcaacagctcgtcttttttttttctgcaacaagaagtgtttgtcctaggtgacccaactatattctgccgcactagcattgtctgccacctagcctgatcgtttaccaacaagctatacctgaacacacaacagcttcaattgccatggttaaggctgtgtttagttccacgctaaaattagaaatttgactaaaattggaagtttgaagaaaaaaagttaaaagtttatgtgtgtatgaaagttttgatgtgatggaaaagttggaagtttgaagaaaaagttgagaactaaacaagcactaagattttcagcaatgttatctgaacacctaacctagtccattatatactctgataaaagaaactgatatatgcatcacctgtagctgatcaccaatgttgatcaccagcgcgttgggctgtggattcacggcgatccacctgccttccttgagaacttgcaggccggccacctgctggtccatgaggaggatggtgagggcgttcgggtcggtgtgcgccggcagtccgaacgtcagctctggctccgggcacttggggtagaagttcaccgccatatgctgctcctgctcaccaagaaccttcttgatgtagtcctgttccaagcccaggctctcggatatcgctccgtacagtctgaatccgagctcccgaacttctttgcagtatgtgcttatgatctccctgcaccatcgtcaaagtaaattcatcttatggttaataatataaggattaacttaggagataatgcgtgattaattcccttgatcttttgtcctactggtcctaagttcgaccttgtttttggataaacaaaggataactttcggcctgagcgaagaatgcgcacaagtgcacaaccatatttatgtatatcaggatttgaaataaagtcatccaccatcacaccaacgagctccaatgagctcccattgaaatccccatccaagcactgatgagaagggaggtcctacgaaaccgacactagtggattcttagcaggtgaaatgatcccagcactaggcatggatgcacgtgaccacttcatcgtttctgatgttgggatcttcatgtgattgtgtacatgactgatgcgatgcgactttttcagtaggggaaaaatgtggttctcattgcattgtcttactagtagctccaaccttctttctgtttcctcgatcgatgtctgtgctaaaattgcctcttacagtatatgagtgcagagacataaaaggcattgctagcatgacaggtcaacctcactagttcatgttgttacaatatataaaaatgatttgtaatactacttatcccatcaataatttattttaaatctcatcttacctctaagaggctctaactacctcctgcctcaagttgtttcttgttacacaaggggcaccaaagtgtttcctcctcaactttaatctttgctatacaatctagaaatccttatattttaaaatggagagaacaattgtctactgtctccaatatcaaacaacaagtgtaataatatagccaattattagtttcaaaaagtggcacatcatctacagctaatctaatactctatccatacaatacttacacacaaatatatactacacacaccgtcttatagcccgtgctactgttagctacacatatgtaacacacttttcttctctatctcctctcttctcatctctgcttaacctacccataaatcttatttgccatgaaaatcactttcatataattatatttttaatgccagagtctcttcttctcaactttaatctccactaagaaacctagagatgctcataatttaaaactgagaaagtagttgtttactacctccgatctcaaatagcaagtataatagtatagccatctattattagcttcaaaaattggcacatcatctacagctaatctaatagtctatctatataatagttacacataaatatttactacacacgatgtcttataactcatgctatagctggctacaaatctataacaccgctattattctcatcttctatcatctctccacctaatcacaaatttgatgtggcaatttttgaagcccgctacttcaattattgcactaactcaaataaatagcattatagaatgcgtgcagtcaaaccttgaatcttaaatgattaattcatgcaaaaatactaaaatttaacatgagaaaatggtgttggtagatttggcatggaaatctcttttatataattatatttttaatcctttttaccgatagtagaaccaatctaaatcgtatatcttattctaatccaatagatcatatctatttctactaccaaccaactactagtagttgtagcgcccgttccgtcgtggcgcctagcgggaaaactatctcttaaaaactctatttgcgaaatctgtttctttgcttgttgcctagtgtccgtgccatctcagatctcaaatccccgatctatcgtcgagttcaatcccgaatccaaaccttcccaaatcgatccctccgcaaaagtttatttttcctccctcgggttcgatgggcc

SEQ ID NO: 88677 - DNA, 1867 bp, Oryza sativa
aggtaaatcgtcgtcgtcgtcatcctcgtcaactatttcttgatcaggatcaaacttagggtcagagcaattagagtcagtagattcggccaaatctgaatcatagctactatcactatgtgccacaagtgattcagtgtcagagtatatgccctcatcatcaattcctaccgcatcgttatcatttgaaccctttttttttatttcttggctctcttttgtgtgtctctcatttgtggctccctaatttgtagcaatctcacttatccatgctctaggccttactgaaggatgacacctacattttgtgggtgaaaattgcaatggaccattgaaattattggcttgggcatcgacgcacacaacccccttatctacattgagtctaaaccactctagcatatgcttatgtgattttatctcaacaataccatcatctaaagaacgccgcaaaatcaagtactgtttagaaccccaaatgtagtgttcagctataaaattaacaacttgcaggagatcatagttatgcatatcaatattttgggttggcaaggttttacattggaggtttttctttggccctccatccggcaaactaaaaaacgacttaactctaacaactaattccaagcgcagttttcagtgaaaaattgaatggcacagccagcgacttgattgaaaatctaagaaagaaaggatgaaaaggaaagaaattggtagacgtgaataaaaaaattgaaaaaaatagtcttagcaatatattgggaaattgcgcggggaaaaagagtaattgatgttttcatgatatatcatgccccgttaaactttttcatgtaaaaacttatagttgagaaaaaaatgtcaaagaaaagagtacaacctacagatcaatactcaaaaataaaaaattagctactctaatttttcctgatctaaatgaaggttttgaactgagtgccaattcctggttgtcagccagtgtattgtgtatgttctgcagctagctcctatccttttatgcttagtagtatttcttcgtcctcgttgctcaaacatgttcttcggtcctcaataatttgtccgtagaggtttgaaggccgatttggaggatatcgtagatacaggtaccatcaatacatctcgtgctagttttgaagaggatatgacatcctgtgattattccacaacctgtgtacattgaagtgcgacgattcatgtctgatggcgatgctatccaaatagttggacaactctatcgtcaacacttggttgaactaccattgccaccatggctggaagatgagcctccacaaattctgctacactatgatttttcttacctgttgcaagggcgggtgtgggtatttgcaatgtgactccctaaaactttaattcatacttttggaacacctaaaatgatttagtattaacatcagaataatagttggaataatcaacatatttagtttctccaataagtgaacaaagattgaggaatcgatgtatttccctctaggatcaagaataaatgcaaaagcatacaacatggggaggtttttccaatatttaagataattttgtttcacactaaagactgctggtcctataagttcatcactatcatactctttgaacaaagtggcaatttcaagaatcttatgcaaatttaaattagctgttggataatatactttagaagttcagataaaaagaaattgaaagaacctctcaacaacatactaagtatatgtctatcaatagcagttgcccatcacttgtcaaaacatcacgtgtttgaagaaaaataataagcaaatccttataatgtaatacactttaacattagataagtggcattccaccgatg

SEQ ID NO: 88678 - DNA, 507 bp, Oryza sativa
tttatgtgtggatgaaagttttgatgtgatggaaaagttggaagtttgaagaaaaagttgagaactaaacaagcactaagattttcagcaatgttatctgaacacctaacctagtccattatatactctgataaaagaaactgatatatgcatcacctgtagctgatcaccaatgttgatcaccagcgcgttgggctgtggattcacggcgatccacctgccttccttgagaacttgcaggccggccacctgctggtccatgaggaggatggtgagggcgttcgggtcggtgtgcgccggcagtccgaacgtcagctctggctccgggcacttggggtagaagttcaccgccatatgctgctcctgctcaccaagaaccttcttgatgtagtcctgttccaagcccaggcttctcggggggaaatttaattttccggggcccccagacagtctgaatccgagctccgaactttttgcagtatgtgcttatgatctccctgcaccatc

SEQ ID NO: 88679 - DNA, 1755 bp, Oryza sativa
tactttttaagactaatctatacatgtagtcaccatatttgaaagacaaatattttaaaaataattcataatcttccctaaaaaaatgattcataatcaaagattctaaagtttgaccttacccttgtctaaaacgacaagtattatcagcccggagggagtaatagataaactgccataccacatcctccttgaactcggtctccactagataaacttcctttaatcgattaatttccttaaccgaatctaccaagaatccaactattggccaccagataattcgcatcggtcgatttcaggactctgaagccgatactgactctagattgatgatgacttcggggcttacaaaattttgatgttaacaatcgaacactagataaatacttcctaaagttaaaaggaaagttactaaatcttgcctaattaataaatagaattaaactatcatgccgtggtctttacgattcttccttgaactcggtcttttcaggataagtttacaaggattaaatacaagttggttttagctgattgctacaaaggtttcactgacatcagaacaccagccggtgtatgcttaacctttggatcaaacaattattctatcatatcattattgaccgattggtttctattagattatatcattgtttaattacattatcagttgattgtctatataccattatttactcaagtgtcaaaatatacattgaacatatagccgattgatcaaaaccccatcgacatcgactggtataagcatcggctagtatcggcatcagctggaactattccatcgacttcgatcggctatttgatctgttgtttgcatattttgtcagctgcaggatcaaactaactggcacgcccgcatcttatcaatttttggaccttcactagcgctaagcagatctcccaggctgttgctgttttcaacttagttcgtgctaacatagatctggcactatcggccgagcctgaatttttcgtcaatagaatcttaccaaattttggtgttaacacggtgctggcacgacctagtagctcgtgggcctatgccgagttagggcgggtactgtagcaacgtgcctggctcagcccgatagagcatgacccattttgccagctttaggtgggggtgagcttggggccctccctctggacaaaggtcaagacacaagcttagggtcttgccttgggtcatcggatgggatcaaagctcaggatacggtcatccctaccttggggttagaatccatggactggttgtgacaacagcaatgcattaactactgaacgtgacttgttggtactgtcatttgcaaggcaagctttgcattaaatgctaagtgacgcatatctacacggtgtgtgatgggagttacgtggtagcggttgtgcggctatcatgcgcaccatcatcacccctacgaatagagcaaggctttcagatggcatggttgactgtcttgccgcttagacggtctcagtgcatgtccacactttcttccaccttaggctgacagtcggatccagaaagcgtcaatagtgctctaggtaggacatgcggcaaagcgagaagttgtctttccaacgagcaccgagagggccacacaaggtcccgacgacctggtccacttgtcaacaagcgaccatatttcatatacctaatccctgtgcgctgccaggacctagccgttagagtttagccattgtggtattcctcgactaactgtatggcaaggt

SEQ ID NO: 88680 - DNA, 585 bp, Oryza sativa
ttgctccatcactccacatggttgagcttcgtaaaacgggaggggacacgctggagtttcacaatgtatgttatcaaactttgtatattctatcatttcatagtgggtcattgaaaaaaaaaatcatttcagtagtacccagcatctagttgtttcttgatgatttcacaaacgattaacgtcatttctatcaaattgcatgccagttctacaacaatttctcgtcagagttaaaagacatagtgtggaaatctgaactgacgcaaaagcagcaaagaagaggtgatctttagtattccaactatccaatgctcctggatgtagttccccctttgtagcgtttgcaccatttctccaggtgataccaaaggatatcgtcctcctggtcttgtgcacattgatgaattttctgtggggtcacatcttgttgtgccaatccttgcaaaagggagcgcttttttttttctttttacccttagcgcaactgtagacatgctcacatgcatgtataaggccctcccggagatgcaccttgtatttgcagttgggatgtcaaataggtgtcctacatgctttggtgaccag

SEQ ID NO: 88681 - DNA, 8969 bp, Oryza sativa
attcctgcagcccatagaagacatagacactcatatgctacatcaggacaatggaaaatagtttcttctcgacctgggtaaattttctgtaggtagaatagggtggaaactccatcctcattttcctcctgcagctcttttatcgaaaaaagaacaggttcattgtaatacggggtcaacgcgctgcagatagaaatagacattatcagtttgacaagggtgccatgagaatactgaacatagaggcactgcaaaagtaatgtcaaaaggaactcacaaaaaataatgagcagcatacaaggacttacgaaaatgaaagcatgtttctgactttgggagcatcaggcatgtccataaacaaagaattggtgaaaaaggtaagacgccttctagcctccagatttgaggggacatccatagcagactctttcacagtgagtaacagttccagcctttttatctgcagcaagaaaaaaacattgttgacactcatttagaattaggaagtttagccaacaacagcaaatggttcagtctaagatatagtaaacctgaagcacacaggcaaacacaccttctctatccaggcatctgtgaattgtacgggaaacttgatagctccagccggttgaaataactgatattcttgatcccatgtcgttgtgccttcaggcctttggtatgaaccaccatgacttgactccaaaatactgtcatgttgcaaacaaataaaataatgacaaactgctggaggtttgaacaggagcaatcatgtcatacaaaactcatagcagcagaatttatttcatatctcgtctacaagcctcctgcctctatattttttctttccttcacatccatgagtcttgtttttctaaacctgcacaaatattgcacatggtagtgaaatattcactatcatttcacccacgctatcaacaagcatggttggtccggaaaccttgtactaagacactaagtgatgatggttctgtgcatctccgggtgcagaagccaggccattttattccactatctaaaaatagcaaaatattccataattttattgtccattgaaaaatgctacaacagaagttgctcatataatgatattaaacagtaaatcgtcatggttcagtacttcatcctcatgatatttgcacatgtttaaaacaatagttgtacctagaaagttggtcttccattatatctcttgttacaacctccagcatatcttgaaaaatctttattacagcatccctatcattcttatcattcttctcctgatatatataataaacagacaatgagacaaactagaatctggtatacagacatatggacagactccatgaagtttgcatgtataacaagcattgcgaatatgagcttaccaatcatcatcagtaattgctaaaaaaaggtcatcagtagacagacagtcaatcatgaaaaggcaagcatgtttctttacgcgttgcattcattaagataaaatgcctagcttctcatcaatttacgtgccagaatgccaactgataatcctttgtactaaaatactttccggcaatataactatcttttagatattacaaaatatatttcgattatctaacatttgaggaaataaacagtacattttgcagtaatttgctgataaatggaaaataagctacatttctttagaaagataaataagctacatgttatgatgattggttagacaaaaaagatgttgaccttaccaaatattttaccaattcaacaaacttattgtaaagatctggcaaagcgtgcatattcaaatcagtaataactttgtcatcagcaatatacttttcaacttctgcaaatatagtatttatgaccctgaaaagcatcacaaaatgcaccatggatcaggaaattatttcttcacaacaatattcaagccttttggatattccttagaaaggatacataacttaatagacaaagcctaggagagacaccttttctctggttcaccttgtacaagatccttgatgatatttttaaatgatgcatagcattcttcaattgcacatttaaaataatagtcgttctcaagcctctttttcaggtcacggtctttgccattgctatctttagccatgtcaacagctatggggatctaacattcacattattcaaaacaggagtgaggtttgttcaaataaaatataaccaaaatgaaaaaagaaagagaagagaaggaccttgctggcaagcaaaaaaggaggccactgcataatctcaagagcctgatcagccacatacggaacaagcagcagctccttctccctgtgttaaaatggggtccacaagtttaaaggtagaaaacacaaatccaattggaattaagtagctatccatgctatgcactcacttgttatttataaggtcctcttctcgaaagctcgtgataatttcgttccacatctgtgcaaatcttgcggctatcttctccttgtctgtgtgcttcctctgaaatgttgtaacagtaacataatatttcagaaattagcgaaccaataaatataaaaaaacaatgtagaaatatgtaaaagaagaatagagagacctcaaaacgactgtgcaaataagactttagacccttcttcctttttgcatcagattcttcagccggaattagacaggcattaaaggctaaaggtattgaaccaaagcgagatcgcagcattcctagggtgcggatctgtctcaccagaaaaggaaaaaggaatgtaaataatgtttaacagatccgcagtcattcaaatgaaacccataggcagtggtcatgctggggttgcacctacaatttaatgactgttctcattttccacaaagaactaattcaattaacagaaagtcagaaggaagtacttaatcaagttattggcaccagttatctcaataagagtaaatttcacaaaactacatatactttgaccaaactatcgcaaaactacagatttaagaagatgtatcacaaaactacagatttagcaccaaatttatcacaaaattaatacacgttttcttttggtctaaaggtttccagttgtttcataagcgaacaacaaaaatgatttgcaaattgcattgaaataagaagactgaaataaataaacagctactcccattgttcccacaaaattgtcactgtttcaattttgaccatttatatttttaaatggttagtctatcatgatatgaggcttaatacaaatgtttacaatgcaaaacactttgataatatagaatatttttaggtacttataatttctttttgcagaaaatacaaatgatcaaagtttaaatatgaatagtgcttgggataaatatttaagaacttgagggagtattgctgttagcatgaaaatattgggaagcaaaagattttaagcgtactagtgtactacaaatagtaactggtcactgcaacatggacaagctgtcgtacaacaaaagaaaagacaaatataatctgtttgaaagatctattagagagagatatatattatgttctttattttaaaattatgtgaggggttttgttgcatatttgcctgtaccaatacgtgtatatatttgagcccagagccctttgatgaatacaagtgatcttcgcaacaagatccagacatagatatacaaaagtataaaaaggaaaattaacctctccaagtcgttggaaagcaccataaattccaccaagcagtgtcgagaagattgtataccaaatttgtgtatccatgaaatagacctggaaagcaaacaagaatgcagaaaataattgtatacttccttctacagcacaaatctagcttatcacaattatcttgccacaaacaaatggagcttcctaagctaaaacaatgcgagtgcttaaaaactttctaggaaaacaaaggagaaggtcgtaccaaaatgattggagcccaaagcgcaatcacgacaccaatgtttccgttcgctacataacaaaatttaggattgttataaactaatatacagctgaaaatgttgagtgacatagttaccttttgggaaaaactcatgccactgaaaagtgtgtataggtaacttcatgatatccttggtaggttcgacaagaggcttgatctttaagaataaatgcaagattaagttggttcatacagttacttcaacagaattgatttctaacaaggtaagctcacaataattgagaaaaaaaaaaggcattgctcaacatgaactagattcagcataatcccatgatttcaaaatgtaagtccccttaattgaaaggttcttcaatgatcagatcgtcatggttaccagttttattaggtgcatcttgtgtgcgtcaaataaatttatcataacattacactagaggtttctaaacttgtagagaaggtccaagtggtgttaaacttggaagcagaaggtcccaaaacatattgagtgctgctcaagtctgcaaacttaaaaaacgccatttatgtcataaaggattattttatctgacagaagttataaaatggaaatagaacagattattggatatgtgaaactaatgcggatcatttaaattgatgttttctatagccatattgggtattgtgactttcaaattggctgaaagagctgacacagcactagaaaatggaggtaagcagcgcacagtgcagtttcatacattgtgacactacaccaatactattttagctctcgtaatttaggtaaccaagcatgtgtacttgctctatcattgccatctgctaaccatgatgagaacatttagatattacacataaaacatatactatcaaaagcattaaggcagatataatgcaacatgctcttaacagtagctaaaacagtcgaaaaaaatcatatagcaacatcaccgagcacttatattccaaaaatatatatctatatctaatgtgtccaaacaaaactgcagttccaaatccatagtaattttggtcaaatggagttattgagataaatcaaaatggaaagtaaacagataattacctccacataatagctaaatgcaaactttatcaaaagaagagcaatccaaaacatggtgtacctggaaaaattgagataagatccttttgttaacatgcaatgttgtatagttactccctccatcccaaaataagttcatttttcacccatcccacgcataccaatacaaaagcaaaagattaaaatacacctattttatctactcccaatgcaattattctccactttcacaaacttcgatgcaataattactcaaaaatgaacttattttgggacagatgaaaggagctaaaaatgaacttattatgggacggagagagtgctagttagtgtgtattcatggaatattcacatactcagttatcattgatacaatataatgaacagtaatgtcaagttcttacatgaaaagtgagaaggcactttcatgcattcccctaccaacaaatagacgaggctgcaccaatacacacaacataagttcacaatgttcaactagatcagaaaataactgcaaaacctatactgaaatttccagagaaaatcagtaagtggcaccaatatctaggactttgatacaagaaaggaattgtataaacaccaaacgagttgctaaatcaatgaaataataatttaatcaaaataatccaaaaaagttaaatagtagtgcgtccaagaatactaatagaatatttttaaaataaaaatgatattaaatgtaaaaacagaactgttagaaggttgtaatttcaaaaccactgtttcctcatattataattgtttacacacagtattatttctttatttctaaataaataatgtttttattttgttaaataagtttactaaataaataatatttcatcgagagttaattacttatatttttgacccaaaaatacattttgcttcgtcatatcaggtctccttctcaggtagtagctcacaactatattttccacattatcttggtcagtagttaactgtagtttacaaagaaaaatcgagaatatcaagttaattccctgcaaaagagattaacaaatttatgcctaaattttcttgatgggtaaaaatgatatgatttaatgagtttaaaatgcaatgttgataaaaaacgaagctatcatgcaattcactaaaatgtaattatgtaaatttacctgtgaccaccacatgacgaacctcacaaacttgtagtctgaactttcaagtatacgccgtagaaatgggagaagaaaaagaatagcagctagcaaactgggagacaaatatataactactgcaaggacaaagagtgatgggtggttttgaccatttccaaaccagcctttgatggccctgataattcctgttggattctcccaggtgtatgcatatgtaaccggcagtaatactacccacaaggctgctagtgtgaactttagaacatatctcagtttaactgcaaattccattgttctcctggccttccaattaaagattatatcaagtgtagctgtaaataccaataagaattattcaaataccaagaaattacataactatggaaatggttgtgctgtcttgtgctcactcaaagatcttatcactacacaaatataaattggaatgactaaatatctaaattttctttcacataaaatatacaggtgttatatttcttccatgctgcattcactgactaattcgcagaaaacatattagcttgttggcataattatttcatgtttttcagaccttgcccgagatttagaatagcagaagtaataaatatgctcagaatcttcttgaaaacaacaggatcaaaaatatttcccagcgagcctccattccaagccagaattaccataacctagtatagaaagatcagtaggtagatgagaataataaaaatggttttataggtatctattattctattgcaaaggtaaatatgattctgaaatctgcaagcactgcaaactactagtattctcagaagagaataacgtagaaatggaggttcatacctgaagagctagaataaagaaactccacattctatcgaaactcctgaatatgtgccaaaaggagcgtagctcaacaaagttgacctttcctttctgcttttcagttcttgtggtctgcaaaaaggcaattacactactattgtttcaaacacccgaaaaaagaagacatgatactgaagtaataactaaagtgggctcacttcatttctttgatcaggtgaatttaaatgttgacaaaagaaatcagcatccgcacgcataggccaacctaaccgaaagcactcagcagacctgcaatttaaagaatgtaaaatataggcaacaggggtacaaaggtgtaagataaactaataccagaaatattcatttagatcatcgtagtttctccactcagaatgatttcctttttctcttttgctcctttcagcttcctgaggaatgatagcaaaatactaattttagcaaagtagtgtaaaacatatattgaataatggaatgatagctgagaacaagatatacctttgcaatggtgaggtaaattggagtaacaactttcttcagaaaggcttctttctcacccccataggctggcttcacatattcacccgtcaaggcactcacatttccaactagcataccatacatttcaaatgccatctatagagttgtaagtgctagagttgtcagcacctcaataagctatcaaagtccaacacaaacattgttgtgggcacagtagaagaaaaattctgagctaaaacattcttcgaaggaaaaaaaaacttatactaacacaataaatgaactccacgaatattggttgatatggttgcaaaattagactctccataggatcaactatagtatcttgatagaacaggtcgtagagttgaactgtagattagtataaattttgctcaatatgaatgattgcatcctcatttacataaaggaatttacttaaactgatgttgctcaggcatacaattagcaattttagctactgtccttaacaccttgtgaagattgatcattcatgaaacaacaattacagaaaaatacttcctctatccacaaatataagcattccaaacgtttgaaatttgtccacaaatataaggattctagagtactacttgtcccatcaatcgcctctcgttcaaaattattcccatattacccctaacgacccttccattcccatccatccctcatttagtgaggggcaccaaagtcttttctcctcaactttaacctctgctagacaacctagaaatgtttatatttgtgggcggagagagtaactgtaaattatgagttgtgtgatctcttagactgaaacaacataaatttttaattcgattttagcaaaatgagatgtcacaacagctgagttgaaaggagtgaatcatatagaagataaacatcataattgagttatcttatgatacagggtttgtgtaactgcagtgttcataattgttaccgtacatcaacatgtagccacttccacattctttctagatgttcatatgatcaatggtatcaataaaatgtgaaacagggtaggcaataagaagatggtcaacatcttttttactagagtttacccggaaaacattttacaattgaaacataaatcacacattaatacctgatgactattaatctaataaccccatgtataataaattttacagcataatgtattgcttaaattattgttagtgttattccaaaaaaacattggttggctaattgcaaatgaagaaactatactccgaactgcttacctacatgtttgttcatgcaccaacccagaactttgtttacaggtcaagtggatgcaaaaacgttgacccacgcacggttaagacaacacaacactaatgctttgagtgt

SEQ ID NO: 88682 - DNA, 516 bp, Oryza sativa
tgcgtaccgatgacgagaggcaggagaagtttatgtctggtcttgatgatgaattgactaactagttgatctctagagattatgaggactttgagaagccggtggataaggctatccgtcaggaggagcactgtaacaaaataaaccgtaagaggaaggcagctcagttcaggactccccaggggaagagtcagaagcctcgtttcacgatgggacgtcacggtggaccttccaccatgattatccggcagcaccgtccctaccacccgggtagcttcaacaagaaccaccatagtagcagtcacaacaacagtgagcagcacagcctcaaccctactccgagttcactaaagattccagcttaatcagttcagccagctctgccagaatagcccaagaggttgggagaaaaacccgaactctgcttcaattgtaacaaacccggacacacggttggaaagtgcccgaagccaagacgtgctggacccaagttcgttcaggcccgtgtcaatcatg

SEQ ID NO: 88683 - DNA, 672 bp, Oryza sativa
ggggtgaagttgcttaccagcttgagcttccctccaacatgcttggcatccataatgtgttccacgtctcccagttgaagaaatgtttgagagttcctgaggaacaagcaagtccggatcaaatcgaaatccaagaagacttgacgtatgtggagaagccgactcgtatcctcgaaaccagcgagagaaggaccagaaacaaagtaatcagattctgcaaggttcagtggagccacctctcaaaggaagaggccacttgggaaagagaagatgagttgaaggccgctcatccgcacctcttcgccagctcttcccaatctcggggtcgagattccgtttaaggggggtaggtttttcacgccctaaagtttcccccttttccttgctttaaaaatttgtaagtaaatcgtccggagaaattgttctaattaacctagagttgaatccctaattaataactgcaattattaattggaaatggcattgtgggatttttcttggtttccgcatgtcacaatacattaacaggatttttagtggaattttcagagccttggaaataattttaaccaattaaaaatcaccaaagtgcaatatttaatcccaggaaaatccttttcctctttttgttttcttttccttcctttttctctagatgggggctgcaggaat

SEQ ID NO: 88684 - DNA, 678 bp, Oryza sativa
tctgagcttccattatctttcttaatgacaggttgccaacaattcagcaggaggtgcaacaacgtaaactgctttatatgggtctgtaccttcttatctggggtgaagctgcaaatttgcgatttatgccggaatgcatttgctacatataccatcatgtatggtgtgaataaaaatctttctgcatcttaaattctccttttacttaaatttatatctctaattctttattttagttgccggattcactttatgaatatatttctcttcagtaggccattgattggatcatgtaggataacgactttatttatagcttttgatgatgcatttgctcgttctcttcatctgccttaaggactgccatggagtactgccctgcaacaaccatatatttcatgatgaataaaacaaacaatgaattattttctgtgaatggatgcgcggagtatgccatgaactgatttggttatgtgcacactcaaagcattagtgttgtgttgtcttaaccgtgcgtgggtcaacgtttttgcatccacttgacctgtaaacaaagttctgggttggtgcatgaacaaacatgtaggtaagcagttcggagtatagtttcttcatttgcaattagccaaccaatgtttttttggaataacactaacaataatttagggctgcaggaat

SEQ ID NO: 88685 - DNA, 848 bp, Oryza sativa
tgttcacctcagtaatctgtaagcatgatttgttattttccaggttattgttggctatctactggccggttctctcgttggacctggaggcttgaactttatcagcgaaatggttcaggtaacatgactagttgacaactgtagcttacaggccacacttctatcttcttcgtagcctattttctccatcttctgatcttatttcactttcttcatgtagttctgttaaaggcaatatcttttgtaaaacgtctcgaccaaaaaaaaaagttaacaggcacatttgaaacaccatattttgtgcatacaaggaccgtattttgttagcctaaatgaaacacattccatacctattcctgtgtttattttacaatacatgacagtattgctaaatatagcatagtccataatggtaatgaactaatgacaacacaagagtaatgccatgtcaaccctaagctgtgctacttgatagaagctctacatttatcatgaatttgaactattatgttcaactgcaggtggagacttttgcgcaattcggtgtggtgtttcttctattcgctcttggccttgagttttcactgacaaaggtaatcgtgaattcattgccattatcttttatctaatgttttctcttttctcaaatatgattatgaaactatataatgtgtcaaaggtttactgacttgtctttcattcatcagttgaaagcggttggacctgtcgctgtaattggtggtctactgcagattgttctgttcatgttcttgtgtggcctaactgctgcggtattaatatttatttattgtccgttgatttttttcgttgtgtttgcttcatcatat

SEQ ID NO: 88686 - DNA, 2012 bp, Oryza sativa
taagtcaaatatccagtttttttaatctaatttccttgctcttgaacaaagctgtgaattgaattaatcaagagatatgcacttttctagcattagtgacacacacatatatgtcattcttctgttctttcttccttttgtttcattaggaaaatgaatgggcctcatcattgggcaatcaatacctcatacctcaatgagataatgttccttgttaccccatattaacaatctttttaggacatgttcagtttgatttcctttttgttcattgtattattaacatttagaatttatacaatctgcgctaatgtttggcctagtcagctaatcaccaccacggaaagtggcttgcatatctttatttacttggctttagccgatactaatagtgtatcatccattacagatgttgcatctgatgaagttgcaatttgtaacaatgatggcaaagatgctaaacttgctaatatctccacaacaaaggtacattaagttaatttctgatcatttttatttttcatgagaaatgcttccgataaaccactatatattgaagttaataaggaaattccattttattcattcagggctcttcatcatcaactgctggaaatgattcaggggatttcaaatggttaggtcctgaatcgcattctaaaaaagggaagagctacaaatccttctggcgaaggggatttacattcatggtacgcctatcaatcattcaacgcacattttttttaaatcttagaggactgaatcttggcttacatccattgtgttcatgaccctttttaggttcacgattttgtttacatcttggtccaacatggcaacaaacttgttgcttatgtggaagaactctatgaggataaccatgcaaacaagatggttcagatacgacggttccgcacactcaactccaccggtattcaactttctccaggtgttaatgatagagagatcctccactccgacaatttgcaagacatcggagttgaatgcatagatggattggcttcagtcctgaacgaagaacactttgagatgtttcaggcaattgccaacaacaccaacaggcaaccctacctatgcatccggcatatcgacaataacagcaatgtcaagacctttgacattgcacaactgcaagggtattcagaacaggagatatttagaatagtctcaggcacacctcccgtgaccgtgcatcccgacgcatctgaaggcagcaagaacacaccaagatcatcagccagaggtcatcatcatcatcggaccatggagaaccccactgctagtgatgagaccaatgttcaggccacaacaatcaatgtccttgcacgcaatgctgcaccaacagagtctgcttctgctctgataaactctgccctggagaagtatcttgagcagtacttctctcatggttgccttgtggaatgcctaagccaggacagtggcattaggggctgttggttcatcggttcagtgattaggaggtgcggagatcgcatcaaggtgaggtaccaacacctccaagatcccgaaacgccaagagcaaacctagaggtatgtcacctaatttcagtaccacttcagaaaatgtagttcgttgctgacaaattttatggtggcctctattggtagtagaatgaatgtacaccttttgttctttcttattcattggaccatatcgatttatactactatagtagaatattttcctctactgatagtagaactcataaattaacacttgagatgacttgtacgattgataatattgatagtagagcactatcgttagagattcaatagtaacttctactgttaataatatgttagagataagagagaatcccttatatgccactgaaaattggtctgatcccttatatgccattgaaaattggctcttcccttatatgccattgatccaaatttgcacaccctctcatgccactcccgttagttgaccgtgtgttgaccgttaatcctcaaggaaaaaa

SEQ ID NO: 88687 - DNA, 986 bp, Oryza sativa
tatgctttatagggtgtctttctggattccttcttctggattccttcttgagtagtcttctgaaatcttcgtttattcttcttccacgcccaaattattgatattctattatcaatatatatgaaaaacatatttagcttaaagaattctattcatctggctgcccatggccaccaagatccattgttatctggaatagtgtagattcctgatcttgaatagtgatctttgtcggggatgacaagatctttattcattatcttcgttgattatcattggtgctgattgtaccgtgtcaatctctgatggttctgttttctgaaaccactgagccaggcttctgtagtaacttttcttggagcattcatttccaaaatccggtttaattatgcgccctgctcccttgaagtattcataactttggttgtagaatttgctgataaaaatccttgtgatcttgttttggaaaaccagctgatattcataatctgtggtgatagcttcttcaatttctgcagcttcagaaaataatctccaattttcatgattagcaactgttgtatatatttcttcctcttcatccgatagtttgctaagaccgtcttcttgaaaattaaattgtcccttcatgatatatatataatgaattgctggacgaacaggtggtgtgaattttggtggtattgaggagaagataatcctgtatcttccatgtccaaggaagttaattttttctttgcatatttccattttctttttggataatattaacccattttgttccacctttctaaaaaatatttcaagatgagcaatatgttctttgtaagtccttgagaagactaacaggtcatctatgtagactaatatgaattcttggttttcgttaaatatattctgcattttcctttggaaaattgctggtgcattttttaatcctaatggcataacaagccattcataatgtccttgaggacatgtaaatg

SEQ ID NO: 88688 - DNA, 5571 bp, Oryza sativa
atataagggaagagccaattttcagtggcatataaaggatcagaccaattttcagtggcatataagggattatctctagagataatgtagtaacttctagtagattactaccagtagagctatatataaaataaaattctttcttttatagtaaccagatggcaagctcccactcatgtccatgaagctcaccttgagttaagggtgcaagcggctacccgcgaaaacccacttataagctaaactaatccgtgaactcgcttattttgacctataagtgggttcacgggtgacccacttgcacccctaccttgagttgagaaggctgacacgaattgattgttctcctgcaggaatggttgcttgtgacaagaaccgctaatcctgacacgctacgcatacgcctctctggaagaacaagaattcgtccccacaatatgtcggagagggagaacccctctacgatcagtgttggcaccgtcattgacggatggttgtatgatggttggtgggagggaattgtgctgaaggtgaacgatgcaaggaggctgctagcttacttaccaggtgaattgtcagttgattaccttcttagtggattcaaatttaacagtccatgatgcaaattcttgcttgtgtttagcttgttgccatgtcaacggagttctttccctcgtctgaatttgcaggggagaagaagatggtgctattccgcaaggatcaactgaggcattcactcgagtggattgataacgagtggaagaattttgctcaccgggaagatatcgcacgtcgaatccctagtgcggaagatcttagaataagagtcattactgcacgagaagttcttacaagagaagaagtaatgaagcaattggaaggcctgaaaacaaacaaaggtggttcaaactctgcaaaaccagctgcagagaagggaagtagcagctctgctactaagaaaaccacacctgatctcattaggcatgcaacaaatgatctaggatctttaaacttcaagcatgtcggtgttcctgcctctgaagaaattagaactgataacaagggatcgcaagttaatcttgaaaatgtcctaaagtcggacagtctaaaatggaccgagcgtaaggctagaggatcttttggtccaagaatgtagtcggatgggatcgttggtagcatcagccatggatacatcaaggaacagagcccctgaggagatcctggagaattaattgcctgatgatgaagtagtatgcaagatcaatggagagccattgccgagctagctgttcatcagatgaaagaacttgcaggatatgaattatgaaggatgatgcatattctctttttcttgatgaactatccaccttctatttttctttatgaattatgttctttggtgtgactttggttcattttctaggttattatgtcaaccacctgaactgagttttggacttctgatgtcaaagtcctgtgtgtgacgcaatccatttggttatattagctccataaaaaacttcaaatatcttttattaatatcatgagtgtagtttagaccatttttatcatccccttgtcatctcatccaatttgaaatgaaatagagtttgtagtcttaattttacccctgaattgctacttctgaagttaatgtcacttgtcggcaaaatttgtttttggcgcaacaaatgaaaaaaaaaagctgagaaagtagcgaagattctttggttaatttggtccatgccactgcaaatgtggctattcagaaaaataccattatcgtctattcgtaaccatgccactccaattttataaaattagaaccatgccactgccgtcaccttttccatccatccgcttcctttccgtcttcttccttccttctccatcttcttcacggcatcggcgtcctgggccatcccgtcggccgccgctctctggcgacagggctgtctcccggagccaagtggtcgtcgcggcagctgccaggtaccgctgctgctccccacgcgcgccggagtgccgccggccgtcgtcgcaaccgtggggttctgctgctgctgctcggccgtcgccgccaccaggtgccagcgcgagaagggaggatacagtgcggtggcttcagctatggcggtgcaaacgacggcggtggcgacgcccgcgctgacatgcggagggagggacggcgcgggctccggcacatggaaggagaaggggtgccgagggagccgggcatcggcgctgactcggcacgcaaaaggagccggggcacggagggatggggcggcggtgctggctccggtgctcagagaaaggagggaggggatggcggcgccagcttggctccctctcctccaagcttgccgacttggctctgggaggcggcgctatcgctggagagtggcggcggatgggctggcccagcagtggaactcggtggcggcgatggccgagcagaagtggaactcagtagcggcgacgactaagcagcagcagcggaaccccgcggtcgcggcaatggccggcgacactccggcacgcgtggggagcggcagcgggagcagcggaacctagcagctgctgtgacggctgctgccccatcctttctctgagcgtcggagccggcgccggcgccccatctccccgcgccacggctccttctgcgcgctgagtcagcgctgcctcccggctccctcgacgcccctactccttccacgcgtcgtcccatccctcctcgtgttagcatggacgccaccccctcccttcgcgcgccggcgccgtcaccgccgtcctctccctccgcacgtcggtgctagaagatggagaaggaaggaagaagatggaaaggaagaggatggatggaaaaggtgaggcagtggcatggttctaatttcgtaaaattggagtggcacggttacgaatagacgaattgtaatggcatttttctgaatagccacatttgcaatgggatggatcaaattaacccaagattctttgcggtcctggtgattcaattgatacagaattttgccgtcacaagacagaagagtctggacaatgatcatgctccctggtaaaactgtcagggttaaaatgagtttatctggttaattgcaactttatacttgattattattcttgaattgctgataccgtgaagaaagaagctgtggaatgatcaaatacatttccatatagctataaaaggtgcacattttctacattatactaatgacatatctatccatgaagtacatccattctttattcttatcaaacttcttgaaacgttgaaaatcttaccacctgtccaacttatcaatttcttgcatccaagtctcaaaccccagatggaacatcatgaactgaattatgaaaagctattgtttttctctgcaccattagcatgtggaggcaggaaaagccgaaatgctctagcatagcttgtatgtacgtatgtcttatcactcacaaagtggcatcacttagtatgcatgtacgcggtgagatcacctagcatacatatgtatgcatactccatggtccatgttttgacttgtgaagaacaacacatgcatatacaataaagaaatcatttattacatgtatctactacatatctattacatctattgtgagatatgcttaaatctatagaaattttaaatatcaatatctctttttagtaaggagtaaatatgagaaaacataaaaaaaaaatacaaacatgggtgcactgggccatgatgcccttgtgctcatctcctgttagctgtacaagtcaagcgctccccttttccaccttgatgacatcaagaagggggttaatagagatagaaacatgtatgcacaaaaataatggtaccaagaaaagaatatcattcaatacaaaaaataaaagtgtatcatgcatgaaaagcacttgttccaaaaaaaaaagaagcaaacatcattgcataatcaaaccatacctacaatacaccaaaaaaaaaagagctgtacatagtgaaacatatattaatgtaaaaaacagaaaggatgaaaaaaatagagaatacatatagattattctcttacattttatagtgattttcttgttttagtacatatgacacatggtagcatccatgcatctgaaaattctagaactttacgttatatactcaatatcttttaaaaagagagtaaactttcactttccacagaaaagagagaacataaaagtgctagtgtacaaattccgtttgtttctctaccactatatgcctactataacacatattttaagaaaatatagcaagaaccacatatatcacctacatctggacttctgcatttttatctaaatgataatcattactacgttatcactacagcagtgctagttttatcatctaggataattcagcacctatattgctttgaacagctgaagagaaatgataaaaatcctggtataaaaagagtgaaagataacatagaaaattgattatgttgtggcatttgcatggataattcttttagtttggccttccacatcatatgctttatgtgattccgtcgtattccatcccttagagtgaatgataagttgctcaaaaggaaagtaaacaactatcgtttgttgtacatttgtatttttatggcggcaccatttaattttccacgtcatatgtttgatctgtaccaccatattctatcacataattaaagaggacaagaacaaagtaggtgtcatatgcatttatccatgcatgactcaattctttatccttccacatcatcaactccacctccaactcattctatccctaagaataaatgaagagataagaaagcttaagatagaaacaaatatcatgcattgtacatgtaaattcaaccatggaccaccaccctcgtccaaatgtagccacataataaatgaataccaaatttcaggtgacctccctaggcatttcacttttaattttggatttttcttatgctagtattaatgccatcaatttttttcattcttgcccttcaatatttctacatattcttttatgaagtactcttacttttctaactacacctctcattttgtctaatggaatataagttctatgtgaccccattcaataattctattgccaaaatatttagaatcaaattacccaaactttttattgattatgacttaatacaaaaaataatcgaggcataattaatgttaagatatggtacgatgctaaggtatgatacaatcagacaaaatcaatattaagtttattcatggaatgtttggattcgagttaacatcttcacacatgtttgtacgatttggttattatttgcttacattgtccctaaatgatgatcttttaagggatgaatgctttaacaacaattaagtatataattgaacagtttcatgaaacatataaacttcatggggttccaattactttatgaaaggcgctcaacatttgctaaaatctgaataaaaccaaaggcttcattaatcaattgagtatatataaagaaaacaaattatgtctatgataaattccaatccaaaagata

SEQ ID NO: 88689 - DNA, 4688 bp, Oryza sativa
attcctgcagccccaatttactaattcttttaaaaaaatattttaaattttctatccactaattatttactatcataaagcacacatcatacaaaaaaaaatatttaatatatagcaagctctctaatcagccaactataatcaaatttcatgcatgcaccctccattctcaaagggcataatggacatttctaagcaaattaacatctagactaacagagacttgacgggaggggtatgcaagggttccaaacaaattttcaagggcacacaagggattcagtatttttcaggtgcatagaagggactgagagagttttgaggtgtacacaaggaattttctctaactttatagtaagataggataagagcataatctgtatttattctctattcatccactatgtttgttactttaataggcatttattatttacaactcactagatgatgccccgcctttagtgcgggatatatgttagatattggagaaatgatgaaatgatttgggttgaaatattatgaaaataatatgagaatgatgatttagcatgtgtatgtttagttttagaattaaataaattgtacacataattactatatgcttgcatgttgagctttgtgtgtttaatgggttgatgtggcatgcttgcatataggttttaggagtgctaataaatactatgcttgtatattgagctttattaggtacttagtgagcattagctttatacaaaaaagaagagattaaggtgtcttctatgtatggtttggatatgtagtatatgtttttttagagctagtgtttttcgtgtgtaatttgttcctttaatatcctattttactataaagttgcaacccactaacgtcacatcatcaccactaacagttattacaacttaaatatcatacaagaatgatatattatctataattttctataatttatttaattttagagctttaaaatgcaagcacgttaaatcatcataacacataattcacataatatttcaaagatgctatttcaatatatctctccatcatactgcctctgtttcaggttataagactttctagcatttcctacatttatatagatgttaatgaatctagacacacatatatatctagattcataacatatatatgaatatgggcaatactagaaagtcttataatatgaaacggaggaagtattttattgtatcttatatacctacatagtccatccttacatagttaacatcatttctctcttctctcgttaaatcatgtcacaccaattttttaagcccttagatgattaatctataatctaaattatcttcctcattttcttctctcattaagccatatcaccttaattatttttagcccttgaaattatctatggtccaaattacctccctaatcttcttctctcgtaaagccacgttaccttaacatttgaatcatcattctatatacttcctccgtttcatattaagattttctagcattgcccacatttatatagatgttaataaatctaggcatacatattaaaatcttataacctgaaacggaggtagtactatttaaattatcataaatcatattaaaacttatgattcattatactagaatatatcacatccagtctaagatttgtttttttatgggacatggtgaggaggtgttttcttcgtgtacactgaaaagaaatgcatgagatgtaagtttattgtacctcataaaccatattcatttaaactcaaaacgtaatgtaaatgggaaatgtataaatgccgaacctaattacaatgctaaaaaccgtccgtataaatcacatcacgatcaaaagggtggttacaactcatccaaatcccaagacgtactatatctccaacaatactacgacagctacaacaatgaaatgcgaagaatgttaactgcacactatagatacaaaaatcagaacaacgttgggacacaggaagcgccgtttagccaaacggggaaggcacaggtccagcaagtgcgtcagatctcttgatgctccccataccacagatgacacaccctggtgcagaaagagcggagaatttggcaccacagagatcgcaaacatcatgaccgatggttgagaggcggctgagggtgacggcgcagaactgagaggggtcttcgaatgggtcgatagatttgtttgtcagccccctctggacacacatgtcgatcagactcttgagctcatcctgcttcgatgggggcgccttggaatataggagatcgagcatttgcttggcataggcaaagttctggacctccatgtttcgcttgatggcagttctgatgcagttaatccggtgcttagcttggataggtagggaagcaaggtggcgagatagcctggccatttcctcctttgcactgagcgcaccagctccttgaaccctttgtaggcgagcaatttcctgcgcaaatcaatagaattaagcaatggatacttaaaccagttccatgagaataattgttcttttaagaccagttgtttcactgactaccatgacgatagagatggaatttttattattctcgagttcaccaaaagaataaaagaagtattgcctagagttcaacatatatttaatcaaagttgtcagaattgaaacatttctaccagataggaaatgatgagctgcaggatatggtacaaaaactagcagaaaattcaccttaggacacacagtgaaaccaataaataactcttaggatatcatgacaaaaattgtgttgttatgaggtatatcatgacaaaaatgaatattacctgtagcaaagcaacagctatcttatactgtgcacaaatagtggcctgcgctttgatatcagcttcacgtgactggtcctttgcaagggccaagaatgcttcatccaaacaagataaagcatccgtaagctgattttgctcaagatgagcaagacccatcttgtagcactctgctgcaggagcaccacgtggaacctgtaatcatcaatggtagtgtcaaagaaagctatggaataacatcaattttgtttaaaatgaaaaatagcaacttaagcacctgtccaggccgcacagcagtaggtgcaggggggcgaggagcctgctttccctgtcctggaccttcaagagcactaagatcaattggttgcgacatggcaggaatagcaggttgaaagccatgtggctgtggaggaagagcctggggttgcgagggaagaggttggctctgtgggggaacaccaccatcaggtagactaatagggtccataggcatgcctggttgctgaggaaactgtgcctgttgcatcggtgcctgtggtgggaccccaccatctggaagaccaacattagccatcatgttttgattatggacaggccgaactgcactcattccaggagcaggttgagcaattcgtgacagaattattcccggtgggggtagtcgagctgcaagctgctgcgatggaatagtattctggaagaaatcctcaggaataggtccagccgtcactcccatgccaccaattacaggacctgtggctccactggaagcttgtggttctactaaagcattggtaccaaatagatcaactgcagcatttggaattgctggaccagcaggtggtgcgagacctggcggctgcataggagcctggttcaactcttgaggcgtccctgataacgatcttgtcctagtgattggaggacctaaacctagctgtttagtggcttctttcagtttgttaacatcaacagtagatgcagcaggcttatcacgtatcctgatgtgtatctttttagtctttgatgtagactcatcttcatcactacttccaccatcaacaacaccatataaagtctttttgaactcctctgctgcttttgcctgttcatctgcagaagcaatttggacccctagctgcctggccagagtatcaccaactgaatcacccccagcatttgccacattcttctgtgttgattcagaagatgctggtctcgcattatcgccactggctgctgcaatagctttaaccaagctcttttcacttacttccactacggtacctcggcctttcatcacgcccaagtaaacaccaatatgatctgcagtgacagatggaataccagcatcggtagtcttcatgtagggcatgacctctcctgcaagctcccactgaggtatactcttcatgttcgtaggtgttttgatttcccagtttcctcctgcccattccggacctttaggcaccatactttctgcagcaaaatttgcaaagacaccttgtgtccatccagttgaacgaactcttagtattctctcaaggtaacgcctcaactcagaatctgtagcagattcttccagcttctgtgaaaggcgtcgcaatgcactaggattcaggtggcatataaacagatctagcatgctctcatgatcagaaataacctcgaatgtttcttttgcactgtcaaactgaccatacctgtagagtttcaatctcattgaaattagaaaaagtaaaaaaaaaaaaaacatattgtatacagaagtaattagctcaacagtattactggccaaaatgacaattgcttgtcacggctcagaatcatgctggaatcattattcatcagcagcacgcacacataacctctt

SEQ ID NO: 88690 - DNA, 635 bp, Oryza sativa
tgtgatagcattcgtttcaggcaacattttagcattatggacctagacacgtcagcattatagcattactacaacttttactttgagggatttgcaggaaaagaaaattatattatattccaatccaactataaattattttccaatcaatgatcatgttttattttgtctaccttttgatttgattaatctaatatacctgtacaaacttagaattgagtatatattctcattcataatttatgtatgaattaagctaactacttgatggcaagaagaatctgactttagcaaaaaatacaaaccaaccttgaaacgcctatatcgtgcctcattattgccaagataacgcttgacaaaatgctcagtgagaaaaccagccaaaccatccaataaccactctgcacaaaaaaaaaacattaaaccgtcagatgcattttatctagttgcgaatactataggtatatattataagcagagccgcagagctgacttaccatcggttgcctcctctgcatttgtgtatatgccaaaccattgccttgcaagagcatatgctactttgatactcgtgtcaattatctgaactatttctacatgttagttagaacagtactaacaaaatgacctgaagt

SEQ ID NO: 88691 - DNA, 3577 bp, Oryza sativa
tgcatagtcagtcatcaaatcaagctcaggtcaacagttttttacagaacagaaaatggcagaagtagacaagtgtcacaaccccaacggcaaagtcccatctcattccaaatactgtctaaatacccagagcattgagagtgaattgtgaggactttcatagtgcccaaaccgtagtgtcatggtggctcaaaatgtagcaaagagggtactcttctttgggacactacagtgcgaagcggggggctattacactgaatcaggattgacgatcactgatccaatcataaagctatggcttataatgtaatccgaacatatttgaaaaagaaaaaatagaaggaaaagaaaacgaaaacaggagaagggtcagaaagtaacaaaacagcacattattgccaaccagttcatcaacagagagcagccaaccagtacaaaacaatgcgccaaccaaccacatgaagccacaaagggcaacaaagccattgatcacaaccaccacacaatctcctgcagtcgccatcacccatgcaatttccttcatgtcaatctttctcctcctccaacaagtacggagagggcatagaaaagagaagataaatagggagatgaggggagaggacagcccctgtcaatgtgtgtgtggatggggtgggtgaggggtttgcatttctggtgattatgggttaaagcaacaaaaatgtattctccacaactattcaatgaacttgaaaagttagtgtggccaatgacatgatagccatatatgatttgtacataataaatactcaatttaaacagaaatgcccctttctattaagctcatgtggtggactggtggtacgtacccacatctgcacaggctggtgaaaatgtatctcagcgagatactccatttctgggtccactctgatccacagtaaaggtgcatccatactgcaatacccagaaattgcaataagtgaccagtgagaaatggcagggcaaaacaaagctagttacttggaaactgacctcgcacggttatcttgatttgaagcatctatgttttcatcagaaccatcaggctttgagccttttttagttttctgaaagcgctttgctgctactttggaatgacattgtatttccaccacctgcaaagcttcaccagccatgggtacaattggatgatcgtacactccatcagtttcatggacacgtacgctcatcattcctggccatccagtatcaccttctcgagaatcaccattcgtgcgaatatcaggaccaggatcaacttttgtggtgcaaccacgtgaaacagctaattcaaccaagtttctcctcttgctataggagattcccaatctttacaagcagaaggaatacacatatgagtaagtatatggagatagcgtacaggggaaaactcaacacgaacaagcactaagaaggttcatttacctcataactgggcatccagaagattcaacccaccttgggaagaattctttcaggaatggccgttcaagattaccgaccttgtttgcaagatgcctgaactgaataaacgaaatttatagaaagaaactcagttgctaacaaagatgaccacagtggttgcactatacaggactaaactaataatataacagtgtagaaaacatccaaacagataatgttacacatcctgaccattttaccatcacattgagaccaaacattgaaactatagttattagcacttgatagtgattactttcacatatcagtaataatagcaacttttgccaaaaatggagcacaaggtaagtaatttgactatttcgctgtttgactagaggaattagaacagcaaacagatcatctcatcctaactcagaatgtcaccacttgtttttatgaagaatggaatacgttggtccatcaccaactcatcctttaaaagttcatgttcttcgataatataaactatacaatggaagcttttgttgttggtggtggtgagtctgtcaaccctccaccatttcttgagtttgtagtatcatttgcagataactaaaatcatttgcacatgtgacttctaataagatgaatagtgcattgacgtctattggaaaattgtatagtgtatagggcttttcgagtttacaacatatgaatatatgatatgcttctttgaagtccattgcaatggactggtatttggatagtagtgcaaatatatggaatagtgggatgcctccaagaagtaccaactcatccttggaaggtttgattcctcaaaccaaacttcccatgaagcatcagcataaacatttgcagaatataacaaattacttcactcattgtgaaagtttttcttcatgacggaggaaaatggatacaagaaagggctagggactttgtagctaactcaagatgatgaacaagcaggaaagaccagaaaataaccagattgatgcaattagtaaaggcacactgcaaaactgcatagttgaaagccatgtactgatgtacctcttttgtacttagtgttcttgaggcacgagttggagcaactatcatctgcagaatctgaaatcaggaatggttacagcctgtcagcatggctaagtacaagatggccaataggaaaacacgtaacacagagagtacatgtagatagggatagtttactcaaaatgaagaaaatgaataccagaccacattaagaaacttaagaaaaaaatgcataaaaagcattagcatctacagttcagccaatggtgttcaagaatggtcatgtagttcttgcagctgttcatatgtatcatagacatattacttcgcaagaggttagaggtacacattcagaagtaatatcaattgcttgagcaaactgttgcattcatttaatacagcaaattgtaataagtacatataaagaagatgcaattgctaaccttccgaaaagagtctggccccatctgtttctccaacatttgaagaacagatacctgtttaaaagaaaaaaagtgagggagtaatacatttatgtcaactgtaaacttgtaattcaaaaggccaaaaacttactgccttcaaagaacgaattttcccatatgaaccgattgtttgagttccaaataaatcacttgaagctgaaggagagctcaaagcagttgcaccactgacatcaaactcacacacaatgcaattggcctattacaagtacagattgataattaacaagctggaaagacaaaattaagatataaataatgttccaagaaaaataactgtgccagtaaatcccttttaccgcccgacaccaaccgttaagattaaggtgaatgaatgcaagacaagaagcaaacacataatttgccagtgaatttggttggaaggtgaatgacaagttaatatgtgaatcaacaccaaaactgtgtgcaacataactctcgtgcactggtttcaaaagcaaagtaaatatggtcaaatcagcagcaacatcctacacatattatgatatagaaataaaagaaatgacacatagctataccaattacaactgaaagattctttttaagtgttctaattaactaggaacatt

SEQ ID NO: 88692 - DNA, 1073 bp, Oryza sativa
agagaaaaagatatggagaaggtactgtgaaaaacgaaggagaaagagaaagaccagctagggcagcaggaaaatggccccctgatagagaagaattttcatataactatataccaggtcaatataggcatatgggtacaaagagaagagactttgagaagcctgttaaatttcaaaaccagaggagtgatggtgctatattaaatttagccgcacatgaccctattgattggcctaatattattagtatttggaaaggtttaatagttcaaaaatatatacaaaaccagcacaatataggaagtaaagttgaagatatgataacctacttagaaacatttttaggtgaatctgctaagattctatgggaacaatgggttgaaaagaatcctaataattatgaagaattgaaaagagctggtagcaatccgcataattttgcaaatgttatatctaacattattatagctgaagatccggaattaggttatacaactttgcaaaatgaaaggttaaaagaaatagaaaaattaacgttaacaagttggaaaggcataaaagaattctcccaacattatttatataatgctacaactgctaaacaaggatataacaggggaatagttgaacgttactttaataaattacctgacccactaggaagtatgatatttgaagaatataaaaaggaaactgaaggagctgaaatcaatatctctcaagctataacttttgtgtttaagcaactaagaaaaatatgcacgggtatccaagcccaaagatctatgaaacactcggattacaatttctgcaataaaatagttcaaatacccttgtcatatggagaagacaagcctagaagtaaaaggatttataaacatcaaaatagaaaccataataatattagaacaaagaaaagatatttcttaagaagatcagataatagagcacccttcttacataaaagaaatgtaagaagatataatccaaagaaaacctatgacaaaacatgcagatgttttatatgcaactcgccagatcatttaagtagaacatgcccaaataaagatcaa

SEQ ID NO: 88693 - DNA, 727 bp, Oryza sativa
ctttgacatgcttatcttgctctttcctctttatctattctatcttggtttcttggtttttaaaaatttctactgccatatcttcgttcttctttatgcatcttaaattcttctatgtctttcggagttgcttctattgggctagtcttaatgatatattctgggttgattatattaattttacactcaatagcatttttctcccaatatttcataggaatttctcctataatttggatatcttctaatctttgaataattttttctatatcccttttagacttaatatctctataccaatttggtgcaaatgcttgtagtcctatgcactctatattggaatttgatatataatagttgtctatattctcactaagctcatattcattaattctttcttcagactcaagattaggtacttctaagttgtcgagtttgggggagactccaccacgctttcgtacctctgagatatatggaacattattttgatatgggataaaagtaattccttgctcatgtattactgtggtttgtactgattcttgaaggaaccttaagccaattatcatgtcatcattaatcattgacaaatctcttattgtaatctcatctattatatatttagttgcattaatgtaaacctccatattatatacatgtatatatatatgtatatatatatatgtatatatacatatacatatatatacatatatatatacat

SEQ ID NO: 88694 - DNA, 1119 bp, Oryza sativa
agatatccactgtgcactaactggagtgctcaatttatacacatatgtttttcttggaggatcttccttgcttaagacctgcatgatacaagtacaacaacagcagaatgtgcaagcacaaaggtcagccaacatcaaaaaatgaaacattcatgcagttgatcattgtgaaatggtataatatatctattctaacagtacatagagatatcatcaaagagcattatcatgcttgtcatggactggctagggtaagggtctgaaagaccagtgtggatccactcgccctctaatagcacaggcagggctctgaggcttagggttcagagattcattgcttcattggtaagagtacatggggtccatttatatatagggaggagactagacatctaaggaactaatctctaatattatagaaaccaatccaatctctctatctctaatttattaacatataactgataactcatctctttcctaactagataatctcctactttgtttgattattcctaacctatcctgcctaaccttgccgcatgggcttggcccatggccataacaatggtagaataaggccgacatatgatacttcctcgttgaaggcatttgttttccattaggaggaatttaatagtatatgtttagtttgcatcattaccagtcttgattaagtgcatacctggtaaagcaagtcaccgttactgacagcaactagattcgtgctaactgtgaactctaggtcaaatctggacatggcatgaaacaaagaaaaattgttaaccagcaccagcaaacataaaagcaaaattgagaggcaagaattttcacttacggacagcgctgtgttgcactatcaatgcaaggaaaccagcagtgtgcacgccttatttgattgttactatgtaagatgttgccagtgaagtaaagtccagtttcagccttctccaaaatataatctatgtgaaccagttttgtgttcttcacctataaagattcacagtaaggcaccgcatccaaaaatgtaacaggaagagatactcaacatgaactaaccatacttatttttaccttttcaatctcattatcattttccttgtccttctcatttccatt

SEQ ID NO: 88695 - DNA, 1216 bp, Oryza sativa
ttcattcgattgcatttttcctacatctttcaaaatctaagaacgaacaaaattggtaaggacgtcaacagaaagacgctcacagttgcaagtttgcaactagatccacataatttctgatttctacagaatgcgttgccacagtttgagaagtgagaggtaatttctacaaggaatcctgggctattgcgttcctattgcagcatgatggggaggtgctctgagaagtcctgtatcggcgataactcctggagctcgtaggctgcctggaagcagtcggccgcttcaagcagtgatccttcagatttcaagacgagtccaaggcgcagccaggcttgatggcttgtgggttccaaacggagggcattacggaggaacgttcttgcgatcgacaatgatttccctccaagaatggttagaattcctgccatgcaaaccatgcttgggacatagtctggatcgatggagagggagagcgagaacgccgtcagggcttcctggtgcaaggactgagcctgcaatataaggcctgcaggggaggctatcatgttagcattctccaaaatcataagccgtgaaatgaataactactatgttagatgcccatagtaccaaataatctgaaaggtgcattcccccagttttttttttttgggtttaattttgctcagacacattgactaaagtctgccagtcacaacaaaattttaccaagcactaataatatagcttgaactagtaacacgagtacacgacaccatcgatcatgtttcaggggaaggcctatcttcttctggatgcagccaaactcaaacttcttctgtatggccaaggcagaacctgattttctggaggtgtttgcaaatgaacccaatctaacattgaggttctttatgctgcacataaatatattttgaagtgcttgagaatatttacctctgacatggcagcacttgggagagaaagaactgatagatttggctttgtcaagacagacatttgagtcatgccatgattcaagcttcgtgtatattgacgccaaatctaaccatgcttccatctctaaattctgtagggatttaacctgcaaaggccaaagtgtataagaaagaagaatacaacacaaacattttgagttccaaaaagaggtgaaagggacaatgtgatcgtaccttgtcataaggggtctgcttccagatttctttctttgcttgga

SEQ ID NO: 88696 - DNA, 805 bp, Oryza sativa
cttttaaattttgatgagcagataacacaagaatcagtaacttccaggcaataactaaacttcccatcaccatctcaacgcattctgttgcactttcaacagctgcattcagtttacgctgcattgcattttcccaagcaaggctatacataatttcagggctatactttgccattgcagcagcatcctgtagcaacctcagtgcttcatcttgtaatctcaatttttctgcatgagaagtggaggatctagcaaaaggtccatagcaaacaccaagaagatggtttacaacactgacaaaatggaaatcatgctttctgaaagacttcatggctttatctgcaaattttattccttcagaagcacgctttgggttcttacaacatagtttggctcctaaaagaagagatggaatatgaggcttccctttcctttctaatacgttgaaaccgttccttataatgtttaaggcgctatcatccatgccagctgcactgtagcagagcgcaagaatataccatctttctgatcggttataggttccaggcaacaacatttccagatggctagccaagatttcataatggcctgataatgagagtgcaaacatcaaatggttcacaaggtcaggatcccactttatttcttgaagggctaacttttttgtaagtatcagcaacaacaaaattgcttcctccatgttgttcctaggagttgctggcttgtgttgatcaaattcttgagtaaacttcacttgagcaccacaatacagcagagtcactgctaaatctttttgtaaatttgc

SEQ ID NO: 88697 - DNA, 1285 bp, Oryza sativa
agtttaaaatattatagtatcatactgatgaacagtatcacaaagactatagtgatcctaagttatcaggataaaataagattgcaagattaagatagatgctcccgtgttcctgtcccccaatagctactacccaattacttactgtggtttgcacactgcagcatgaaccggcaacaacaaacaaaaatgaaaatggacggtggtgtcacgcaggcagcttgaatggtctgtgatgagtggagggaaatgagaagggaagaaaacgaaaggacagtcagtctattgtcagggtagacgacttatctttactaagtttctccagaatacatacgatgttggagtacatctccaccaacattttgtgacccatctaaacatacccttcggagaaattataacctcatttagaaccgtatcatctttatcattgttagcacctttggtgaaaacaaattcaattttagtaatatggagtatggcctggataggatcagtctgattgaactaccttccaaaagaattagtttagtttggggggcaagtgtgttaaatattaccccagaatatgaacactacgtgctagagattaccaagttgtgatttatggaacaagagccaaaggctgcagatcaccaagtccttctcatcttgattactaagctcattttcttgtttgctccttttcatcttgttccaaatccagcagattaatttgatgagctttaaatctgcaaaataaaggaaagaattcagaaccatcctgtttgtttggctcctaagttaaaagggtagattgaaaaaccttcagcaacagccatattccctttccgttctgaagggtgaaaattcagtgcataagcagtcagcaattaatagtacagcacaaacccaagatcatgcagatgatgcattggatatcttatgcagaataagacggatcaacatcaaatgctccaaaaagcctttagcaagtttgactagattttgccctgatactggaagtgtaatttgtagtcctgcaccagatttgcaaaagttgttcggcatggaccctctgcaaagccaaagaatgaaaaaaggaattatcttggggatcagtttgtatttatagtagttacatttgtttattcgtaaatagattaagcattttaagaaaaggttaagcaggagttactgaccacccagatatgtgtggagcagttgaagatcactttcctcgcagatatcgataagcgaataaaccccaggtctcaaggcctcatcaatttctctgcgatgtaag

SEQ ID NO: 88698 - DNA, 586 bp, Oryza sativa
atcttaacttacaaccaaagatattagaatattgctcataacactccttttcctgaccaaagcaaaataactcacttttgtgaaaattaattttcaagccagataatttctcaaagatagacataatcaattttaaattctttgcttgttgtaaatcatactccagaaaaatgatggtatcatctgcatattgcaaaatagacaaaccatcatccactaggtgaggaaccaccccatgaagagatccattatctttagctcttttaattagtaaagctagcatatcagcaactaaattaaagagaattggagatagaggatccccttgtctaagacctttatgcgtttgaaaattattaccagtttgatcattaactttaataccaacatgaccaccttgaataaaagaggcaatccactcacaccatttagtagagaagcctttcatcctcaaagtctgttgtacaaatgaccatttaaccttatcataagctttctcaaaatcaatcttaaaaattacagcacttttgtttttacgatgtaactcatgcaaagtttcatgctaaataaccacaccttccataat

SEQ ID NO: 88699 - DNA, 744 bp, Oryza sativa
gcggccgcactccactagtggatccccctttatttcaaaagagagatcaagtctgcattcggggaagccaataattaattttctatggttattttgtgaaatatgccatcaacaaaataaagcattccgtatgccatgtctgcatgttgctgcagaggtatatatccagacgattttgagtatattacttatataatatttgtgggaaaaagtatagttggtgaaacttcatcgagatagtttcttacattttatttttctaaagtttgagtacatatgtatatgtatttccatatcaatgaagctcgtttatcttctttagtatgacagtatgacaaaaatgctacaaaagtcgcatttacaatagtgattgttttgtgaccacaaattgttcaactatgacacctacagatactataagcatgatgcattggtacatattttagcttactcagaaggcagagtgcccacaaatcatgttcatcccatctccagcaccgaatgtgtggccatggataaaatggaaatgaatccaacttcgagaagattaatctatgcttcacgtcgtacaattggccaacaattaaagttttatctaatatcagttatccgtgtgttgcttcggataatagaaatatatttaatattatctgaaaaattaaaatttgctttctattaaatgtgttaataatatgtttggtaaagggaatattgatcctaatttaattttatactccctccgat

SEQ ID NO: 88700 - DNA, 783 bp, Oryza sativa
cttctgtgccgatgacctcggggtcggaggacgacaggagcggccttcccacagtggcctcggggccgtcctgggggtcgggggctcctggcgtcatcggacaagcgggcaaggggccagctccggtcgtcaggggcctcaggcctcctttcggctcgggggcctcttctccctgctctctcccgggtcgagtcagcacagggttagcctcggggccaaagggcgataagtgcggccttccctcagtggcctcggggccttcctgagggtcgggggcacccagcaccgtctgacaagcgggcagagggccgactccggtcgtcgggggccttaggccaccgttcgactcgggggcctctcctccctgcctgctcccgggccaagtcggcacagagtgggggtgcgcagaatgaggattgtcctcatcgcgctccacaaccaacgctgcactaactacttggggggtcgctgctaagtaaagtaacagggactcatttggctccggggcgactagaaccgggggagagctaagatacgcctttaactgagtaagggcatgttcagcttcctccgtccaagtgaacggcccggagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaagaacccgagaagct

SEQ ID NO: 88701 - DNA, 683 bp, Oryza sativa
gggcggccgatctccactagtggatcccccctgggagcccccaacaccgcgcctcccactccaatccgccgctccccctactcccgcctccccatcgccagcctcctgccagatccactcccaagaacacacaccaccaccagtccaccaccaccaacccaagccccgcgcaccaacccggaaattttttccgcaccgactccgccgcttggttgggcggaattgctccgccgccgccgccctccgaccgccggtggatggatggattcgcgcgcaaccgtcgccgaaatttctggtgcgttcttggatgcggcttttcttttttcctttgttttactttgggcgttggagaagacgaagaaagaaaaaaaaaacaagaaaaagaggaggatttggattagctgtgccagagggaagcgagagtaaaaggaagctgctttggattaataaatgcagcaggggaagcaactggggagctgagctgaggcttggttttttttttcctttctttttcttttctctcttgttgctttatggttggattggagaggcttggagtttatgggggtttgattaatgtgctgcatggttgaaaagaggatttggccgtgacagtggtttagtttgggttttagttaggatggtttttttttctttttttgactgatggcatcatggttaat

SEQ ID NO: 88702 - DNA, 801 bp, Oryza sativa
gggcggccgctctccactagtggatccccccgaggcgatgatgagtcgcttcgctcgtacattcagcggttttgccaagtccgcaatactataccatgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggcccattccggcgacgaggggcacgtcctcgccgtcgagggcgctccgcgggccacccgaaaggggaggcctgcgagcgacaaaaagaaagaggctggtactcccaaccgggagcgcccagccagcaagtggtgctccgtccacaacacctccctccacgatctcgcggactgtcgtgcagtcaaaaatttggctgagcgaacgaggaagtgggaggaggacaggaggcaggaacgccgtgagggcaagtccgcggcagttccctccggtagacggcgaagtgaggccagacagaaggcccccgccgttgaccccgatgacggtgatgatgacctaggtttccaagaacctggggccaccattgccactgtcgacgggggagcgtgtgctcacgtttctcgccggagcttcaggctatgaagcgagagcttctagccgcggcccctactcatgaggcgacgc

SEQ ID NO: 88703 - DNA, 812 bp, Oryza sativa
  unsure (1)..(812): unsure at all n locations
gcggccgctctcaccaactagtggnatcccccgnagnaaaaaaccaaagaacgaacaaatgagtaagaaaaaacttctctttgggagaaaggtggttgcaatgagagtgagacgaacctgcgagggggtcggttgaatgaccaccttggaggagaaatcaggttcccccggcatggttccgtctcccccgttttgcggagccgtttcttcttgcgctccccctcgggctgcgacgtcggcgcggccccctccgggcgccgactgctggcacgcgccgccccgccccctcggggaggagatgggggaggtgttcctcccagcttcctcttcccctgggcgtcggcagggcggctgctccccgagcccccggcgcggggcccagaagcacgaccccctcctggggcagattgttcccctcggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccgcggagctaagattcagcaccctttggaccacgatcttgaagtcctcgggagcccaatcccatctggctccctggtgggtccgcatgtagtcttcaggcccagtgtactcccaggcgttccgggcgcgccgttggagcggcgcaatccggcgacggaggtaatcgccgtacaccatggcccccggtgagcccctgggatcgcaggcccgccaggcggtcgaggacggcgtcgtagtcctcccccagatctaccg

SEQ ID NO: 88704 - DNA, 769 bp, Oryza sativa
gggcggccgctctccactagtggatcccccgtaatccccgaaacctttaaggccggctccgtctacaagagtggcatccaggtccagtaatggacatgcatgtccttgcattaggtcacatggaaattattagcctctaaataattatctattcaaaagagagaccgagtctgcatgtgaacacgtcaattgttaaatttctattgttattttgtgacaacagactattgacaaaatgaagcataccatgtgcccttcccacatattggtatggagctatatgtgcacacgattttgaatatattgtttatgtaggatttatgggaaaaggtatatttggccatcattcatcgagatggttgtgtacatttgattttccatagttctaatatatatggttgtgcactaaactacaccttggatgcgcaccccaccccctctcccctcccgcaccttttctgttcccacatcttcttcccgcaccttcctaccatatatcttccagcttttgttaataaataaattactctaaactagtctttgttaagtaaataaattacttataagcaattgatcttgccataaaatctgcatttgcgtccctttcaaccttcattcagtaaataaattactcctaactagtctttagtcagtacataaataacttaaaaacatattggtcttaccacaaaatcttcattggcatcccaacctttcttatcacttggcaaactatctgcattggcatcccatcatttctcatcactcg

SEQ ID NO: 88705 - DNA, 780 bp, Oryza sativa
aaaaggtaaacatgatggatgttgtgattggttgagatgaggaagtaggtggagaaactaaatggggattggtgcgattggttgagaggtggaaaggtagctaaattttggaacaaagggaatagtttgtaatatgacatgttcataaaagtggataattagttgaaggaccactggaaaacaatagtgtgttctcaggtgcaactaacaaaatgagcaaacttgctgaagggcagtcacccctttgtctgtgcgcccagcaacaacagcacagccttctaatggcaatgatcttgcttcaagctgtttagctttcttctcgtcaacaaactggccaagatgtttttctactaacctgcaagaaatacagagtgcaacaaatggttttatcctgtcatctgtcttgagatgcaaaggaagtgaagaataaaagtgccagatatgtctatagaaatgacataactccattcttatttatccttacccttgaacagtgttgaggccaggctgcttctgccaaccatcaaatgaccccccatgatatgaaaggacaatcttgaaggttactctttcccatcgtcctcctcgatctttggatgatttagttgatgtttgattttctgatggtgctgtgtaatcttctccattcgtatcaaggctgtaaccattctgttgaagaaaaatccgataaatcttactgaaacaaactaaaagtactagaaacggacctgcaccgacaaattccaaaattgggggatccactagtggagagcggccgcc

SEQ ID NO: 88706 - DNA, 796 bp, Oryza sativa
aaggttgtgtctgtgccgttttttccttttgaagaatcttgacttgaaataatgtcactcgtgctcaaccttgccctcgggggctcggttcggtcagctaaaatcgccaaacggggcccagaaccgagccgtgccccggggcgtggtgaactccgggggggaatcggcaaaaacccacaattgggtcacccataaccctcggtcaccacgttcccggcctggccagtctcgacatgcggatctccccaggcactagccccgacccgcgcttttcgaggactgggacttgggcatgggcccttatttcaagctaagacgcaaaaagaccacggcacagatcatcctcatctcacatatagcaaaataaaactaacacaaaaattttttcatcatttctcattgcagattaagttaaattgtacaaaaaagaggcatgaaggccttagaagaaagaacaagaaaaaagttaagattggcgggggcctgggggctcattcaaatgcgcccgggtcgccggcctcgtcgccaccgtcgtcctcgccgctggcgtcgccctcctcgtcggagctgggggcgaacgcgagccgaggggccgagccctcgaagccgttgacgatgtggtcagcagcatccccgacgcgcgcgcgcgcgttgtcctcggtcccgggagggaactcctccagcgccatccaaggagagaaattggggtcccgggcctggtaactcgctagcacgagttcaaccgccccccgggcgaggtccctcgaggatgacttgatggtcttctcgagctcct

SEQ ID NO: 88707 - DNA, 694 bp, Oryza sativa
ggcaatccatccgacacagcttgccagatgaacgagttgatggagaagacgtcccgttaccttgctgagttcgggacgggcggtcgctatctccaacttaactctgtgagttcggcgactgacgaattgccgacgctggagcttccaaagtccacgcccattgaacgtcgcaatgcccgcatggtggaggaggatctattaagcatccaagattgtttgatggagaaacccctgaacaaggagggcaccatagagtacattggtgctgccaccgctgcatgggaaaatagttacgagcttggacgccccgcagacttggagaagttgatgtcttacttgggggcacttgtgcaacatcttaagggagagctcccagtaacctttgaagggagaactttagctgctcatgaaggcgaggcgcgctcttccttagcaaagttagagagtgcgtgttcagacgtgctactagaccttgacctcctcaagagtggccgtgaagacgtggccgcggatcttcagaagtccaagcaagcaagggctacctggaagaaagaggcggaggaacacgagctgaaagccaaagatgcgagggagaaggagcaccagtgtttggaatcagaggaggcagccgccaagaaccggcaagtttatgatagtaccatcgacggcgtcatgcaacgggggatccactagt

SEQ ID NO: 88708 - DNA, 624 bp, Oryza sativa
ggtggtatggagttcccaactgattgtgatgctggaaagtcctttattctttcaaagtttggcaagagcgctcttccatctgtgagattctttggtgataagttcatccgaaaggaaactctctctgatgatgaagttattacttcatttttgattgttgcaatggcttgttttctttgtccaaactcttctttggtccctagcaccaagtatttgactgtgtttgagaatgttgatgagcttcggtcatatgattggtcaaaatttgtgtacgaatggatgatgacttccatcaaaaagatccaaaagtttaataccttgggtggatgctggtttctctgggcagtaagttattaaattttttttccattatctttgttccatattattattgttttttaattaatttttctttgctttttcatattttattttgctaggtgctttatctggattatgttgagtttggtgacaagaatattcctattggttttcctagaatttctcactggaagaataatatgattactttgtattctgaccttgacaaagttgatgaagaaaactttggccttaggcccattaaggatttcaatgatacacttatttcaaggtacatgttca

SEQ ID NO: 88709 - DNA, 812 bp, Oryza sativa
tcgagctccgctcgttctgcacgcagggcctcactggggtgttgaacccatccagcactgcggtgtttgcggcggccagggcctgcagaaggggctcggcgctcagcggggcgacagaagatgaggagaagagccgcctggagaaaaggcgacgcggcttggccccccggaggatgcgctgggctcggggatgtcccccgggcccgtttggtcctgggcgtcgcccggtgaggtaggcccaggcgatgcgcccgcggcctcgtcgcgagccgcctcggaggatgtcgcctgagggccgcccaagggagtaggcccaagtgacgcgccagcagcagctgtcgcctcagcctggcgagcccgggcggcctcctcccgggcagcttcttcggcttggcgagcccgggcggcctcctcccgagcagcttcctccgcttggcgaacccgggcggcctcttcagcttcccgaaggcgggctgcggcttcacgccggtcagactctcgcctccgctcctctgcggccgctggatcttcggcctcggactggccggatttggggtggcgggaggaatgcgacgggacatcgctgaagcagaagaaaaaaccaaaagacgaacaaaatgagtaaaaaaaaacttctctttgggagaaaggtggttgcaatgagagtgagacgaacctgcgagggggtcggttgaatgaccaccttggaggagaaatcaggttcccccggcatggttccgtctccccctcttgcggagccgttcttcttgcgctccccccggggggatccactagtgggagagcggccgccc

SEQ ID NO: 88710 - DNA, 3284 bp, Oryza sativa
ctccaatgtccatatagtctgaatcagctgcaaccaatcccaaatccaagaaatctacgaatgccagttaaatccccagcttcgccgtggactgagaagaataaacaaattaaagtgtacaatgaacttaactataatgaaggtggatgagaaggtcagaactgcacatcccactactatgtagcagtgcatcctcatgcataaaaacatatattgatgaacaaagtctaaatgctaaaagtctaaacacaacacatgaaacaccaaaccgtataatcaaatgtgcttaatagaacggcataaatataattcaatagattgacattatacgtaaccaatgtcataagggaccaacgagaagctaaaattggaacatgtcatcttttgtaaataaaataacaaaacagctaacatcttcatgtaaaatctatgttcttataacatagatacaaaggcatgaattatgcatggccgtctgttatctacatggatatagtaagctagttctatataacgctcaggcaagacaaaaacacatcctgggttcgtgcatgtggattatatttatataaattagcacctaagttgttcttgtgaacaaaacctgtataaacctaaaattagtaaaaaaaggaactggaagaaaacgaaagatcttcccatggaactgataaaacacggtgaagacataaaagcagaggtaaacctatagctcatgcggggcagaaggaaaacaaacaagtgaacaattcataactctctttttttattctaaagcagcacattagcaaacacatatgtatagtggaacatatatttgaactgaggctattgcatcctgaaagctcagcagctgaaaaaaaaaaagaaagcatgcacaaagtgtagggcaggcgcaaagagaaccaaaaacaacaggaaatgtaattttcatgcacaacattcaggataattctggtcgtaatgcaactcaattccaaaatcgcatgtatctgatcatataaaccacactcttatgataaaaaggctttctggacatcagaatatcaatagatataaaaacatgtaatcaaatgtgcaaccatttagcagcaacttttaataataacatgcacagtttttcatggaaagcagcatgaaactcaaatttcaccttcctattaatgaacattaataggcaacaattttccccagatctcaacattcttccacagcattagtcatgtataaaattaacgataatctgtatgttttttcatcgacttaaatttatgaccattatcataggataaaacaaaacactaagttttaagaaccaatcttagcatggccgggtctatcatcatgtctcttacaataagtggcaagaagagtagcgcattaccttgttagttttctctgatgaacaagtacggcaccatcacactggagacaataggaagctcatttattcgtttgcctcaaattgatccagtagaaaatacgataagaagcatcattttacaaacttaatcataaccagaataacaataccaaagtaatatttgtgatacacataatccccaaggcccaactacaaacttttaggtagagcaatatacaaacgcaatatcaaaatctatatcacatcacatacagtttccaaccagccagaaatgaggaccagaatacataacgaaaaggtaacgccaaaatcataactgaaaaggtgacataataaacatggtttgctcatcttagataagcatcaaacacaaagactatgaggaaccacaccaaacagtttttttttaaccatggcctcaacatgtatccagttaaatagattgaccgaccataaagttaatcagaccatctaaatataattataatcctggcctatgcgactgatctaggtaggtccactcacccatccgctaatacgttttttccttccatcttttgctgccaccaaccatagagtgctgtggtatacacgctagctgtttggaacgaagcctgttgcaatcaaaccgagaaatacctttttagtctttaaaaaccagataaaccataaattaccctatcccaaacatcgccacataaccattaaaaaatgaatataaaaatgatacaacgcactaaacaaaaccttgaaccctgccatcctccaacaatagaaaagcacaggaaaaaaacgaacaaccattcaccgatagaaaccgagctggacagaaaacgcaattgactcttcccatatcacccaaccataaaatctagccagcttacattatgctattaatcatattatttttgcacttccagaaagagcactgcagtaacagatttctgactaaggcatcaattaatagagacctgaaattataacttcactctgctgcaacaattaaagcgcaagctaagatgttctcccatacaaacggaagcaaataatagggcaaggtactctcttgactgaacctaccaaaaacaaatattcaatgtcagcaaagtgaagtagctttattttattttggaggcaaaaccaacacctgtagtcattctgttttacctatctataatttttaaaccaccttgagcagcctcaatcgatacgcacatttcttgcaggtgatcttccatgtcttctgtcagtttgtcatagagctttggcccatgttcgtgaagtgccagattataagcagtcctgccagaatataaggacaatattatgttctggtacataagaaggatattggttccaaacaagtaaaaatactatactgtgccatgaaaggctagtaggtcagacatgataccatggaaagacctaataatactaacgaaagtatttccagaacgaaagaaaaaaataattcaaatatcacaataacacatcacttaagggcaagcaaacagggcagttggcctttgcttctctcttaaaattctatttattgcactttttaagagtaaggggcatagcgactacagagttccattgaacaagttgtatgacagaagcactatctacagactacacgaatagtaaaagcccatgcttgtgattgtagaaatagagtttttatgtaagaaaaataacaattttccaccgaaaaaaacaacgatgtaaagaagaaagactttcataagtattttgaggcattgttcagctaatcttgtttcaaggggataaggacctgtttttttatgtgcaaacaaatgcataacatagaccacgctgcacgcaaactctcaagtgataaaaattgatccgagatgaatttccctagatgtaataggcg

SEQ ID NO: 88711 - DNA, 1428 bp, Oryza sativa
  unsure (1)..(1428): unsure at all n locations
cccaccgggccccgccggtgatcgacgcgcccgccgccgcggtcgagttggcgccgtacccgggcgcccccacggtgtccagcttggcgcggatgcgcgggcacccgacggtggcgtcccagtccgctaaagccgagagaagctacgtgaacggcgaccgctcgcgggtgccgacggcgtccagcgccgtggcgaagagcgncggcgccggcncgncggagtagnagnagatgnacgggagctcgaagtagccggagacgaggaggaggaggatgacggcggaggccagcatcggggccatgtagttgatccgcttcgggaagagcatcgaggtggcgcgcccctcttcttcctccggaagcttctggaagcttcgcctcctcgccggagcgcgagatctcggtctcggaggagggggaggcgataggtagaaggattcaggattaggtggagtggaattaaaagtttttcgaggggctcttttggaaaagatgtcagttcgcgtatcggaggtttatttcagctacggtgttttttgcgattaggtccttggaagtttaagattttacagtgaaaagggtggaaggttgtcgccggcggctgccggtcgtttaccaggtgagaattacgatggtgttgactttgaccatagatgggctgggccctgcattgaaaggccaggcggcccaggcccaacgccaaaatgtaggagtattattttttagatttttcataaacctccatccatttcaaggttgacctcacttgacaacttctaacttgtagccaatgtttggaaatgggtttgggatatgatttcccactcccaaagagtaagtttcaattttagccatccattcatctcaccccatttcatcctatccctctattcatttttatttctcaatcccacctctcataagtcataacccattttccaaacacacatgtagagagagttgtacgaatttatgcctctcccttcccaattcctctaccaaaatccttttatactatttttccccgtagtttgcagaaaatcatcaaatgcagaaatgtttgcaacatcatctgcataactatcttaataaagaagtgcatataagatggtacaagatgggaagaacaacttcttccactttagataacacaatgctattacaccatgaaatacatacgtcatatatatatatatatatatatatatatgatcatatgcaactcgctacgcatcatgtgcaccttcacttgtcaccattctcctcctgatgatcacccgcgaattgctcggatggcagcagcatcgcgagcgaagcatccaactgcccgaatccgaaatccatggcgccgaagcttcccgcggagaagaactcatccccaccaccggagccggacccgacgccggcgatccctttgacgtcaagaaac

SEQ ID NO: 88712 - DNA, 6578 bp, Oryza sativa
ggttcctctatacaaagtgcattcccatcagtagttaaatttgttactccttttgcccctcttctagcggtcttaacttcatcacttctggcgtgcaggtttgagttcttgtaacatgttatgttattggattttgaatagctgaaacagcacgcatttttagttttttttaccatttttttattcttatggacagcgtgttctctgagaactttgtacggctgagatcaacaattgctgatgcatcatatgggaatggaggcctgttttctggggatattggggttgtgatgctgtctgtcttcttgctgcactgtgctggttttgttgtcgggtgagcactggactgtttgctatagttatttttttatatgaaggaattacattggttgtgtgaatagtagaaatttttgtttaagaaaaactgtaagggaacaaatcgtgatgtttcatccttccattaattcaaccaaaatgttatggatgcttgtagtagttagtatctatcatccagatttctgattgtttacataattttaccacgcataggtacacgacagcagctataggtggtttcaaggaaagacaaaggagagcgatatccattgaggtatgcagtctgatcgctaaagctactactagtaatttatcatcgtcagaaatgcagaacatagcattccaaagctaccaattttctatcatcattaaacgtggagtcttattaaaatatatgaaatcacacttccatttagaaaatcagatggtttaaattgcttcggagagatcaacactaaacgtaacaatatctagccattatcaacactgagttactaaccataaaaatatctaaccatttgttataatttaaacagttgcattccccacagtgtaagtttatttctcatactacctttaaatatgtagcattacaaaacaatactattactatggccttgatcatatttatttggtctttgttcagtttataactggcatgaatataatttgtttctggatagttttctccaggatgatgaatattatgcctttttggattgcaggtagggatgcagaattcatccttaggagtagtattagcaactgcacatttctcctcttccttggtcgccttgccagctgcactctccgctgtcatcatgaacataatgggtagcacattaggtcttgtatggcaatttatgacaccgcctgattcgaagaacgaaaaccgttgactcgcgtgatgtatgacctgctcctactttgtgtggttaatctcctgtcatagtctgctgtaagaaacattagaaacgttaaaaccatgccgtgtatatcctcaactttcagcccttcctgatgtcaacttgtcaagtagggattgtacatagttttggaatgttgattttctgaacttttgctgatatacagtctaaaatgcacatgtggccaaatccggaacactcaattgttgtctcgaggaataaacgaataatgcaaagaatttggtaatgtatgctgtgacaaaaaaaaaaaagagggaaaaaggaacaaagctctgagtcctctgccaaaaaaaaacagggaccactctgaatcatgtagcatgtgattctgtacaatattatgctttgagacagccatatgccatcagttttaaatccatgtatggttgtcaatgcactaggaagcagggtgcaatggcactggtcaaggacatgtaccagcattcatgctacttatgatagattatcaccaaacattgcatcaccccacatggagatgttgttggttggtgaggttcaaggaacccttggagcacatctctatcttgtttttatgtttccacacacaactttagatatgtttagtctgtatatgttgagctgagataactctactggaacagctgcagaaattttatttacattttaatatcagaatgattttcctttttttaatccatgttagtggctagcaactttgcatgataattgatatggtcagatttgaaaggaagctccagggcacatgttgtccagaagaagctaatcatgtgttgaatgagtcataaggtttttacaggtcagattctatcgaacatttctaggtgaaactcaaaatatgaaaaagtatgcaaaggaatatcaataccacctccgtcccaaaacgttactacctagtaatagatgctcatgtccagattcgtagtataggatgtgtcacatatagtagtactagataacaacatttcattttgagacaagtatagtagctgggatgggatgacctgatgacagtcttttacttgccttttcactctgtgtcactgatgggatcatgtgcagaaaggagtttagcattcattggtttggtccaacttgtgaaaaatgaacggatgcatgacaaatctttgtatagtgtatcccaataaatccatcactctactgttcccattaaaaatgaataatttaaaataaaatcgatgatctgacctgctgcattgcgtgcttgagcacccatatcttggttcattggttgctatcagcatccccggggcggctccagcatacagtcgaattttttcatttttaaatttttattttttaatatttacagaaatattgtaccggtgaaagtatttacaaaagtaggtgacgtgagggacggacaagatgaaaaagacactagaaaaatgcatttttggcaggataaaaattacatttgcccccttgcagtccttgtagagggcggcaaggcacctcagtgcaaaatgcacacaccttgccgccccaggggctatttctgtaaatattttagatggtataatatttttgtaaatattaaaaaatgaaaatttaaaaatgaaaaaaattcgcatacagtccgggtggtccaacctttgaccaccctggatcgcgaaggcccaaacgaaaaaaagcccacaagcatcagagccaggttagggttagccggcagaggagagggctcaaagccccgtgcacgcgccgcctctccctccgctgcgctcctcgcctcctctcggctctcgctctgcgccacaggcccacagcgccggccgtcgcccatcggcggcgtcgggtccctctccctcctgcagtcctgctcgagctcgacgacgacgacgagtctatgcctcaagccctaaacagctcctcataggtgagttactcattttagtctttactctttagtatttacttttaatagatcggtcatcgatgaattgaaaaatgtggatgaaaaaaatgtgattgaaaactgaaacttagattttttttttatcaacaacttagttagtagtcaatataacttagtgtatgaaggatgggaagaaactattgtttcattttgcaataaacatagtatccaagttccaactttcgatggaaaaatatgtgcctcatggaagatctccacggttttatccggaccaaacaaatgatgatcattttagaaaacaagtgtacattggtgtacaaagaagtagtgtattgtaatcttctacctatctattgtaatgtaagatatttgaattatttatgttgtaactttcgtaacttcgaacttaaatgttggttttaatcaatttgtgatgttctgagctatattgcaatatttgaattatatttccaccgtatttgtcaattttgatttgattttgtaacatcgtgacaatttgggatgccaagtaggaccacccaacgaatcgatcctagagccgccactgcatcgtctcctcgtccgccgccgccgccatgtgggcgctccgccgcgcgggcaaccccctcaggtacctacctacccccgcctcctctctctcccccgccctctgccactgttcttgtgggatttcgttaacagatgattgattggtaataaatctgtggcttatgttagttcgtgtcatccgtgcctttctcccactcgcgtttttctgtccctgttgcgtggtggcgacaagtagatccatccaaatgccttgtttagttcttgggggtttatttgtgtgattttccggtgccaagttgtgtggtgtccccgttaataggccgtagtttcttgttaagattgatcattgggtcttggatgagttgatcattgccagtgatttatttttacaggtggggagtagggagttgctggtattattcatctgatgttgggactctgttttgttgtaatctcttgaatttctatgcaaattgcagtcttaccatcttgggtttgactgaaatatatcagtcggatgtatgtgagagacatgatagtgtatctactgtgtgtatatgtgcttgaagaagtacccatcttagatgtttgtctatgtagacatgattattactttgcgtagcattatgtacggaacgatattagatgtgtttgaagatggaacaacacctcttcttgtttcaatcatctggtcatgttattgtgaaatgaagcagatattttgtatttcgttttgcatgtgaatccatgttcacgatcataatttgtacctatcatcccatgtttcatgcgttgttaatactgatatttggcttggctaactgtttgctgctgttttagggtccgtgcccaccaagctttgagtgcccgtggttgtgcaaaccttgaagtaattctaaatgcagatgcaaagaatgtggaagagcatcatgagggggactgtcagaaattggattgctgtcatcaaccaaagccattggtctgccaaccatcattctcatcaggccgtttcatgtggagtaggggtttctcttctcaggccggtgcaagttctggtgataagcaggatgagttggaggaagggttttctgatctggaggttccaccagaagctcataaaaaggatttagatttgacatccgatgagagttctgatgaggacaccattgatgcaattggcttgtctgaagtggaggctgatgcaaaacctgaggagccgataaagaagtcacaatccactcttcttaaggctttgctggaatctccaagggttgatgtcgctggagcattgaaaaaatggcttaatgatggcaatacattggatagaagtgagctcttttatgtccttcttattcttcggaggcggaagctctacatcaaagccttgcaggtgtttaacttggcctttacgtgttttattttttttcaatgatagcaagtcctttctgtacatttataattattgataatacatgtagcgactgttatgctcgttagcttggcatgtgttaagaatgttactttctgaaacatatttgcaatgtcaatggtgaatgagcttttggttttgcacataaatgaagagttatagccttgtaaaatgtagcatgcactagatgaggtaggggcactttagaatgatatgtctatatgcttcttcttcgagtcctagagtattaaaaaagaggaagtgatgaagtactcttagtcaactatgggaatgatgctagacagctagagggtgaagataagaagcacacacaatttccttgactattgaaaaatacaatgttgttgagatatcaccagttcaccccctgtacttctatgttacatcctaaacttaatttagtatgagaatgttattgtgactttgtagatcatgtgaatggtgtgcaaactgcatcttcttttctatagtatcagactctgaaatttgttagagtgcttgtgttggttttgtttgtcaaagggcgttgtctttttctgttcattccatgcacgttttgagtattactccatttctttgattccctctttatgctgcagcttttattgaccaccattttattttactgttaagcattccaagcatgtttaccccttaacatacatattgtgccatctgtgcttttaaacctttcgttgtaatactcatgtttggttatacatgatgtttgaaatagcgtagccatacttgtttctttttatgtgcaatctaatttgtgacatgatgaaatgaatgctacctttctttgtaaattactagctaaattgtgtgttcaactgtctatactcttatgtacaaaacaaattcttgtttgtaacttagtggaccattgtagctatctaatagatcttagtcatgcagctataactgtcttagataataacaaagccaccttgcttccgaatgcatttgtaccgctgcatggtaaattttcaaaatctcactattctttggttatttgtagctatacacggtgtttactttgatggaacttgttacgtaaacttttttcatgtgaacaacctcatatctaaacacttaagcttttttcactgtaattatttacctcggtctttgtgttttctaactcagaagatatttacttcattttctgcagcttctggagtatgttgaagaatccaaactaattgatcttggagaacgtgattatgcttcacgcgtggatttggtagctaaaacccacagtatttacaaagctgaaaagtacattgagaatgttcctgcatctcataggggtgagattgtatacaggactctttgggctaactgtgtggctatagccaatgtgaaaaaagca

SEQ ID NO: 88713 - DNA, 722 bp, Oryza sativa
ttatcatcagcaagagcaattaatattcagccatttccatttccaaaccatataaatgaggtagcccttgctagtatcagttgctttgcaaagctgctctgatcagaaatcccaatggcaatggagaagagccctcctccggcgccgcacttcctcttcgtggtgagcgggatacagggccacatcaacccggcgcgccgcctcgccgcgcgcctgatggcgtcggcgccggccgcgcgcgtcaccttctccaccgccgtctccgcgcaccgcctcatgttcccgtccctgccgtccccggccggcgaggacgtcgacgacaccggcgtcgcgtacgtcccgcactccgacggctacgacgacgggtacaagcccggggtgcacgcgagggacgactacatggcgcgcacccgcgccgcgggcaccgagtcgctctccgccatcgtcgcggctctcgcggcgagggggcgcccggtgacgtgcatcgtgtacacgttcctcgtggtttgggcccccgccgtggcgcgcgcgctggggatcccctcggcgatctactggatccagccggcggcggcgttcgccgtgtactaccactacttccatggccatggcgaggccctcgcctcctgcgcgaacgaccctgcccgcggcgccgtcgtgcgcctccccgggatgcccgttcctcaggtccgacgagctccctccgccgtgtccatcgtctc

SEQ ID NO: 88714 - DNA, 730 bp, Oryza sativa
atgagcttcttaccggtaacaaaccaaatgtctcttactttcgtgttttcggtagtaagtgctacattcttaataagaaggctagatcctcaaagtttgctcctaaagttgatgaggggttcttgcttgggcatgggtcaaatgaatgcgcataccgcgttttcaacaacacctccggtattgttgagatcgcgcgtgatgtgacatttgacgaaactaacggctctcaagtagagcaagtcgactcacatgtgttaggtgaagaggaggaccctagcgaagcaatcaaaagattggctcttggagacgtgcgtcctagggagccacaacaaggggcctcttcctcaacacaagtagagccacctacattaacccaagccgacaatccctccacttcaagcttggatcaaggtgaagaaggcgagcaagtgccaccctctccgataaatctagctcacccaagaatccaccaaagtatccaacgagatcaccccaccgacaacatcttaggagacatcaacaagggagtatccactcattctcgtattgcaaatttttgtgagcattactcgtttgtgtcttctattgaacctctaagggtggaagaagctcttaatgatccggattgggtgatggcgatgcaagaggagttgaacaatttcacccagaatgaagtgtggactttggtggagcgaccttggcaaaatgtgattggcacaaagtggatctt

SEQ ID NO: 88715 - DNA, 537 bp, Oryza sativa
atctccagatgaagatgccgggccccggtggccccatcaccgtccatggcgacctcaaagtcgcacttgcttgtatggagcagcgcgcgtaccacctcgccgcggcgtccaagcccacgggtggcgacgaaaggctcggcacctccgtccccgccgccccgaggcagcggatggtcacgtgcgacgaggtcccggtcaaggaggttgccctgggcgacggcccgtccaagaccacacgaatcggtggtcttctggacgataaataggaagacgcgctcgtctccttcctgcgggcaaatgccgacgtcttcgcctggagaccggcggacatgcccggggtccccagggaggtgattgagcaccgtctcgccgtgcggccgggcgcaaggccggtccggcagaaagtgtggcggcaggccccggaacgtcaagccttcatccgcgaggaggtggcgcgacttctggaggccggattcatacgtgaggtcatccatccggagtggctggcgaacccggtcgtcgttcccaaggcgaacg

SEQ ID NO: 88716 - DNA, 651 bp, Oryza sativa
gcgtacggcccatagtactgatgggagttcttcgacccattttttgtcgtgtgacatgagcctgtcgtagacgcgggttttgatcccttgtagtactatgccgtttgccctctcgacttgtccgttgctttgagggtgagagatcgaggcgaagcatatcttgattcccagcccgatgcagtaatcctggaaatcggtgctgatgaactgggagccgttgtcggctatgatgcggtgcgatagtccgtatctgcaaaatatccccttgatgaatttgatggcgttgtcggccttgatttccctcgtgggtactgcttcgatctacttagtgaatttgtcgatcgccacgaataggaacctgtaaccgccctgtcatcgtgggaatggcccgagtatatctagcgcccagcacgagaatggccaagtaagagggatagtctggagcacttgcgcgggtagctttgtgtgtttactgtggaattgacaggcttcacatcgctggaccatgtcgcatgcatctttgagggcgattggccagaaaaacccttgtcgaaaagctttcccgaccaatgtccgaccggcggcatgtgacccatagatgccttcatgtatatcaaggaagaggtgtctgccgtcgtcggacgagacgca

SEQ ID NO: 88717 - DNA, 690 bp, Oryza sativa
tccagtggcatgtagccgatatgacgaatagtagtgatattttatttaatttcataaagttggagtggcatggatccaattaacctaatttgtttaattgaaatggtatgtatttatttaaaagctttatgtgaagtttgagtggatctaacgatccccatgacatttgatgtcttcactggaaaaagcatttttcagacgcccaaaccatccgcatgtacctaaacgcctacaaaaatcatcaatttttctaggcggaccaagcacctgcctacgaaaatcattcacgggcaaaaacacaattttcccaggcgatagcggccccacctatagaaatagttttggtgcaaaaaaagaaaattcgccaccaaaccagcccgccctcgcgtttcacccacaaataaaaaattcttcatccattcaacaaaatacaatcacaaacatccattcatcaacacaatctatacatgaacacagatacagcggattcaaatccccacaacaccgatttgcattgcaacatcaatcaaaataaaaacaaataaaaaaacacagctctgtggcctcctccctgccgccctctactgctcagaggggagggccatgccgctgccgccggtggcctctccccaccgggcggatctgagaggaaagagggaagggaggccgccggcctccacccgtccccct

SEQ ID NO: 88718 - DNA, 544 bp, Oryza sativa
aaatgtgagctcaagcgaacattcccagctcgttacaggagctttccctcccattctcttctcctctatatcaccccgcaaccatgcctctcctccattgtttcctccaccgatggctccttccacgagtctcctctcctggtcctcctccgacgacgacgacggcgccggcgccggcggcgagctgtcccgccctcgcaggcggtggcgggcgcttgtcctgtgagtcaacggccgagtcaaccctgcgttcttggttgggttcagagatggtttggttgctcatgaatttgtgttttttttgttctttggttggttgcagggggctcggggtgaggaggaagaggagcatggagggggtgttcgggttcagggagatgatgggggaggagttcatgggcatgttcctccccttctttggcaagatggttcagaaagtggtaatgattttcatccaacctactagtatttattacctttccttcagggagtggtaaaaaaagccatattttttgaagttttttacccaattgtgaatttacac

SEQ ID NO: 88719 - DNA, 587 bp, Oryza sativa
atgttcaccttgattcagattaaagacaccattaaaagcactggctagatcaaattcttcataaaaataaatactccctagtcccatttccaatagagtaacatgactagggtggaatgcaatgtggcatggtagatttcagcgtagtgccatagtggatttacaaatcaagatgattaatgatttagtggtttttacaactaaattgcagcctagtcctgaccacaaacagagtacatgatttgttgctatgtaataaatctattgtactagactaaattttgcaattgatacattaaatgattacctcactaaggttcatgtcaaaattttcaatccgtgtgagcaagctgtgtgcaagttctgctgcaggttccacaggcagctccatggaaacatttgaaatagtttgcaagagtgaaacacgatccacagcccataatgcagaatttggttcccctttaggacgaactttgcctttatcttggccaacattatcaaggagtttccagtggtgtgagaggaatttccagttaactgatttaggtgcaaatgatgagacctcagaaagaagccaccatgccccg

SEQ ID NO: 88720 - DNA, 723 bp, Oryza sativa
atatgtatcataatatctgagaaccacagatcatacaaattacgtttcatcaaaagttagaagaatcatttcatccaataaaaaggttaaaagggtcattaaactgttacctgacagctgcttcgcgacagtgctctgcaacatcatcaaaaatgcatatggcaatccttcgttcctctactgttttgtccttggcctaatattattaacaaaaaaaatacttataatcgcagaaggttcttttttgtccttgacagagtattttttttgtaataagatgttctatgtttatcacaggctacaagatctgaaaatgaactggaatagtttctagtagctttatgtttactctttggaacatttaagcaaaagatttctatggcaagccaagaaaaattctgggtaaagggaatatctgaaaatgacccccaaaagatatagggtccaaggtttcacattgctagaaaaatcacttttggtgtaaagttcagcattcagtatgttgcccttctatcactaagaaaacagaagttccaatcaaatcagatggatccacttaccaacataggtgtcaaatagacggaaagttcatcaaagaatggaaggaaataagtcttgaacgtcttaacaagagtgcccaaacaatcaccaatctgtgaaaatcacaaaagataaatctgtataagttatttccaataaagcttggaaagtagggctgcagga

SEQ ID NO: 88721 - DNA, 697 bp, Oryza sativa
ccgactcacgtgctaaggaagtctctagtccaggctttaattttgtgcttcagatgggtcgcattggatcatcaaactggtctgagagcatgcgtttatctaatgctgacatcccaaggccaactagcaccttgtttgaacaaaatactcagttttattcaaattataatgtcccatcttaccctgacaatcagttctatcaacctgctaccattcatggctatcacctggcaacctctttgaaaagtatgaatgcaagtcacagcacgcactccagcatttcactagatccacggcgacttcctagatcatctgaatctgctggttctaactacgcagattctgcaaggtatgctcgtaaccaagatgtaattggttcacagggaaccgcttcgcaaaacacaacaatgagctgtttagatacaatgacagtggagagagctttttacaatcctgcctctgttaatgagattgaaggggttggttcatctgcttactcaaagaagtaccatagttcacctgacatatctgcactaattgctgcaagtaggaattatttgccaaatgaagtaaatttgggaggtgctgctggaagcagttcatacttcagtaatttggcatgtgaaagatcacaatatgtgaacttgggatccagttccacagctcaatttgcacttagcaagcactcacaacctaa

SEQ ID NO: 88722 - DNA, 647 bp, Oryza sativa
agtggcgctttagctgcaaaatttatgtcaacattagacagataacacagaaaggggtaaatccttcagaaaaagaacttgagtgcttgactttcccaagaaaaaagaaaacgtgtggccacaatttttttcaaatttcaaataaaaaaaatcaagtaaaagataaaacagaacgcagggtaaacctttcaagatgttcccaaaaaggaagtctgccaaatgccttatcttctctgactcatcaactaaagatggcaggaaccgaaggaagagcacacctctccactttacatagtccctctaaataaaagaaaagtttcaataaaccatgatccaaacatgtggaagtgatattaagaaaattattagcacctgcagcaactttgagagtaggataaatgtttgcctcctcactacctcacagggatcacgcaacgattttgttatttttgacatataactgcagagtgaataaaaaggggaggtcagttagaagttgaactattttaatgttttccctgtttcccacgtgcagtttaactgataagatcttaatcaaacagtaaagcagttttacatcttttgcaactgaagctgtaacaaagataaacccaaattttgtgaatattgacagtatgtgctaattt

SEQ ID NO: 88723 - DNA, 628 bp, Oryza sativa
gatcaatttacagtagctcatatacttttctgataccgagatttcagagaagcctgacctttctcttcattaggagcatttggcaccggaccaacaaaatcagcatccccactgcttggccagactagaggaatcagcttctgctgatatgcattcgtattatcgcatatgccaagctggatgacaaacgttactgtgcagcctcttcctgttccttcgctatccaaccagatgtgccctcccatcaaagtaacaaacctgagataggatttttcacattttcagttaagtcgccgagtttacagtgagggagtgagtatatagcagcctcagcacaaattgggttgcagaaaaaggagctgataggtaagaaggtggtgatgtatagtaaactacctcttgcaaatggcaaggccaagaccactaccactgtatcctctgtttcctccaggctgagattgagcaaactttgtaaatacttgaggtagatcctgagggctaatgccacagcccgtatctttaatctgcaacagaagaaataacagatgtcataaaacagtaaaaaaaaaaaactggcaaacagttacctgactgtacacaactctagtttttctttatcaaccagtaa

SEQ ID NO: 88724 - DNA, 1167 bp, Oryza sativa
aaatcaactacttcaattcaggtttcttgatccgttaataaatggacaatatccaaaaaatatgcgagatattgtgaaagaaagattacctactttcacgcctgaacaagctaagctagtcaagggctccgcagattattttgggatcaatcaatatactgctaactacatggcagaccaaccagcacctcagcaagcagcaactagctactcatctgattggcatgtttcatttatctgtaagttcccaacttataattaaggattatataatataaaccaatagagtactcaagatatcattaaatttatccttttctacttaattttacagttcaacgaaatggcgtaccaattggacagcaggtatagttgtttcctcttgccacattcaattttagtttcttatcaatgctacaagattagcaagtgtggctaagacgagaatctcttaccatgcattatttcgtgcaggcaaactctaattggctttatatcgttccgactggcatgtatggagctgtgaactacataaaggagaagtataataatccaacaatcatcatatctgaaaatggtattttcaaactacctatctagttttaattcaaaattttccatgcatttctcaaaaaaatttatggtcatggtaccaggaatggatcaatctggaaatctcactcgtgaagagttcctgcatgacaccgaaaggattgagttctacaagaactacctcactgaactgaagaaagccatcgacgatggtgcaaatgtggttgcgtacttcgcatggtctcttctcgataacttcgagtggctgtcaggttacacatcaaagttcggcattgtctatgttgatttcactactctcaaacggtaccccaaggactcagccaactggttcaagaacatgctgcaggcatcagggcctggctcaaaatctggttcaggcacttcagattctcaagttggttcagcaacttcagcaagccatccagttggttcagccatctcaagtagccatcggctcttgcttccctgttggtttccttgcattttcttttcccttccttcttcatgtttttatccctgtagaagtagcaatttagcagtgattaataagtagtggatgccagcagtatgttcgctttaaaaaatgtgctgcag

SEQ ID NO: 88725 - DNA, 848 bp, Oryza sativa
cattcagtatgttgcccttctatcactaagaaaacagaagttccaatcaaatcagatggatccacttaccaacataggtgtcaaatagacggaaagttcatcaaagaatggaaggaaataagtcttgaacgtcttaacaagagtgcccaaacaatcaccaatctgtgaaaatcacaaaagataaatctgtataagttatttccaataaagcttggaaagtagaagtcacagctgtgtctacagtttaagttggaagtacaataatcatgcttgctccttttggtgtctaaggtactaccgcgttcaactttacaaggcaagatttaacttagcatggtcttctagattggactttgaccataaatttcatttgaatatgttcttactaactagaaaatcacgatcgtgtgaaagcaaaatacatttgagtagctgcatcaatttggatcactaaacctaattgttgatcataacttgcaaagtttgaaagtagaaataactgctcgccttataaatttgaatggaatagttaattagcatgtgtaaatctttcaatttcagtagtgcacagaactgcatacacttgtcaattcttgtatcaggaaaaaaattataaacaggtacatctaaatatactatttttttccagaaatattagcagtctagttttcaatagcttacttgatcgaagatttcatcctcctgttcattttcttctctgagtagatcctcttcttctgaatcaaaatcttcagcttttgccctgtctgttcgttctctccttctgagagcactcgcagttattacttctttaattccatctactatagatctgacctggccttcct

SEQ ID NO: 88726 - DNA, 2669 bp, Oryza sativa
tactttctataaattggatcgaaatcattttttatgtgcagagtacatgctgaatctggatggctgtcttgcttctgaattctgatagcattcccatatcttttactttcttgatgtttgttttcccttctgaaaggtggcttgatatgatatttttcctttccagatatgtcaaattctcgggttagctggaattgatttgtttaccccttctgatgtggttgagaaaagaaatgttcggaaagtttgtatgtgcatacgcttgctatctaagaaggctcggacgatgcgcctgactgtaagccctagattcttatgaaaccatttattaaaaataattcaatcagctaatcattgcacaatacacatcctgaaagatttaattggtgtgtttctgctctctggtgacaggtgcctgattttgatattgtcactcatacaatagccatgcccaactacattgttggaggcatccggagaagtctggagcaaccacaatgtagttcatctggttcaagtggttacagtccaagtgccaactctaaggcattaaatcagcaggtaagctatttgaaaggatcagtttttttttttggggagaaaggatcagttttattggcatgttcttgctaattgatcctttattttaagtcaatactatcattgtttaaaacaatcaactcattaattttgatatatatttccagagagtttttggtgcagagaatgatcaacaatgtgaaacacattatgattctgatgaagctgaaagtaagctctctgcattagaacctgaggactcagtcagtgaagacaatatttccacacttttgaaatcgggcaacatgcccaaggaagaaaaggaaggctatggagatagtgagcatggtatgcatgaagagaagtcattgtctgaatcagttggatcgattgatttcggcaatatggaatctgattctgttggttcaactcctttatttcacaaaaatgaatcatattgctgtattgaatctccaactgaccagtgttcaagaactagaacaattaggtgttcattaagttcagaagagtcagattccataagcagtcatttggtagttgacagcagcaaggctaaaaggactcatggcgaacatctcgagcctcttaacggaaatgggaaaagatttgctaacgatcccgaaaaagaaagcgatgccctccaaaaggtcacctttgatcaacaatgtgatctgcttgcctgtgatggggagtctgtatgttcaaattgcgacagtacaccatactcgagtttaaccccaatagacagtgcttgtggcaaattgccagcagtttctgaagatgatagtgcatgccgagggctggaactcgaattccgttgtgggaatgaaacggtacctcctgaaatgccaaacctgtgtatgctagtactacttttaacatagtcatcattttgtctcatgtacagcaaacacgctttaacatttctttggcatccaggacgtttcccaaaaagaagataaacaggtggaatcagaatataaagctgaaaatgacagctctgctcaaatgaatgagaatgatgttcccaaatcagggaaagggatgctaaagtctgttgctggaggaattacacttgtcggcgcagtgttcttcatagctcatctcaggtaatggtaccacagtatcaaattatcgtcgtgtgccgtttggtgtactgaacactaatactcctatatattatgaaattaatccaaactttgctgcagaaggagcaaggacagaagcttcgcaggtgttatagctccattctctgaaaaatcagttcagggcgactcaagggcaaagaaagtagagaaaacaaaggcgggtgccgtgtatcccggggaatggctaaaagtttaatcaagaagaacggacatgccacggtgccacctaagcgcaatttggaagtttattttgcaatatgcatacatcttgtaaaagtaaaatccatatgctaaagaacacttttttttaatcagctactccagtttgcacgagtagagggctttaagaagcgactccactagtatagcaagtgttaatatttattttcttatagcagtccaaagcttacaataatctgtaatctggataaacaagatgcctcaagttctctccatgtacagaatgatccatgaagttgattaatttattataagcagcagccattattcagagtagattttgtactatgatgcagtaggccgaggtcttgcagcgtgcagcactgcagttaattaacgtgtggctgtcgagtttgcctgcaacagctgccagccctgagcaatctctgtgctaaccccgcgcctccaacctgggtctgggttagttttcaactttttcatcacatcaaaactttttacatatataaacttccaacttttttcttcaaacttttaattttagttaaactttcagtttaaatgtggaactaaacacagaaaaaaaaaactagcatatctcatcggggaagagacgaagagtagaagccccggcacgtcgccaccactcgccgccgagcgaagactagagactcacccgatgattggacgggccagcgcacgcgacgaccgtgcgcgcgaaagcgccatgtcgccgtccacaccaagagcgcccccacaccc

SEQ ID NO: 88727 - DNA, 1316 bp, Oryza sativa
  unsure (1)..(1316): unsure at all n locations
gaggggtctcttnngnattagnatgccncgttagtaaaaccatctattatactgccataggaccctattctacatgatttcgtatagtttaggggggagatttctggtatttttggggggggggaaaacaccccaattaaaaaaggggggagaaattgtttttttacagacttcgacataaagttgagggacggtaggtgaacttattcctcgtaggaatcgtgcaagctgggaataagttcactttgtgaccctcaaaagtgattgaaatctaatccgtgaccctaaaccacaaaaccggatatcttgacccccaaactatgaaaaccggtgcaatttgactccctcagcggttttggagggcggtttcgctgacgtggcggtattgaccaggtcttctttacacgtggcgttgatgtggcgcttaggtggcatttcaattaaaaagttatacgtgggactcatttgtcattcacacacaattgtggggcccactaacatgtgggccccacatgccatcttctccctttcttcttccttccctctcttctctctttctttctccctctcccctacggccgtccgcagggagcgagcggcggcggcggccgccgtgggctggagctgaagcggcggccgctcgccgttccttttgcaccaccaccacccgcatcacccagcggccggcatcgagacgtcgtcagcagccggcatcgagacgtcatcggcggccgagcggcggcggcggcagcccgcgggcggtggcgtaacatggggagcggcaggtgggcttggggaaagtatttacagctcggcgtatgggacgacgattactggtggccggtggctgctgctgtttactgctactacaactgcaacccttcgttgccttgtcgatttgtcatccgcgcgagagcgctccgggacaaatcgatggtgtcctcactgccgactcttctctcaagaagtcttgggccgtgtttggtagggctataaacttcaactcctagctctaaattgctatttcagttggagctagctcctattagagttggagacccatccaaaagtgtttgacaagcttttagctcccgatctaaaaaatattgaaaaaaagggaaatcctgctgcggccgtgcgccngccaagcatngtntncacgcacgccggnctngcgctacttnccctgcacccaccatnncgcctttgtagcgtgcccgccgtcacaagctgtgcgccgctcacacgttggnctcgctttgccccgacccgccccgacggagcaacgtttgccgcgcaccccaaccgtgcgccgt

SEQ ID NO: 88728 - DNA, 1681 bp, Oryza sativa
tacagctttggtttctctgaattctggcagtacagctatctgggtgtactttttcggttaggaggcatactgtacactatacagtaccatgtttccattttaccagaaacagttatacttccaggtcataatcataagccatcactgttcaataggggtaaaatgttttgttatctcctggtaaattttcaatcaacaatgtcaaataagccagtaatatttctggaatgattccatccagtacgcaatgtacaagccatcataccacagcataacagttaacaatagttagtcaacaagttcttgctttgctctagtgatgcaagaacaaatacatccattaaatgctagtaagtttcttttcttattttgttcagcactagctagtatccattaaatgctaacttagtattgcctgcgagtattgagggttcagctcctccgcacttgcagagtgaggcattggcagaacgcctcaccaactaatggtttctgcaaaattccttgtgtgcagactgaaggatacggcgctgtataaatacaagagaactgctgtctcacgatcatgacgagcatgtgtcatttttatgcacttcgcttcccatacttcaacatttgtattaaatactttccaccaaataaatcattaacccacttcatctgaactgtcactatctgaggagaaatatatgtgctgtcctctagttgcttcttcctcagattccttgtcttcgtcagattcatcttcttgatcagaatcggtcgaagctgctgattccgtgaaaacaaattcagcgacaatgggcaaatggtcactgccaatttcctgattttgtttttggcataaaatcattgttagcagttaaagatgagaagtatataaaagcaacaatatcaaattattcatgactcaaattgttgcagatgatcatttaagttactgtgatgatcaaatgagaataccctggttggaagacccctagttctcctcaaaaaacccacaggcagagtatctaaaactctggagcattcaagccctgcagtgtaccttaaagaaagaatatcagccacatttttattttattttattctgcgtcatactgtacttttgagcaattgcatcatactgtattagaaagtatttagaagcataccacaggtaatcaacagtgccaagaaacttcttgtgataggaagttgcaaggggttcgccatgatgacccctattgtttgagtttccctaatataattggcaactagtttcagcaaaatatgaaatggtcaaacaatcagttttgatcttaactagaaactagtacctttaacatagcatacgaactacaaatattcaatggatgtttagcaaccatgacatttgaagacccagttgcatttcttacttcttcgccgctccattggtacttcagtgaactgcgaggaaggagatgagtattgagtagagaaaaagactatttgacaggtcaaccgttgtatcacgagaaaggttctgacctacaaagatcatataaagcaaactcagagctatcaagtccagacaactgccttctatcatgcaaagaaatgtcaagctggtgacacaaaaacacaatatatgcaatgtcaatttaattataattggatgtgatttcagctttgaaaaggcctaagaaatattttaagg

SEQ ID NO: 88729 - DNA, 2412 bp, Oryza sativa
ccatcgccccagagaaattcacacctgagcagaagaaggattttgaagcaatgttgcagcaagcctgggatcagttcttgaactcattcatgcagacccgcaagggaacactggttcagaagtataaagtaaaggtagttgccgatgatcctgggaccagttcttccaaaggtgaagacgggaaacaagctccagatggctcggctcaactgagtgacaaaggtgctaccgacggttctctaggaagtcaaggtgacaactctcaaggggtccatggagttcaaggcgatagagtgcatggagttcaaggtgatggtgctcaggggttgcaaggaggaaatcttaatcagaatagtgatgcagcacaagattttttcaataatttccaagaccgggtcaactatgctgtgcaccatgctttgatcaatcagtctggggtgttagtcaataccttatcaaacatgatgaagtcaatagccgatggatcaatagctgagcatcaggctgcagacccagtttatttgcaaggagttgtctttgcaaattatcggcctttgatcactgatgcctagccatctactcaggcagctttcctcgtcacaccatcagctcagccgacggcgccggcatcgactcccttacctacttcgtcagcattggcaccaggccagctggtgaaccctcagttgttgatgagagagcagccacagcatagtgggcaggttgtgaatcggccgacgcaagatcaggttgccgccatgtttctgccgcctcaatttgctgttgatccaatacagcagtagccgattcaacagacactcccgattcagcaggttgtacaaccaatccagcaacaagttgtgcaactagtccaacaaacgccaccaaggcaacagcctccgcggccgattcaacaaacgccgttaagacagcaaatcgttcagccgattcagcatcaaggctcaatgagcgcatcggccgggtttgtggcacctggtggacagcctgtgcaacgatttttaaatcaagtcgtcccagaacacttggttcaccatgtacagccggatggcacagtaatgcctcaagttgttcccgagcatttggcacgtaatattcagccgaaccttcataattaccaggggggcaacttgagttatcaatatcagccttcttctccgcaagcccaatatcagccagggggactggctcaacgtcagtttgcgtctcagtacggtcagttcgagcccatgcaacaacagtcacagggagcagctcagcaacgatcgtgggctgatgtgattgctgatgtaatgagggaacagtttgggcttaaaccaaaagagactggaagcttgtatcggcagcgttaccctgagtggtttgagagagttcctctccccaatcggttcaaagttccggacttctccaaattttcaggacaagatggtgtcaacttatgagcacattagccgatttttagctcagtgtggtgaagcatcggctgtggacgctctgagggttaggttgttccggttatctttgtctggatcggcttttacttggttttcttctttgccgtatgggtcgatcaatagttgggccgatttggagaagcaattccacaactatttctacagtggggttcatgagatgaagttatctgacttgacggcgattaagcatcgacatgatgaacctgtgcacgagtatattcagagattcagggagatgaggaacaagtgcttcagcttgagtttaactgacgctcagttagccgatctggcctttcagggtatggttgctccgattagggagaaattctcgtctgaagactttgatagcttgtcacatctgatacaaaaggtaaccttgcatgagcataggtctgcggatgctaggaaaagctctaagaaggttaatcatgtttgtccttacatgtatgggtcggatgacgatgaggatgactctgagatagctgcagccgaatgggtgaggagtaaaaaggttataccatgccaataggtaaagagttctggaaaggaagaaaagtatgattttgatattactaaaactgacaagatttttgatctgctactccgagagaagcaaatttaactccctgctggtcatacgattccgtcggttgaggaattagacaaaaagagatattgcaaatggcataattctgggtcccattctactaacgattgcaaggtgtttagacaacaaattcaggtggccattgagggaggcaagattaagtttgatgattccaaaaagccgatgagggtcgatggtaacccatttcccattaacatggtacacacagctggccgaacagctaatacggggcgcatgaggggtaatcaagtaagttcggctagaattataaacaaatatcaaaggaaatat

SEQ ID NO: 88730 - DNA, 3042 bp, Oryza sativa
tcaagccgatgtcgacgaggtggaagaggaatcagctaggttggttctatcactagaacaggtgatgttcgagaagcctgaggggatagagaatcggcatcttaaaccattgtatataaatggctatatcaatgtgaagccgatgtctaaaatgatggttgatggtggggccgcggtgagtttgatgccttatgctacgctcaaaaagttgggtataaatgccgaggatctcatcaagacaaatatggtgctcaaggactttggtggcaatccatcggaaaccaaaggtgttctaaatgtggagctgacagtcggcagtaagactattcctaccacgtttttttgtcatcgatgggaagggttcttacagcttgttgcttggaagggattggattcacgccaattgttgtattccttcaactatgcatcaatgcttgattcagtggcaaggcgacaaaatagagatcgtaccagccgacaggtcagttaatgttgccagtgccgatttagctctttgggagatggatggcctttattgtttatctggaaaagtttggaatggagattttctaaaagtgtccgattctgatatacagccagttgaagatggagaacccaagctattattttgagggcgtcgtggagggttcaagtgtctacactaaggatatggtagatgatctcgataacaagcaaggtcaaggttttatgtcggccgatgatttggaagaaatagatataggtccaggcgatcggccaaggccgacatttattagtaagaatttgtctccaggatttagaaccaagctaatagagctcttaaaagagtttagagattgcttcgcttgggagtattatgagatgcctggactcagccgatcaattgtagaacatcggctacctatcaagccaggggttaggccgcaccagcagcctccgaggagatgcaaagctgatatgcttgaacctgtcaaagttgagattaagcgtttatatgatgctggttttattcatccttgccaatatgctgagtgggtttctagcatagttcttgtcatcaagaagaacggcaagttgagggtatgcattgattttagagatctgaataaagctacaccgaaagatgaatatccaatgccagtagccgatcagctggttgatgctacgttagggaacaaaattttgagttttatggatggaaacgctaggtataatcaaatttttatggctgaagaagatatccataagacagcttttagatgtcctggtgcaatcggcttatttgaatgggttgttatgactttcggcttgaagagtgctggagttacatatcaacgggtcatgaattatatttatatgatataatcggctggctggttgaggtctatattgatgatgtggttgttaaatctaaggaaataaaagaccacatagccgatttaagaaaagttttcgagaggaccaggaaatatcgcttgaagatgaatccgacaaagtgtgcttttggtgtatcggctggccagttcttgggatttcttgtccatgagaggggaattgagataactcagagaagtataaatgcgatcaaaaagattaaggccccggaaaacaagaccgaattgcaggagatgatcggcaagattaatttcgttcgaaggtttatttttaatttgtctggaaaattagaaccttttacaccattcttgagattgaaggccgatcagcagtttacttggggggaagagcagcaaaaggcgttggataatattaaaggatacctgagttcccctcctgttttgattcctccacagaaagggataccttttagattgtatctgtcggccggtgagaagtcaatcggctcggtcctgatttaggagttggatggaaaagaatgagttgtattttatctcagtcgttggctcttggatgcagagactagatattctcatgtggagaagttatccttatgtttatatttttcatgcacgaggttaaggcattatttactgtccaatgaatgtactattatatgcaaggccgacgttgttagatacatgttatcggctccaatattgaaggaagggtttgaaagtggatattttccttaactgagtttgatcttcggtatgagtctccgaaggcgattaagggacaagctgtagccaattttattgtggaacatcgtgatgattcaatcggctcggttgaaatggtgccatggactttattctttgatggatcggtgtgtactcatggttgtggtatcggcctagttataatttcccctaggggggcatgtttcgagtttgcttatactattaaaccttatgcgactaataatcaagctgagtatgaagcagtgcttaaagggttgcaattgctcaaggaagttgaagccgatgctattgaaatcatgggggattctttgatggtaatcagtcagttggcagggaagtatgaatgcaagaatgatacattaatagtttataatgagaagtgccaagaactgatgaaggaattttggcttgttactttaaagcatgtatctcgagaacaaaatattgaagctaatgatttggcccaaggggcatcggggtataagccgatgatcaaagatgttaaggttgaaattgcagcaataacagccgatgattggaggtatgatgtgcatcaatatttacataatcgatctcaatcggcttctaggaaattaagatataaggcgttgaagtacactctattggatgatgagctttattatcggacggttgatggagtgttactgaagtgcttgagtgccgatcaggctaaagttgcaatcggcgaagttcatgaaggaatttgtggcactcaccaatcggcccataagatgaactggctacttcagcgtgcagggtatttttggccgacaatgctggaggattgcttcaaatattataaggggtgtcaagattgtcagaagtttggagcaattcaacgagcgccggcgtcggctatgaatcctattattaaaccgtggccatttagaggttggggaat

SEQ ID NO: 88731 - DNA, 889 bp, Oryza sativa
catatatgtgttcttcaaggttcactactagagaaatcatctttgttcatggtttataagcgcaacggaatgtgattttagtcccggttcactagcttgtcaggggctatcagccccccctatctttagtcctggttggtgttatcaaccgggactaaagttagcttcctttatatatgtcttcttccagcctgagctaagcttcaaaatttcttgaggaggagggaaggtgctgccaaaatttattgtgaatttattttggtgataatatacaaattggaggcgtctaaaaggttagcaacttcatcctccaatgttttttgcttagcatattacatttagagatatgttttgcatacattattgcctctaaaaactttgatggaagttgatgagaaagaaaatttgtgtagggaggaaagaatatagaatttttgtttatgtagaattttataaaatgttttgataaaagagttgagaaggaaaaaatattgaaaattaatctaagagaacagaaaaaaagttaatttaaaactaaaataagtacaacacattaaatatgtgtttgcaacaataaaaataattaaaacaagaataatatgtgggattattttataattattgtatgaataattatatacaattattgtatgattgtttaattggtttgacttttgttgattatttttacgatttttgtgtatttcatgtagatggatcggcaatggatgtacgcggaccgacggtcaaaagagtttattgatgacgtgcattattttttgagagtggctgatgctaacaagcataagggttttatctgttgtccatgcaataagtgaaaaaaccagaaggagtattctacattaagaactattcatttccacttatt

SEQ ID NO: 88732 - DNA, 581 bp, Oryza sativa
catggattgttgatcgacattcgagctcggtaccctgcactcaaacacaagagacaggaatactccgttgaggggttgatagcgtctcttgatgttgaggagaaagctcgggaaaaagatgcggcgtctaagggcgatggtgggcagtccattgccaatgttgtgcaccaggcccagaacaagagcaaggggaaatacaaagctcagcagaccaccaacttcaagaagaagaagaacaacagcaatcctaatcaggatgagaggacttgctttgtgtgtggtcaacctggccatctggccaggaagtgtccacaacgcaaggggatgaaggcacctggagggcagacctctaagtttgctaatgtgaccattggcaacactggagatggaagcgggtatggtaatttacctactgttttttcagttaaccagtctactaattggtgggttgatacaggggccaatgtacatgtttgtgctgacatctcattattgtcttcttatcaggtcgcacggggttctaccgtcctaatggggaatgggtcacatgcttctgttcatgatgttggcacggtagatct

SEQ ID NO: 88733 - DNA, 4659 bp, Oryza sativa
tagatatataccctacccagaatgttaggaggaacaacgaacggtgctattttcaattggattgctgctagcactttagctttgtaattttcgagcgccagccacatcatgtgctgttatgccttgagaattgtcgtccaattgtccatgctgccagtgccaggcaccacaacgtcaacggtgaagggatgacttagcactatcggtagctttctcgaccaatgctacaaatacataaagcgggagggaaggggacttctaatttgttttatcttctccgtttacgatttctcttcaaacttctgtatgtaatgtactcgatctgattaattacttttcttgatatgactctacatacggactgtatctataaatcttttttctactttctataaataagattatattatgtattaatctccaccatcaaaatagagatcttctacaatctaacgattaatatctttttctttttcttcgattaatatgggaatttctaacgctcacagcgaacgtggtgtcttctttcaaagctgttttaataatataatagatagatgttgtattgaatgatgggtaggtgaggggtattgaagtaataaaatttctcgttttgcagattggtggaacttcgtaggcaagaagtttgaagttggagttggtttattttaagacaaatttgaactttagaagttgatttattttgggattttaggatttaaattttatcccaaaagcatgttattttagagtaatttttatcacatcaatcacctcgaattcaaagttttctttattctactctcaactatcatctcactcccaaccccatatcatttatcataatcatttttgttaaaatttagattttactatcttcgtcccaaaataagtacagctgtgggtatccatgtcaaacgtttgaccgtccgtcttattttaaaaattaaaaaattaattgcacataaagtactattcacattttatcatctaataacaataaaaatactaatcataaaaaatttcaaataagtaggatggtaaatcgtttgatatgaacagtataaaactaactaaacaacctcaaatgataattattgtaggacggaggtggtacatattgaaacggagggagtaaattttatactcctgcgtagtaatagtactagtagttgtaatcttttactcactttgtccaaaaaaaacttaagctaggtgaagatgggatccatcattctatccaaatttcttgtaatataatagattgcatttccacctagattggtttattttatggaggagaagtgtacactatgactgtttgtttatgataagatgcataatttaccttaattattgttagcacgattttcaaactattaaataatgtgtcttgcaccaaaactttttgtaaatgatgctctaaaatataaataaattcatttttaagtttgtaataattagtatttaatttattattcacccatagcttatctcgtattatgtgcatcaaaaaatcttttatcttaacctataacaaacgaggccgtcattccatctagaccccatttgttataggtggagtgacagccttgctttattcggcaatagtttaatctcgtattgtgtgagttaaagaaaatatttatcttgacctacaacaacgaggttgtgtttaggctgtgtttagttccacgctaaaattaaaagtttgaagaaattggaacaatggtacggaaaagttgaaagtttgtgtggaggaaagttcgatgtgacagaaaagttggaaatttgaagaaaaaagttggaatctaaacagggtcttagaactgctggttcacatctcctatttctcgttttttgtgcacacgatttttaaactgttaaacagtgtgtttttttgccaaaattttctatacgaaagttattttaaaaaaatctgtgcatgctaggtaggcatggtttagttcctaactttttcttcaaacttccaacttttccatcacattaaaactttcctatacaccaaacttttagcttttccatcatatcattcaattttaatcaaactttcaattttaacgtgaactatataacacaccctcctattgttgcgaacacagccagttggagtggcgggctcgctctactcctagatccaccagattcgcatcaaaatactctgatgcctagtataccagtagatactcccaggtatacttacactgtttctcggtactcccatttactggggtagtactcgtagcacgaagtaccagtacactctactcctattcgtacctcttactcgtaaagctgtagcctgtaggagtatttatttttctccgtccacgcaacgcattgcattgcaggctacagtacgagaagcaaaaaaaaaaaaaagctttcagagccaaagtcgtgacaacataatctcaaaaggaaaaaaaaacaaaagaaacaacggggaaaggaaatgaatcgccatcaatgcaacgcaacgcaacacaacgcaatgcacccccccccccccgcccttttcccgggccagtttcgccgtgcccaaatcatgacctcgcgcacgcacacgaacccgcaaacacaaacacacgcgcgcacgcatcgtttcgcactcgcaagcgcaacgcgcaagcggtgatccatccatcatcccaatacatccagcgcgtcgtcaccgcgggaagccagcgtgcggcaacggcaagcggatcggagctcccccgtccatccatggcaaccacctgccgcggccgggctgctgcgcgcctgcgcctgcgcctgcgtgcagcgatgctcctgtcgtcctggggctctgctgctatcgtcatttccgcagtaattgcggggctgtccagtgtccatcgcttcccgcgaaaagtgggaagcaaatgcggtggcagctctgccatctctgggcgctagctgctgctctgccttgcctgcctagcttccgtttctcctcgcacgcatcagcagcagcagcagcagcagcagcaggtcgcatgcgccacacatttcccgtaacttgatacagccactaggggtacgctggtcgcagtcgcagagcaactagctggcccgcgcgggcagcagagtgcagaagaagaggtgggggtggaggggttcacggcttgatagcgaaaagaaaacaatgcccactttcctctttcaaactccacgcactctctcggtttctcgtgacacaaactatggatgatcggataacgtaactttcccttgccttggtggccgacatatcggcccgatagtggtgaggcttacagtacatatttcacggtgaatagtcacgtcagacgatccttttccgataatagagcatcaacggagttgtttgaaatgcttgatccagagattaatttttagtctttatcacatcggatgtttggacactaatttaaagtattaaatatagactaataatagaactaattgtataaatgatagctaattcgtgagacaaattttttaagcctaattaatctataattagcacatatttactgtagcatcacataggctaattagagattaattaggctcaatagattcgtctcacgaattagtccagggttatggaatgggttttatcattagtacgtttaatacttctaattagtatcaagcatccgattggacattgactaaaaattggttataaagaaaaaaaatcagtcatgtccgtttggcgcacacactctctctaaattcaatgcatggttattttatctccaactacctgggtggcccgcgcgattgcacggttagcacataaaaaaatcatatattttttagtatgattttacttaaaatttattaaatagctaactcgttgtcttcaaactttgaaataccaaatgttatcatccccgtgtttctaattatatagtttttaaaagtcacagtcgctaccccttacttctgacatctcctttatttatttgctcgatctaccactatttatattcattcttcttggaacctttaaaaattggatcttatagtttttagagtttattgccttgttgggtttctttttataatttctagaagtcccatcaaatgttgctattatactcctttatggcccgttgacggagctcgtggcccctcaccgggagaccgcacaggcccccctttgccggttcggccgggggctcagggtgagatctcaagctctcgctgtagatgacggaaagatcgccacctctcaagagaacatgaaacacaagcgatgtatacaggttcgggccgctgagaagcgtaataccctactcctgtgttttggtggatctgtgtatggaggagctacaaagtgtgagccgacctctccctcgttctaggctctgaatctggaaagaatcaaccaacccctttctctatgggcaaggtcctccttttatacttcaaggggataccacatgcacccctccctttccaaactggacttttcttcttttataaatggacggagatttgcacggtcgtcctccgaacatcctcctgacgggacggcacatacctacctccacttttgcctgaggcgggcacgtcctgggaaggtggctgtgtgcttacaacatgagcagtgttagaccggtcacaaatcggtattttttg

SEQ ID NO: 88734 - DNA, 5165 bp, Oryza sativa
  unsure (1)..(5165): unsure at all n locations
ttcagttggtgctcttttgcatctaggtctggagtagtgtgtgtgaatgtttgcatgtacttgtgcttcaagggaaaaacagcctgtgtttgagctgtgtttttcaatttttgttctttttttataagactctgtttgtttgttgggctttctttcaaagccggttcaatataattgatctgttaaaaaaaagcttgttgctgttattgtgactttgaagggaccaccattccgcatccatttgaaagttactgtggagatgccatggatttcgagaagatggctttggggagacgtactattgacaatgagcgaatcatcagtcatgggaagctaatagcttgtcgacggggtacatttggagaggactacatatatttttgatcctgctagggactctaagattatccatgcttttaacaagactgctttggcagcgaagcttaactggggggatgaaattagagaatcaaaggttccaaaatgaaaaggaaaaggaaattagaagaatcagacgaagtgaagagtaagaacatacggcaaatggaagcagagtaagaacatacggcaaatggaagcatattgatgccttggtaagcatgtacttaaagtgttacttgcttgtatatgtttcgtgtactgggttttgaggtgtgacctggctgaatttaaatgttggtgcaaatctgaccctagaaccctttggaactagaaatttcatacgaatcacatagaaattgcttgttactgtttttacttcctatatgtgatatctagaacatagctggcaacagaatgatattgcttctattgttaacgaaattaagtcatgatacttctccttatgttggtgcaagtttatactactccttgtccaatcgagagcgactggcatccactcactatctaacccatcatatatctctatacataactaatcatctcactctaattagaaataaatacattgctacctttaagtggatgaaacaatcctaaaaattcattaatatatcctaaattatgtgaagacatctatagtatacaagacaatttgttatttaaagttttaaaactcacaaataagatatgctaaatattccaaaaaaataacatatggtatctagagataggaaccaactctattattactacactattttctcataaattcaacactacacggtttcaaacatttttagtttaaaatttatatgttccaagggtagttagcaaaaagatcataaccaatgcccaaacaaattactaacgaaacatgtttaaaatgaagtaaaaaatatttagaaaaatatcaccaacttataaacatttgtaatagaaaatttaagcaatattaaatatacccacgcatgtatgtgggctaccttagtttaatttaattgatatttgtgaggattacatatgggatcatctaagtcaatagaagtgtgccaagatgttaaataatctaaacacactttgtgaagatgttattttctgctactttttaaattccttttttttaattatatgtacgatttgcccatcaaagtataggtttcgcacggccttaaagtgaaggctactcggcctcacggtcatagaatgagaaaggaagaaacatgccgcgcatgtaaccaacatcaaagaaggagacgtaaacatgtaattctttcaccccaaaatgaatgcacacaaaaggaaaaaaaaaaccacatctatcgattgcgtaagcacaacagatgggcaatacaacacacataaaaggaactttccgttgccaagcacctctagcaagtaatgggccaattggagccaagaacgcaagatctcaactggtcttccatgaggaccgccctgatagaaatgtctagttttaatgaccccattcacataatcagggattcgcaaggcgataaatgaaatgttggttgacaaggcaccaggcccagatggcttcactgggaaatacttcaagtcatgttgggacatcatcaaggacaacatcgtggcggccttcaacgccttgcatgacgctaggagcacgcacgtaaacctgctaaactcagcaaacgtgatcctcattctaaaaaaggatggggctgagggaatctaggactataaaccaataagcctggttcatggctttgccaaaatcttctccagagttctggccatcaggctacggccgctcatgcactagctgatctcaacaaaccaaagctcttacatccccgatcgaagcatttacgacaacttaatgtacgtcaggaatatggtgaggaaacaccacatgagtagaagaccaatcctgctctttaaactagacatctccaaagctttcgacttgatgagatggggctatatacctcctcaccttcaaaatagagggttccaaaaaaataagaggcagaactagataacgggcctcctatccacctccacctcaaagatcatcccaaatgggatcccgggagaagcgatcagccatggcaagaggctacgttagggcgacccactatccactggtgattagcaagatgcgaggtagagccgtccgcttctgcacatccatgtacaccgacgagacggtcgtcttcataaatccagacaaagaggacgtaagggtcttctctgagctactccgctgtttcggtcaagtaacgggcttatgcacaaacctgctaaagtcgcaggtagcaccgatcagatgcaatgacctggtccttgacggcatccgagattggaaataggcctgtaataaaacttctccttttgacattgtacgcggattagttcttactacgctaacactacaacacgttacaggcccaagagcccaatctaaaatattctcctactactactgcttcatcaccaaagcaactgattttacaatgccgatcgcagttaacgctctctcaggattcagcaatcaaaaaacaggttcacctccatccatcgtcagaactcagaactcaggcaaatgatattgatcctctttagtcagtctagtccctcggccgcgccagccacagcgagctcagcgcccggagccgcgagaagtagtcgctgatgacgagcagcgcccgcgccgcttgcctcgtggtcaggatccggtgcatctgctgcagcgtctgatgcctcagcagatcagcctacacacaatcaatcatcgcatcacgctgtggtaatgagcaattcagttcgcctcgccgtcgatgtttttccgaagcttcaattacctgacggaggaagttctccagcgtggtgagcttggccatggcgatggccatctgtcccatgtagttggtgacgttgtcggcgccaccgctnccgcttaccacggtgnnngnccgccgacaccaacgtgtcccccagcgtctgctgcagcgcctccatcccctgcgacagcgcgtcctcggcctgctgcgacgactgctgcaggttgcagatgcccatcagctgctgatccgtcagcggctcaagatggctggcaagaacctgcacaaacaacatcatcaacaatggcggtcaatggtagcttcaaattctttgcttgttgctgaattgggtgggtgatcactcgatcgtgtcaaaaccttgaggagctccgacgagcggaagccgccgagccacatgaagaagcgctcggcggggctcatccacatgccggagaggacgtggaacacgtcggacttggtggcgaagctcttgaggcggaacacctggtcgtagtgcatcatcacggcgtcgacgagctcgcacagctcgtcgtcgctcatctgcgcgttcagcgccacccgcaggtcgttgatgtgccgctggtgctcgtccagccaccgcgcgtactcaaggtcgaacgccaacgtacctgcagaagcaaacacaacacaacacagaatcagaattgcgatgtttgcgcagatgccatgacagatcagagaaatcaagcaagtggaaaacaccaccatttcctccgatcgagtgcccgtgatcgccggagcctccagttgcaatgaagattccctgtaaaggatagtcgtcaattgcatttgcgtatttgttactgagctgttcagacttcaaacattagattctgcaaggcgatttgataagtatgctgaacaatgcagggctcacctgctgtcttgccctttggagctcctgctcaaggtgcatcagcttggacctgctgctctccaactgctgaatgtatgcctacgacaaacagcaattcgcaatgtctttagtcatcatcaataaccacaaaacaaagatgcaagtaacagcagagcatctactcccagaacattgcagcaacggcagcagcagtcaacattgattccgaagcaattaatgctctagtatatttaacagatattgtaattgtcccattaatcgaatgaatgatcgataatgtataggttcagacgatcaccttcttcctcatccggctcttccgcgccgcctcgcgattctgcgcaagcctccgctgcatctgcacacaaattcggggacaaatcatattcagaatgaacacaaccaaattgatcactcatgagatcagattccgtttcccctctgacacaaaatgactgcaccttctgatcccctcttctttccttggacacggcggaggaatccgcgcctcgctgctcgccggcgtcgtcgccgccatcgccgccgccctgggagtagcacgagaaaccgcattacacgagtggagccagccaagaaagacggcggcgagaggaggtagctggtggcagtggcaccactagagcgtggaggtggtgcttgtcggcgctgtcgtcgaggtcggtggaggtgtcgtcggtgaacgggctgctgacgatgacgccggagtcgccccagttctccacctgcgaggcggccgccgccgccgccgccatcctcggcaggcagaaccggtccgccgccgtcgccgccgccatcccctggtgcgccgccatgcccaccaccgctacgccatgctgctgctggtcgcattgcatcagccgaagaatcaatcaatcagcaagaagaaagaaccaaactcaccncggcggcggcggcggcggcgacggcgagcggcggaaggtgtcctccggcggtgaggttgctcgacgacttggagctcggattcggaccttttcaaaaaa

SEQ ID NO: 88735 - DNA, 525 bp, Oryza sativa
aaacaagaaggaattccatgaggaaacatgtcggaaggtaattaaggagaatattttcatgattaatcttcttctgcccaaggcagctaaatgtattcttgaagcattttcagtagtatactattgcacttttagtttaactacttaactagtatttggttggtgtttatgcacattacagtagctggtctacttacaagaattatttttcttgacctttagataaaagcccttcatttatatgattgcttgagagcgaacaaatcaacttctgcatggggtgttgaggcccgtgttccgttccttgacaaaaacttcatcaatgtagctatggacattgatcctgaatggaaaatggtatgtacaccggacatcaacttttattgcagttatttttcttatattgtaaccagtactgtcactttctaacacttattatcctgtaaattttagataaaacgtgatcttggccgtattgagaaatgggttctccggaatgcatttgatgatgaggagaagccctat

SEQ ID NO: 88736 - DNA, 657 bp, Oryza sativa
ctttaaatgaatatttgcgaatttcttcatttaattttaatttaaaatggatttattgcgtcagccgaggggagagggcgcgcggaccgggtccacgggagtggggcccacgcggcagcctcacggtccacggtggaccgggtgcacccggctcacaccggccggcgccgtgggtcccatgcgtcagccgcacccgagggcgcgggcggctgacggccgggccccacatggcagccgcgggacgcgcccgaaggcggccacgccggcacagccgacgggaggcggcgcactcgcgccccgatggtcgccgccggcgaccaccggcacggcggagcggcgcccgaaagaggggagggaagggggaagcgaatcggcggtccacggctcaccccgggtcgacggcgacgacgggaacggcgaccggagcggaggaaggcggcggcgcggctcgggtagacggggacggcggcgttccggcgatcggcgaccgaaacggagaggtggacgaggtcggcgaggttgcggcgaacccgaaggaggcggcgccgaggcgggagagggtccggggcgacgacggcggcggaccggagctcggcggcgacggcggagagagagagcgatggcgcgagctcgattccgacggggagagagagcgac

SEQ ID NO: 88737 - DNA, 2540 bp, Oryza sativa
aaagcactaccatacaagattagacgagacgatccaggagaagttgacgggcagctaacgtagaagagaattcctactaaggtgatgtggtatttccctataataccacggctaaggcgtttgttcaggaacaaggggaatgctagaatgatgcgatggcacgctgaagagcgttaacaggatgggatgctgagacacttcgctgatggttcgtagtggcgaaacatcgacagaaaatttaaagactttggaaagaacgaacgaaacatacggtttggtttaagtacagatggcatgaatccttttggagagatgagcaacggccatagcacttggcccgttacgatgtgtatatacaacctccccccttggctatgcatgaagaggaagtacataatgatgccgattattattcaaggtcccaagcaacctggtaacgacatcgatgtgtacttaagaccactggtcgaaaatcttaaactgttgtggaaaaaggaaggtgtccccatgtgggacgaggacaaacaggaggagtttaacctacgagcgctgctgttcgtaaccatcaacgattggcttgcacttagcaacctttccggtcagtccaataaggggtacaaggcttgcactcactgtatggatgaaatagaaagtacgtatcttaagcactgtaggaaggttgtgtatatgggtcatcgtcgattccttactgcaaaccacccggtacggaagaaaggcaagcactttgaacataaggcgaaccaccgtacgaagcctaaacatcgcagcgggaaaacagtgtttgctatggttaaagatcttaaagtagtgttcagaaaggggtctggaagccagcctatagagagcgaagatggtcacgcggcgatgtggaaaaagaactctatattttgggagttaccctattgggaattcttggacgtccgccacgcaatcgacgtgatgcacctcactaagaacctttgcgtaaaccttcttggcttcctaggtgtatatggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatatttgaatgcttaaagagcataaaggtaccgtctggatactccacgaatataaagcgaataataagcacgaaggagaagaagttcacaaacctaaagtctcatgactgtcacgtgttgatgacacaactgctaccagttgtaataaggggtatccttccagacaatctccgggcaataataacaaagctatgtgctttcatgaacgcaatttcgcagaagatcatcgatccagatagattagaagcccttcagaatgatgtggtgcaatgtcttgtcagttttaagttgatatttccaccgtcatttttcaatataatgacgcatctgctttgtcaccttgtcaaagagatcggtattctcgggcctgtgtacctacacaacatgtttcctttcgagagttacatgggcgttctgaagaagtatgttcgtaaccgtgctcgtccagaggcaagcatcgccaaggggtatggaacagaggaggtcatcgaattttgcatagaatttattgaagaccttcgcccaatcggggtacctgaatcacgctatgaaggtaaactacggtgaaagggatctctcggaaggaaagcaatatatgacggtagacaacaatttattccgtaaagcccatttcacggttctgcaacaatcttcattggtagctccttacatcgaggagcacttggctttagttcgcgccagaaacatcggtaagtccgatgcatggattacacggcatcacattgatactttccccgcgtggctacgacaacatctcatgggtaacaagacgatcaaccaacaactggccttcctggtgaggggaccatctggctcgatcgcgacattccagggatatgagatcaatgggtacacattctacacgagagcccaagacatgaagagcacgaaccaaaatagcgctgttcgtaccgatgccatgggacacgatggaacaactggcacgtattacggtgccatcgaggacatatgggaacttgactatggtcctctcaaggtccctctgttctggtgccaatgggttaggttgactggtggaggcgtaacgattgatgacagtgggatgacaacagttgatcttaacaaggttggatgctcggaccaaccttttgtccttgccaatgatgtaacgcaagtcttttacgtgaaggacatgtctagcaaagcaaagaagggcaaagggcctgacgagtcgaagcgtcacgtggttttcccaggcaaaagaaaaattgtcggagttgaggacaagactgacgaggattacgatcagttggatgggcaaccccctttcatggtgacgattgaccctagcatcctcgtatcaaatgaagacaccccttactcacgtagcgatcacaagg

SEQ ID NO: 88738 - DNA, 3248 bp, Oryza sativa
acaagaatttattaatgacaccgggctaactacagatcaattgctacgaggcgcaccaatcgaaaaggcggaagtgaaatacatgtacgaactcggtaaaccgcttgtcaagcctgagcagttgcagtccctatccacacaaatgtacaaattccatcaactgtacatggagatgagtgccaccggtagagagatgatcggagcgaggatcagggacacggacttcttgcgaggagaagatattctctggatcaattttaagggtatctacgaactataccagctggacgccctcgacgtctctattatgagttgctgggttttgtaagtatcgttcatttagatttcttattacatttcctttagttaattaggtccttgtatataagtagactatatataatatatacttccttttatcgttgtagaatggagattcaaagggcccgacggcggggggttttcgatactggattcatcgaccctcggaaagtaaacgtcgcaatgctcgaccagtatccgcaagccacagaggacaatctcgtccatctcctaaaggcgcagcattacaagacgttcatactattgccgtacaacaccgagttagtttttactgtcttcctataccaaatttcattctcgtatgaacatgctaagtgtttcatatgtaatgcatccgatgcacattgcaaattccactgggtccttttactcttcgacttggaggcctgcaccgtcaacgtatatgactcaatggataaaaaagagtctacgtttgacaaggtttttgaacttatagataggtactgtcataagttcctatgttaattaagaatcttgttataattaattgctactacggatcatagctttaaactccatgtagggcttggtatcggttccgtcatttggtccgcggcaattggagagaaagacttaggcggaagtttaattttcctgtgagtacacatgctctaaatttatattgaatctccaattcaaatacatacaagtgtatattaattagatctctcaccatttgtcatttatatatagtgcgcaaagcaagcccagggaactaacttgtgcggctactacgtgtgcgagtattgccactgccttgcagaccaaatcatcaccacaagagagctcgatgtacgtacaaataaattcaaaatttcattgcgtacgtatcgatttgttgtttactaattaatttcatacattcatatagtttattcgtataagggataatctcacacacaaggaatttatcgcggtggttcaagaacaacttatgggattcatcaacgaacaaatccttgatcccaacggtgaattctactacgacggaaatacaattcatatgttcttagcttctgagataatgactactactacgtcgaaatcgtagctagctaggacatcataatggattgtaattaatacatatctatttttttatatgcatgtacacatttctttaatgtaaatatatattttggtcatatatatatgcacataaaatgttaagtgctttcacacacacacacatatatatacatacatacatacatacatacatacatacatacatacatacatatgcatttgcataacatatatatgtataaatacatatatatcatgcatgtatatgtattgaaacatatatatatatatatatatatatatatatatatatatatactatatatatatatatatatatatataaaccatgcagcaacagggccatgcaaatataaaaaaaaggtcagctcgatctttagtcccggttatttcacccgggactaaagatagcgatctttagtcccggattggtagtcccggtttgaaaaccgggactaaagggggttacgaaccgggactacaaacgctttctccaccagtgcccattgaactgatcagggggaaaatctaatcaagccgggctttagtcccaagccctatgtcccttgtctcattattctcaagttggagcagtgattcacatactgtatttctagaaataaattaacttaacaacatacttcttgagtccattgttaagcttttggagactatttatgaactaaccactactagagaactgatctttactcggatgacaaaaatcacatttgtcccggttcgaaaaggaaccgggactaaataagaaatctttagctccagtttaaaagcctaacggtactttatgatctttagtcccggctggtaacactaatcgggactaaagattatttttaaacagaaagttaaggaggaattcaattccataactttattcgaacaaatacctcagcaaaaactgattaccaataaagtttgtattttgcaatcctgaatacatacaataatttatccccctttcaaaatttaaagttgggagaaagtgaaagaacttctattcaactcaacaaacatatgaggtcatcactgaatcaattagttgtatatattgattgattgatttacatgtatatctcctggcctcgaactgtacccgtgcaggacaaccaatggacatatatgcatacagcacagctacaggctactactgtcaaccaaccccctgaatctgaagggaggaaaaaaactttcaaaactttcagcaattgagcgcaggggtactgtatacctctcaacaaatagtacaattcactttttagtattatcattattattatagtaataattattattaaaagtccttggatccttagcaaccatcaatggtgaactgatggaaaaagaagacgcatgtgtgaccgtaaaagaaaccagctaaaactaatgcagtttcgacgagttgttttgttcttgtgtgatttcatggcgagcgcgcggccggcagatcaaacttccgccatgcagcgctacgcgacgcacgccgtggcgacggcggcggtggcggcggcggcggcgcgcttgacgaagcggcccttcatccgcggccgcttctcggcgttgagcttgcgcacctcgtaccggatcttcttggagaagagccgcgtccgccgcttctccctgtacctcgacacccgcgcctccctgccgccgtccatccccagcctcggcgtcagcgcctgctcctcgccgccgtgcccgaacacccctgccgccgccatccacaccccctgcaccgccgcacgtcgccggagcaagtcatcagtaccagctaaattgtggagtatacggtgagacgaggcgtacggtgtgcatgg

SEQ ID NO: 88739 - DNA, 762 bp, Oryza sativa
caagcttttgcaatttgacaaaagcaacagacctgcatattatgggacttggaggaagaaaaggttagtatttaatttgaataccatgttcttaatactttccaacctcctgttttgaatgccatgtttcttaatgctttccattctgtaatcctttccagtgctgttgttggcccaagatgtccacttaagatggatcctgatcttgactatgaggttgatagtgatgatgaatgggaagaggtaattggtgattttgctcctttattctctttctttctggcaagaggtactcatgttgtttggcgcacaggaggatcctggtgagagcctttccgactgcgagaaggacaatgatgaagttatggaggaggattccaagatcacagatgaagagagcgaagatagcttttttgtccccgatggttacctctcggataatgaggcaagtcattaataagtgaattctttaccagtttacgatataaatagaacttttaagtttgtctttttgtgtaaatgtacatctctaagatgcttccatttagttactgtaactaacaatccgttctgttgtgagagtggtgtgctatttgtttctctgtacctgctgaaaggatgatagaaatgatacttgtgcatacttaaatcttcgttgaatttataagaaaataaaattgtggaacaagacaaatccttgtatgaatatgtatgctgatatgagctacgtcttctactttttccgtatatgaatatgtatga

SEQ ID NO: 88740 - DNA, 625 bp, Oryza sativa
ttgaggacttcgatcaggtggtggcggattcctggcagcagacggttgagagcacagatccctacgtcatcctgtacgtcaagatggcgcgtcttgctatgtctctctgttcctggggacaaaagaagatcagtcgctttcgcctccagctccagattgcgaatgaattgatcttccgttttgatgtggcgcaagagaaccgactcctttcccctcttgaacgccgtttcagggcaatcctgaagggccgctgcctggcattggcgtcactcgaacgaatcagagtgcgccagcgggctcggatctcccagctccgggagggagacgccaactccaaatacttccatatgaaagtgaatgcgaggcgccgtaagctattcatcccagtctttgagtatgaagggcagacagcaacctcgtaggaagataaaattgctctggccaaggactattttcagggaattttgggtgtggcggatcccgactcggctgagctccaattcaatcaaatcttccctccggcgccgaacctgcaagagctggaagtgcctttctctgaagaggaagtttggaaggtgataaaagagatgccaaacgagaaggcgccgggaccggatggattcac

SEQ ID NO: 88741 - DNA, 1302 bp, Oryza sativa
gggcggtcagcatgcacctcatgctatcttagcaactgcagattcccaagtgaatgtagaagcatcaacacaagaaatggcatctaacgatataccaagtgacctaccaaccttggaatttccagaacgtgagaaaatgctgtcagctccagacgttgaattgtaccaggcaaatgacttgggccaggtaactgcagaaaagggaaccactgaatctgatggaagtaacaaagtaggtagtctcactagcagaaaaagacacttggaggacagtttgccagctctcgaaagtgcaactactgaaaaattgtctagcagaccacgtggtaaaagaaccattgatggtattcctgatgatgatgatttactggcgtctatattaggtatggatgaacctcctcaacaataattgtgcctggcttttgctgcattgtctaacactaactgtgtggacttgtatttagttggtagaaggacccctggactgaggcttgattcaacaccaataccacctaagacgtcatctttgaaacgtccaaggttgacgtcaaagagtaccacaccgaagagaaaagtgcaaatggatgatgccatggttatacatgctgagtatgtatacgcctcatagccttcaaacaagtttgttgaatggaactgtgtgactgttgttctttagtgttatgtccttaaatttctgccatcactgtcttctgatgggaaacaaatagtatattttttccgtatattcttgtaaattttgtgcagtatatacattgagttgattggtccatctctggaaatcagattgcggactattttgctgtccaaattattttctgctgtgatattatttactgagtttcttccattctccagtaccatacggcagcagttgatcagcactgaggatataaggcgcattcgtaaaaaggctccatgtacccgttccgaaatatggatgatcgagaaaggttccttagaagatgatatattccatgagcccatcttttcctgtaagctacttaaattggtttttattctctgcttcctctttacacatttactgtatgttcaattcaattaggaaagaactgaaacagaagtgaaattagttttgatatatgaggataattagtggttagttttatgctctgaaattctactgatgcatgtttgtgttcccaactaggcatgtgcaaggagctaaacgatttgcaatatggacctatgagattgttgctcatcccaccattcataatatggaaatacatgtacggctagacatgtcccaaactatggcag

SEQ ID NO: 88742 - DNA, 2606 bp, Oryza sativa
ccatttttgtaatcaacataaacaatgccaaacctcttggtgtatcccatagcccactcgaagttgtccaggaacgaccatgcgaagtacccacgaacatcagcaccatccctgcatcatacagttagttgcattagttgatttttagcagaaaacacttagacgcgtggtaaacagcaagcaaaatcaactaacttgattgcttgtgcaactgacgcgaggtatcctttgaagtaaccaaccctcgtcgtatcattcaagacttggtcaagcgttgccgattgatcatcttcctcatccatgcctacatgagagaaactatggtaaaggaagcaaatatcaaatgtgacaacaatttgaagtgtgctcgcaaaaacctttatcatcaggtacagtactagcgtaacaaacatcataccgggacatttcacatacaggattgacaaatttaattcactccagatttccaataatgttttacttttactactttgcatattctgaccgctccagaaattaaaacaaggaatggccaaagactgtatcaagaaatttgcttccagaccatatttatagggttctccagctttggtttttcatgtctcatgtgctatctctataatctatatagacctagtaatgcatcagttgtgagctgtagctctcattcctgaagtgaagagtgaaataatgtaaaccctcagaatgtaaatcggttcactgctcaatagtcacaggcaaacatacaagttaattatgtagaacaaaggggcataaagatatatatgttagaaaattctatgttgcatcacattcattttaggaggtatggaaaccttaccattctcagttacatatatcacaggatttccatatctctttgctgcataattaagtaatttccggaggccccaaggaactatgaaaagccactcagatgcggcctgcaaaaatgttgacatgatatgttaggacataatccacagaatttacacgagagagagagagagagagagagagatcagttctgaccctttcaccaattttttcaccagtgttccatttttctgcaaaaagtaaacaaatgttacaaatagtttgatcataaggttttgcaaaaatggaagatatcatttcattttgaataacataaaggagatcgcagtaacacaagccaaactgcaataatgctagtattgccacacggaccaacaaatttgcagtgttttactccaagaaaacagtctggaaaaatgaaacagaggagttatgtggatttcaagttcgttagtaaagcgcttggcaatggagatggagttaacagaaaggttactacacaggtacaaactgacaaactgttcttttaactaggcaatggtcgctcttgcacataaatttaaagtttgactcttgctaatgaagcctcttacatctattataagcggttcaacagttttcaatgcctatgcattatattcttttgtttgaagtataattgttgtttgaggtcttatgctgcaacaattgtgtaagagaaagattctgctgtagctgaagaattgtacctattctctccacttgttgtactcggtaaaaataaatatcttctggatcctgatgatgagcaatgaatcttgaagtataatgatttattccaacaaagtcaattttgttcctgataaattctttatctttctccgagaaggttggaagatcatcgcccagtcgctgacgcatactttctgggtaatcaccgaaatatattgggtccaggtacctttaaggaaaagtagcacctatgtaagactatgacacgcaatatcctaagcctccctgagccaaaagatgtgggagcattgtaccatgaaaaaaaaacatgttacaatttctctcggtgtatacacaaagcatttatgccttgtgggagaaaattcagcattttccccatgtttcaggaaaaaaaaaagatgcaggacaatactgtgcaaagcataacattataccatgaaaaaacattttttgccttgaagaaaaaaatggtagaagctttcccttgtttcagaaacaatattgcagcataacactgtgccaaaggtagctaatgtgggaaactgtgacgcaagtaatatgagcagaaattataccatcctagctgaaagtcaagccttcgttctgcagcaacctgatcttctgttttctctgaaaatggctctgcccattcacaatcgacaaccaagcctacttcaccaccttgcacagcctatttttgtataatgtaaaactgtcaggaaaataaaatgttcttcaactacaaggaactgatggaataatgatcagggtgcccaaattttctgctaccatatctaccaatggaaacacgtatcatcagcaccaatgtcctgacataggattaatagaacacaaccaatgtcctgatatattagtatatcactgagacagaccttaaatttcctttgtaaacatcaacagcagcagcatgagccaagatttggtagtgggcggccacgtagcatctagcagtttccccttcacatcctccaggtgcaaaatgtccaattccgtaaccattaactgcagtttgaaga

SEQ ID NO: 88743 - DNA, 1273 bp, Oryza sativa
agcattattattcaaggtcgatcagcagttcatcctaccgatatggaagttgatgataaccaaaataaagatgaaagcgctgaaggatacaacatggaggatggaccttccagtcacaacaaactaaatccgttaagtgcagatggtctagtaggaaacagtcttcctaattggcatacatacaatgtgcaaacacctgatctgaatgatatgctattgaacaatgatgggaatgcaggaccatcagcttcatactatcaacctagtcccttcccttgtgatgagcctgcatcaccagagtttgtaagtgcccaggccccggctacacctggcctaatggaagagactgttccttccagagtgcatgaaagtcctgttctgagtccacagcgaaaagcttcaccatcaagcaatgatgaaactgcaaagacagctgaaaatgctaatgatcttgtgggtgctgagacgactgaacttgcattgacaaagcctgtgcaaattgaatcttctggtgctgtacaggagattgattccttgagtcaacaatgtgcaactgaggaattgccaccccaagctgaaacctcaaacttggaagctaccatggacaagtcaatgataaatactgatggtgtagctgcatcaggtgaagctacagctgctaaagaaaccactgaagtgtcattggttgaaaattctttagagctatgcgctgatggtcctactgaacctgtgattgagaaccaaacacagtttaatgatggatcagttgatgtgcaaggtaaattgactattcgttgattttgtttttaaagtcattgtatttgataaaaaaaaggtgaaatcatctgctttttgattatttgttttgcagggggcggtcagcatgcacctcatgctatcttagcaactgcagattcccaagtgaatgtagaagcatcaacacaagaaatggcatctaacgatataccaagtgacctaccaaccttggaatttccagaacgtgagaaaatgctgtcagctccagacgttgaattgtaccaggcaaatgacttgggccaggtaactgcagaaaagggaaccactgaatctgatggaagtaacaaagtaggtagtctcactagcagaaaaagacacttggaggacagtttgccagctctcgaaagtgcaactactgaaaaattgtctagcagaccacgtggtaaaagaaccattgatggtattcctgatgatgatgatttactggcgtctatattaggtatggatgaacctcctc

SEQ ID NO: 88744 - DNA, 568 bp, Oryza sativa
caggatctattatgtcgttctaccctacaattttgctagatacaaaacaataaaataaataatatatatacaaaaattcagatgttgatgaaattccatttttttgtggtacttttagtagattttactctgtgttggctcaatccgaaggaaattatgcggaagctttgcaaaattattatgaagctacgcgactagaaattgatccctatgatcgaagttatatactctataacataggccttatacacacaaacaatggagagcacacaaaggctttggaatattatttccgggcactagaacgaaaccccttcttaccacaagcttttaataatatggccgtgatctgtcattacgtgcgactatctccactatagaaagaaaaataagaaaggatcaaattttctaatatttactagaaaagggtgctttctacatagggatcgtcaaaacaacgattttaccctatcagctgtaggaagaaaggacacttcacgagaatcaaaataggaagaaagaaagtatggcctatactactctatggatagagttctcaaacggactt

SEQ ID NO: 88745 - DNA, 811 bp, Oryza sativa
catgcatgccataacaacagtgatgaaaaagaatcaggtctctcctcgaattgaggagagtggaagagattgttctagcctctgtacacgccggagggatcagcgttttgaactatccaagggtgctcgaggagcttgtggaggggcagacgatgcgccgaattcttcacgagcatctgcagatcaaaatgctttcttgaggttcacactctggtggatgttctacttgtgtccaagtgacgatttacttgtcacagttttacagttatgtaaatcatcaggacaggagcatgcttcttacctgtgaaattaggtctttcgcagccggggacacgaatggtttcagtgggaacttcaagtcaactttcacaatcctgcatgtccacaagacatttcagagaacagtgcttgcaagaagtttcatggaacttattggtaattacaggtgagaacaaatggaattaattgtactctgtcgagcatggaggatagattgaacataatcacgagtgtttattaaagtagcagaaaaagataaacaattagcagagtatagctcagatatcagaaacgatagtgcagaatacaacctctaatgggcaagagacaatgagattcacaagggcatttgagatatgtctcaggctagttagtaaaaagtcactgcattctcactctgaaactcatcattacctgcgatatgtttcggagtgttcttttgcttcgaaaggtgggactccataaaggaactcatagcacaggatccccaagctccaaatgtcaacatggtagtcatgttcagtcttctcca

SEQ ID NO: 88746 - DNA, 815 bp, Oryza sativa
caaagtcttcacaaaagtctttaaacaactccgccagtgaattgtctgccattatcagtgatgatccgattgggcactccaaatctatgcacaatgttgatgaagaagtctcgagcgttatctgctgtgattgtgacaaccggtttagcttcaatccacttggagaatttgtcaatggccacaaagaggtgcgtgtaaccgccgactgcctttttaaacgggccaaccatgtcgagcccccaaaccgcaaacggccaagacagtgggatggtctgcaactcttgagctggtagatgaatttgtctggcaaaaaactggcaaccttcgcacgtgcgcacaattttgtcggcgtcggacactgcagtaggccaaaaaaaaccctgccggtaagctttgccgacaatggtgcgtgcggcagcatggtttccgcatatcccagaatgtatgtctttcagcaattgtctcccttcctctaaagatacgcagcgttgcagaatccctgaaaggcttttcttgtacagctcagcttcatgcataatataaagtttgcttcgtcttgaaatccgctcggcttcatctttgtcttgggggagttcttgagaagtcaagaatcgtatgaggggctctcgccagtcgacttcaaccatagctacgtcatgagtgcccgcaacttgagtagtatctttgtgaggtactgtcggcgtataaaggtgttcgacgaaaacatcggagggcgccacctcgcgcttggatccaaagttggcaagtctgtcggcggcttcattattgtgtcgaagaacgtgactgagctcgag

SEQ ID NO: 88747 - DNA, 552 bp, Oryza sativa
taagtattactctgagcagttatttcaaagcttgccttgtcttttctttttctttttcttaagaatggatgtatacattgtcacagacaaaatacggggatagagtgattggccttatgctagtttcgccgttatgcaaagccccttattggagcgagtggttgtacaataaggtactaacatacatttaaatctgtcggtactgcagtataggtaatgtgttctgtgaatcaacctcaaactcatatgtaccaggtattattaaacttgctttactattatgggagtcgtgggctagtcaaggaatgcttgcttcagcggtattttagcacggtatacttggtcttctgttagctgctttttatttgcatccttttatgtatatcagcttcgctcaacagttttctgatgctatgtgcaggaagttcgtgggaatggacaagaccctgaatcagagattgtgcaagcctgtagaagtgtaagtagttcatctcctcgtcagctttctgatatgattttgacaagattggtagctgtctacttatagaaagt

SEQ ID NO: 88748 - DNA, 669 bp, Oryza sativa
agtccatcacatcttgcacccttgtttaataactgtgctccatcttgcgaggtgaccattcttttccatgcggactccagcgatgatatcctccaagccgcgacatcagtttggacgctaaggtatccggggatcagatggcagtggggtacctggaactaatccctgcatatgtgcatcaacatgaagataaaggatcacatgtgacaggactaacactacatctcgcaccttttgttaacatagtagcctcttctaaagtattgcaagctgttattctgttaggcttgctattgctagtagtactgattaatgttggtgagcagatggatgctcaatttgctcatagggctttgtttgcccatagcaactgtgcgcaaatgtgccaagataactaacttttggttgttttctgtgcttgtacatcctacttaatgttggaattatatactcctacattagaatatgtacttttaccttggataccaggatattgtttgtgacctcagcccatctgcaggatagcataacatttccttggcaacagtgaacaatatcatcttcatctttttacccatctgcacatgcatacatatgatatgatcctctcatgcagtgatgcctaatctggtagcaataattaatttaactatggctgtatcaggatta

SEQ ID NO: 88749 - DNA, 869 bp, Oryza sativa
cgcctccgcaggtacgtatctgaaatcttcaacccatgaccaaaacataatcttgtcttcatgttgagttaactaaccgcggaggcatctcactcaggaatatgtattgatgaagtctgaccccccaatcactcagcgccggtctcctcgccagcacaccgttcagggaggtggagggccgacaatcagatcagatccgcaacctcaaacctccaatccgactgggcagacaggttctcgcaagagaaagctggtgcttaatgacgacgaaggcgacgacggcaacaaatctggggacaaaggctcgcccaataaactcccaaagcataccactcccaggaaaaaactggctagtcgtccaaggccaaagatcagaacatcttccaggtataaaactctcggtaccatttcacttcgacatgcttctctcatggaaataatactgaatattgaaagaacactttgcaggaaaccatccgacatagatccaactggaaaagatcctgatccgactgtgacagaaccaagttcatccaaggattctgagccgactgccgaaagccagccgactggcgcccatacttcaggtgataaggccaatccgagtgaccagcctccgactgaaaaccagtcggcagcaactgaaactacaacaacccaagagcccccgactggaaaccagtcggatgtaggtccagatcaagaaactcccgaagttgaagcgcagacgacaacttctcaaggaccagaggctggtaacgactcgttgattgggtctccagataaagaacaaggatcaccccacggtcagctaggaacatcctcaagtaactcatcttctcaagtgatgccgatttcaataacttcag

SEQ ID NO: 88750 - DNA, 2027 bp, Oryza sativa
gggggggaaagcttgggtttatatgggcgacaatgtcggtttgggagaggggaaccgactttggacggtcaagccagcgagttggcgctccggctagcagccaaatcggcgacagggaggaggagaatgacgccggcggaggaagaaaaaggaaaaggaaggaagaaaggggacttgccccttgccactttgggaaaaggaggaggggatgggggcgacgcggcagagggaggaggagctctgcctccgtcccttggaggctagcgtgcggagtggcgggggccgggtcgatgacgacggcgatgacggcggggcggtgtggagcggagcggcgacacggacggcaggcgtgggcaggtgcggcagaggctgacggcggcggcgaccaggcggtcggccaccacggcacgcgcgcgcgggaagcaacgggcggcgcggcgatttgggcggcatcggcgggaacggcaggagggctcggcgcggctcacgggcagagcggggagagagagagagagagagccggggagggagggggagatgggccgagagggattcggcccatcgaacccgagggaggcaaaatagacttttgcggagggatttgatttgggaaggatttggattcgggattgaacttgacgatagatcagggatttgagatctgagatagcacggacactagacaacaagcaaagaaacggatttcgcaaatagggtttttaagagatagttttcccgctaggcgctacgacggaacgggcgctacaaatactatttttaaaaaccagcactaatacttacgatggtaagcatgttcccaagtactaaaaaaagtcatggaaaaatcacagcttaattcagtggcaagattatcttagccatatgaaaattagcttatctgattaagatgctttgttgcatggatgccatttttctaggaaaaagaaaactgaaaagaagatctatggcatccttgcatacgttataaataaataaataaacaaaatgataaaatttgatgaattgtgccaggctgccagatcgtccaactggtgtgtttccaagcaaaaacagatatacagtgacgtacaaaatatcatcaaatttgttgtgtcacacttcaggcagcttaactgaactcatcaagtttaaggcccatttgggacctgcttcatacggaaatcgaactgtttcctgctcagatttgggcgttctggaacggggacaaagagaagctgagatttcaaaatgaatcaaacaaattcagatcagtttttgttgtttgtgtgtgtttacatgctctgctttgaggctcatgaatcatgatctctctctatgtacagtgtgaaaaaaacagaacaaaaaaaaaaggggttttttcttttttgtgtgtgtttgatttgagatatctctatgatggttgatctatctatacagaatcaaatcaaagaagaaaaaataaattcgaccataaaaccctcgaataaaatgtcgaagaggattagtggtctgttaatcttgattagccgtcttgacagtggtgggttaagactctgtcagattagcccgagcgtctgcaccaagccgcccatctgtatcatcgccgcgtcgtgccacggcaatgcgccgccgccgcgccgccgacccacgaagtccatcaccttggcgagcacgccgccggcgtcggcggcggcggcggcgggctgcttcttgtcggcgccacggaggagggagatgtaggtggcgaggtcgtggacggaggcgaggtcgccgaccttgaagaagtcgagggggagctcgacgccgacgtgggtgtagcaggagtggcgccacgggcggagcacgccggcggtggcctcgttgaggaagacgccggggagcttggtgatcgggtcgtgtacgttggtgacgcggagcgccttgacgccgagctcgtcgcagcgcgccttgaacgccgcgttccccaccctcggcccgccgaaagagaagacggtgaccggggcggcgcggttgaagccgagctcggc

SEQ ID NO: 88751 - DNA, 778 bp, Oryza sativa
gagtttgtttggcagcataaagatggaactactgtgataaggctaaactctttcactcatcatcctcttcctcgtcatcatcatcagcaccagcagaggagttgagagcattcaatctttcgacaagactggccttcctctgttcgtaggttagcttcttgaggttgtatctgagacaaagatgcaagttagttacaatcatacatggacatcacaaataatctttccagaaatcatcagccagattcatgtacctcttgtgggtcgccggttccttcttggttgatttggccatggtaggatcagcacggatggcagcatggaccttcttgtacagtgcttccatgccatcagcatcaattcccttcttgaggtactcactgaagtgggcttggaatttctcaggttcctcctccgccatagactgcaagaagtacataagtagaaattttaaactgatgagaataaaaatcaagcagactgagctaaacagtaacaaattttccagcctgcttataatgttttagtcaatattacaagcatcaaggcagctacataactcctaatacaacacacagcaatgtcaaaatagcacgaacaattgatctaatagtgccagctcaccctcatgtagtcagccacgtgcccaccgtagatgtacttgcggtgaatatcagaatcaagctgcttctcgtccttcttgaacccagcaaacctcttgtcactgtgaggaatgtcaagaccaccatccaaagctccctgcagaagaaaagagaag

SEQ ID NO: 88752 - DNA, 625 bp, Oryza sativa
atcgatttatcgccagaaatcaagagattatctgacttgaggtccctatgaatgaacccaagagcatggacgtaggccatgccccttgcaacatccaaggcttgcttcacagcaagctttaatggaactgacctgttctgcctcttcatcagaaactgcctaactgagccaccctttgcatactctgtcacaatgcaccaaaccatcggcttcctgcatgccccaataaatttaactatgttgggatgcctcaaagttgcaagcatcataacttcttgcacaaactgtgttccattagcccggctctctccggatccgcctctggcctctccaaaagcttgatggcaacatcctccccattgtaggtgcccttgtatagcttcccaaatgcaccctgtgcaaagggcatccccatgtggagcttacccaaatcgatcgtccactcctcgtaatccttgagcgtctcagtcgggtacctcgggtccatcagtgcccgtgcaagcgcatcctcactcaacgcatgcgacacccgcccggggcggaaaatgctgtgcccaaccgagtaattggctgcgacatgccccctgaggcccgggtggttgagcatcctggtgtgggaatcact

SEQ ID NO: 88753 - DNA, 2771 bp, Oryza sativa
atcccccattttataactcgtggtgctaataaaaaattgataatccagcataatcaaataacttgaaatgaattcccctgtgcgttgatagtaataagccaacttactctgataccaagaagtgcagctacagaacctcctaaagaatgcccaacgatttcaatattgtatccatggcactcacatccagcgccgagcaaagaagataagaatccagctggcactgcatctggtttatctgcagacggtctcaagatgacagttaatcccaggtgctaacttgaaatttttcaagaataagttgctatagtattagcgaaacaagtcactcgttcagtccaaaaaactgaagggttcttgtttgtacatagagaagaatctattctatacttaccaacttgtcatgcttaagatattactgacgggtattttggtatttttatatctataaaatatgattgttaggaatgtgtgactgtcatctgatcaaaatatccatgtatttaagttccacatcaaatataaaatataaagttacattatttccatgctaaccttgatggatgggcagcccttcaagcttagcgtacagttctcgagctgattcaaccattccagcatgtccatggtgtggaaaggatgagatgacagcatccttaacttgtaggggtaactgatcagaactgcaatgcaacagatcattttatcaagaaaaaaaatgagtcctaattcacatttaattcagattgaccataaggaccataacgaagaagagtatttcccaaatttaatcatggcggaccatgagactattggcagtggggagttccagatagttcgtttcatgcacaagcagctggctaaggataagccttatttattcataaaataaccagcagcttactctagataagttttagtgtaagtaagggaaatgtagaaaaagtaaagttacttgatcagcccatccaagtcatccaccgtaagagagcattccctacacaagccatcagttataacatcttcaggagtctcagttccgcggatggcaatgactaacgttttcaaatcgtgcaggacaacaacaaaataggcagcctcacgtcttgcctacatacagaatacaaaaccttaggttcgtcacacgccataacaaaattgtaaatagaaggtgaggtagactgctgattaacctggctaacacggccttttataagaacttccgggggtacactgacatattttaggaaagcagctgcatgccctcgccaccaattatcgccttcaagaactggtcgcctgtcaaactaaagttccataagcgtgactatataccatgcagcaaagacacaacagacaaagacagacatcacataaaaactaaacataatctggagcaccaattggctctgatgcaaaatttagaaagagctgaaattcggaattaaaaaataaggaatattagaagaggagactagagtccatatagaaatccaattaggaaataacttaaattcggaattaaaaacaaggaatattagaagtagagtatagagtccatatagaaatacaattaggaaataatagaaattcggaattaaaaataaggaatattagaagtagagtatagtccatatagaaatacaattaagaaaaaaatagaaattcagaattaaaaaataatgaatattagaagtagagtatagagtctatataggaatttaaaactaactataatttggaataaacataataaaattaaaagtagagtttagaatccgtataaaaatacaatttacaaataactaaaattcgagattaagaaaaaacatgggaagaaaagtttaaagtcaatataggaatacaatttagaaatagctgaaattcgaaattaaaaaaaaaaggaatattagaagaggagactagagtccatatagaaatacacttaggaaataactgaaattcggaattaaaaataaggaatattagaagtagagtatagagtccatatagaaatacaattaggaaataactgaaattcggaattaaaaataaggaatattagaagtagagtatagagtccatatagaaatacaattaggaaataatataaatttggaacataaattagtagttttgaaaggggatttaattattcgttctttttccctttcattttaattttgaccccaagggaagctgcaatgtcatgttttaagtgactgtgcttgtagaagagaccaaatttatcaaattaaattatgcaaataatttgaagggttctgttgcaatatttatatgagctgtctctgtgccatgctaccaaataacactagtcaagttctaaaatatgtcttcttattttcgtataaagattgaacggacatcaaagtaagcaagcacaaattatccaagtgctaaagataaaagcaacactgacaaaacatgtgcagcataatctcttttttttttgtgcaactagaagagcatagccccccccccccccaaaaaaaaaaaaaaatccattagcagaaatgagcattacaaagttttcacaacataatctaattatgttttgcaaaagcatgtaacaaagcaccacatatttacctagcacgggtccatggtgtcataacaccctgccgattgagccaaacacatggaaacataaaaggattccttccaaaatcaagaagtggtccctgcaaggagaacatgtaaaaaatgtactggcaagactgaaaatgacagaccaagtaaatgagtcaggg

SEQ ID NO: 88754 - DNA, 580 bp, Oryza sativa
cacgtcttgtcggcggaggtgtagaggctgaggaacccggactccaccttgacgtcggggcgcgggtcgcacgggtcgagccgcgccgcctccagcgagctcatgaggttggccatccactcggcgggggtgaccgtgccccggaacgagacgagcacgtcgcgccgcccgagccgccgcgacatctcgtcggtggacaccgcgacgtacccgatccaccgcccgcgcccgctcgtcgacggctccatggtcggcacgctgacgtccgccgccgcgtagatgtagcgggtgacctcgtacccggcgccgcccatcccgacctcctccagcatcctctccctcccgtacttgcagttgaggtacctccgcgacgccgggtccaggtcgaacgccttgtagcacgcgcccaccagctcgccgtaccgcgccacctcccccctcagcaccgggtgcggcgccggctccagcatcccctcccaatccccgcacccctgcacctccctccacatccccgccaccgtctccgccgtcttcctcgccgcccctcgcctcgccaccggcgccaccaccgcatccctca

SEQ ID NO: 88755 - DNA, 780 bp, Oryza sativa
aaaaaggggtacaaggcttgcactcactgtatggatgaaacaaaagtacgtatcttaaacactgtaggaaggttgtatacatgggtcatcgtcgattccttgcagcaaaccacccggtacggaagaaaggcaagcacttcgaacataaggctgaccaccgtacgaagcctaaacatcgcaacgggaaaacagtgtttgctatggttaaagatcttaaagtagtgttcggaaaggggcctggaagccagcctatagagagcgaaaatggtcacgcggcgatgtggaaaaagaactctatattttgggagttaccctattgggaattcttggacgtacgccacgcaatcgacatgatgcacctcactaagaacctttgcgtaaaccttcttggcttctaggtgtatacggaaagtcgaaagatacactggaagcacgtaatgatctaaagcatatggaacaacgcgacgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaagtctcatgactgtcacgtgttgatgacacaactgctaccagttgtaataagggctatccttccagacaatgtccgggcaacaataacaaagctatgtgcattcatgaacgcaattttgcagaaggtcatcgat

SEQ ID NO: 88756 - DNA, 1391 bp, Oryza sativa
ccctggaaagagagagatgtcagaacaagagcataacacaatataagaaattaccctgacagtaatcaaacaacactgacctaataatcttttcatgctgtgtatcatgagcataagcaagcatctcactggccttctcactggctgtcccaaccataagcaagcccattccaataccagctgcttcaccagccacagcactgtccgtgtaaagacattttttatgtcctcatatatctcctcatctgctgttcccaaagctgcaagcccaaggcccaaacaggctccgtgctggatcacctatataatttgcttagaagtaagcaaaatatgcatgacatgaatgacatgagattaaaaagacaggaaaggaataaaaggacacctcagcactggtattgcgaaggctttcacgaaggaattgtttgatcccttcaccatggttagcatgaatcaaacccagggcatatagggcacctccttctgagtatggactaccaccaccaacggcaccactttgaggtaggtagggggccatcaaagctcgcccttgttgaagatggcctctgtgaatgacacctagtccagcggttgcgctgaatttagcccaattggttgccctgcttaaccactcctgcaagaaccaacatgagacaagaacagacaaaggccaaaatgttgcataacagtaagacaacaaatagaaactaaatgtaccagattctctcttaggaaggtgtctacagttgttccagcatgcatgattgcattggtacatattgttgcactgtggcaaacactgttcctcatttccacagcctgctttattgttttcaaaattaaaagatccgacctgttgagacaaacaagttgcatcaaatcagcaccaggcatggaaatttgcaagactggttatcaacggttagcaagtactccctccgtttcacaatgtaagtaattctagcatttcccatattcatattgatgttaatgaatctagacatatatatctatctagattcattaccatcaatatgaatgtgggaaatgctagaatgacttacattgtgaaacggaggaagtaaatagtacgctcagttagcaagtaatagtcagctcacctattgtggctatacaaaaattgcagtgtcaactggatagatgtctcccctgacagtattccttttattttcgcaagcctatcagcacgtgctacctcatttggatctactgtgtgagaactaccatttggtgtagctgtgtcatctctcatctgaacatccccagctggttctgtgctgcccgtacccgcattagcagcttgatcatccggtaaagccgatccactatcagggttagactcaggagtttgtgaagccagacgattcctc

SEQ ID NO: 88757 - DNA, 602 bp, Oryza sativa
cagctccaatggctgctgccggtgaccccccatccctccctttcttggctagtttcgccattgtcagcttggattgatttgctcacctggtgcttctcccccttttccgtctctgcagctcacatccgctcaaattcttcacgatccgtaagtgtgtatgagttcttgcggatcagaagctaaatttataatcgattgtatcaattcgtgaattcatattcttaaattgttggaatagatgggctgtggccgcagtacagctatgggggatggccatcctgctgcaggccaaccacattcgacggcaacaaggtggctgccaaccacccatcttatcttcagaatgggatattgggatgtggtcgttttcccccccaatttgatgaagaactgctagcttcttgctgtaagattggcatgtcaatgtgggtgtgtatttatctggttttaccttgtgacagatctcgaggttgaagacgatactcgaggagtactggccgtccttgtactgcggctctttctcaacctgctttggtgggaaaaggccattttgggtgcatgaggtagacattggtatctaaatgagatatgtgatttgatga

SEQ ID NO: 88758 - DNA, 692 bp, Oryza sativa
cttcaacagagttgatgacttgcaaaagcccattgaaaacccagaaaacataaactgggaaagctatgcaagaggtgctgtttatgccctgcaaaattttggatatgatctcaaaaaggtgacttttacatttaataattcaaagtccagaatatcatatgctttaaataatattgacagatgacttcttgtagggtattataggatatatatctggtgtgaaaggacttgacagttcagggctcagttcatctgcagcagtaagctaactgatatgtcatgtatatttgagttaaaattgctggcacaatcatctgtaatatgtagaaaactggaaatatgagtttagtgccgacctagctgtgaatcgaatatgcagtatttcataatcatgacatatacttggctcacatttgacttggagttcaaagcaaatttgtgaagctactaactgctgtactagtatcttctgaaccttcagctcaccataacaaggacagaaacttccagttcttactgtaggttctctaaatgaattattaatataattgatactttggttaagttatgtgatcatcaaatgcctatttctgtatgctcctcatcaggtcgggattgcctatttgatggctttagataatgtgaatgatctggttgtatctccagtggacaacattcagttggacaagtga

SEQ ID NO: 88759 - DNA, 2133 bp, Oryza sativa
gtgacagaagcatctctatgtgaagtgaatcaggttaattagcctatgttgatttcttgtgatgaactttcattcacctgatctgaaactgccaacacttggagtggagggtgagctttgtgcaaggatgacagtggaaggttcctgtctatgtgaaaatgaatatacaaacaaacggaagagaaagagtacatctttatacttttttcctaccctcagggacctgcaatgttcagctggtactgcatctaagatctaactaagtttccaggctttgcctcctttcatgctgaacttcttgagcctcccaaagaacatcacaaaaatgagtatcagtttgccagagtcgctccatctccctacgaaaccagtccatttatctgtgcagagatggtctggattgatctgtctactgcaactgtagcccattgagaaccccacatttccatatgcactgcaaatgtgggcagatccgtcagattccacgaaagaaaacattactattttcattgtgtattattaagattcagaaatacctgacaagtgttactttgtgttttgctgtttcatcagataaattgttaatttacttggtctgcattttttttctcaggtaagaaaccatttagtctgacttgcctgacaacttcgacaacaatgctagcacactgaagttgagggggtcttctttgagctttcttctctcggtgatgcagatggcaatgacaaagatggtcaggtaggagagttgtgacaaaagtgtactctcgagcagtctgattccctggttctctgcattactatccttagtagtggaattctcttcaaatgggaaccacgtcgtgtacggaggtagatacctggaggcaagatgaagcagaatatgagacaacaaacggtacgagtttaaacagacatcagttaatttgcagcaatctttccaattaaagtttcagtgattagttgcttattttgggcattgaaaatgcatgcatgtcgatgcagctgcttaacgaaatgcgatcagaaagtcacccttgggtggattatcatcttcggatgttcaaaagcagatcattattgagaaataattcagggaaggagttgcagctctgcttgtctaaggtttgatctttcaggtgacgtgcaagaacattctggtgcttggttatattctctgtaaatgatgcgacaataagatgaaaacatggctcaactgactggaagcttggattcacaagcatatggccttgagagaacaatatgggaacaactgctggccggtgaagaaattcctttgcacgcgctacgacaatcggcaggagatatcaccctgctttagccatgcaggtcattttcagaggcacacatcccagttcctaaaccaggctgcaaaagttgacgaatgacgactactgtgctccactattttgtactccatgcatcaactggggaaagatggcgaattttatggaattgcatgtgaaaattgagccataatcatctggaagaaccaaagattggaacaaattctagcaactatgcgcctcccattttgacatgaacaaaattagaagtaatagtcatcaacctcccaggtgaccagatttgctgagaacgcggagagcatattctcaggttgacagaaggtgtggcatgtgatgcatgcaggcttttgaatggagacttggaatattaatactcctacctttcagcaaattgattgtggtgttcttgcaagttgaagtggtgtgctgcgttgtggtttctgtgaagctaggaggagagctatccttttcttctttggcaaaaataaaaaaaaatctgtcaaaaatctaggagaaagggtcaacgcacggtcaactcctacctatggtcacgaactgggaaatgggacagtgttttgacgtttgaaactactctccatcacatgcatctacctacctaaggccattctcaacccaataattaggatgatgtccatagcattaaataagttgctacttaggacaaaaaataatatgcaagtgaataaatgaggaaagagagacatggtttctacacaacatccaagacatcatgtgagataagtagcattaaattgaagtatgaaatagtggtgtttgcattgga

SEQ ID NO: 88760 - DNA, 1178 bp, Oryza sativa
aatcggaggtgcctaaaaggtttgcaacttcatccttcaatgtttttttgtcatattacatttgcagctatgttttgcacacttttttgtctccaaaatttagttgtaagttgatgagggagaaaatttgtgtggggaagaaagaatatatagaaatttagttgatttgctaaagaaggttttataaaatagttgagaaggaaaactatagtgaaagttaatcttgaatactagaaaacaaactaaaattaaaattaaaagaagtaaaacacattaaaattagtttaaaactttagaaatagtaaataagaattatttggtgtaatattttatgatttttgtatgaataaagatatgtcattattgtatgactgttgaaacagtttataattatcttataattattgtatgactgtcattattgtaagaataattatttttgtacgattttttttcgactcatgtagatggatcggcaatggatgtacgctgaccggcggtccaaagagtttattgacggcgtgcactattttttgagagtggccaaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtacgttggatttgaaggaaatcaaacgggcgaggaggaaagggatgctgatggtaacgacgttgcggatgatcttggtcagatgttgtaggacgccaaggaggactgcgaaagtgaaaaggaagcccataaattggacaagatgttagaggaccacagaacttcgttgtacccaggttgcgagcaggggcacaaaaagttggataccactctggagttcttgcaatggaaggcaaaaaatggggttagtgacaaggcatttggcaatttattgaactcgtcaagaacattcttccggagggaaacaaattgcccgagacaacgtacgaggctaagaagatagtctgcctgctaggactggaagttcagaagattcatgcatgtccgaatgattgtatcctatatcgcggtgaggagtaagagaacc

SEQ ID NO: 88761 - DNA, 746 bp, Oryza sativa
ccaccatgatcactgtctgagccactttctgggccatcagaatacttgtccttaggagcctttcttcggggcttatcatctttagattcattgcgagaactatttgtagatttcttcttcttccgatcatagtcgctgtccgactcactgaacgaaccatcaccctccgagtcagtatctgaatcatccatgcgcttaccctttctaggcttttcatcttctgagtcatgtcggcgagagatcgtggcaggccttttctttctctcatcacgatcgttcttgccatgttttgttgtcttcttgccataatcaccatctgatcagactctgaatcatggcgagagctctttccacgccttgcattcttatgatcactctcagaatcagactctgaatcatggcgagaactctttttacactttgcattcttatggtcactctcagaatcatcatctgtatcatggcgagaattcttcaagtgtttactgtgcttcttttcatcatatttagcctcagaatcatcttctgaaccatagcgagaattcttcttcttcttcttgttatcatcatgatctgaatctgaatcatgaccaagtttaatcttcctagaacttttgccatgactctttgcatcactccctttatccttcttacccttctttgcatgccttctgtcatcctttaaagtcttgccatcttctggcccatctatttccaaaccttcatactcctttccaagaacaagc

SEQ ID NO: 88762 - DNA, 657 bp, Oryza sativa
ggttagtgcaaagtcaaattgaagagttaccacacccaaaatgggcagtccctgaatcctcccagagtctctctcctccagcctccttggcttctcttgagacaattggtaatacttctccaactcttgaacatgtagaattacctcttgcacaacgtagagagactagatccaatgctggtagacctcctatacgtcttggttttgagcatcttagttctatgcatgacattgcaaactatatcacatattctcatgtttcaccagcatacaaaacatttattgcatcattacagacagtgcctataccaaaggattggaagtgtgcaaagcaggatccaaagtggaaagatgcaatgaaagaagagttgaatgaccttgtgaagaataagacttgggaacttgtaaaacttccaccagaaaaaagggcagtgggatgtaagtgggtctttacagtgaagcaaacccctgaagggaaggtggataggtataaagcaaggttagttgcaaaaggctacagtcaaacatatggaattgactatgatgagacatttgcaccggtggcaaaaatgggtacagtgagagctttggtatcttgggcggtgaactttgggtggacccttcatcagcttgatgtgaaaaatgcatttctccatg

SEQ ID NO: 88763 - DNA, 1098 bp, Oryza sativa
cgtcgatcctagtaacgtggatccgtaaccaattggaagcaaccaaagacagtttcagagattcgcagtttcctaggcctcgcaggatattatcggaggtttatagagaatttttccaagattgctaagcccatgacacgactgcttcagaaagatgtgaagtacaagtggtcggaagaatgtgagcagagttttcaagagttgaaaagtcgcttaatatcagctcctattttgattttgcctgatccaaagaagggttttcagtgtattgcgatgcatccaaacttgggttaggttgtgttctgatgcaagatgggaatgtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagttaaagtatatctttactcagccggatctgaacatgagacaacggagatggttggaattaattaaggattatgacatgggaattcatgatcatccgggaaaggctaatgttgtagcagacgctcttagcagaaaaggctattgcaatgctacagaaggacgacagttgccattggaattatgcaaggaatttgaaagattaaatttgggaattgtcggtagaggtttcattgcagccttagaagcgaagcccactctaattgatcaagttagagaagcccaaattaatgatcctgatattcaagagatcaagaagaatatgagaagaggaaaagctattggtttcttggaggatgagcaaggaactgtatggttgggtgagagaatctgtgtccccgacaacaaagatctaaaagatgcagttttgaaagaagctcatgatactttatactccattcaccctggtagtactaagatgtaccaggatctcaaggaaagattttggtgggcaagtatgaagcgtgaaatcgcggaatatgtagcagtatgtgatgtttgtcagcgagtcaaggcagaacatcagaaacccgccggtttgttgcagcctttgaagattcctgaatggaaatg

SEQ ID NO: 88764 - DNA, 803 bp, Oryza sativa
taacttctgaaaccagaatcttgctcaatggccatgaaagtgacagcttcaagccggcgcgaggactgcggcagggtaacccgttgtcgccgctactctttgtccttgtcatggatgcgctgcaaggcttgctcgccaaagctacttcctgggggcttcttgccaagctggacactcgacgttccatcccaaacacatccatttatgccgatgacaccattgtgttcctgcaaccaatcgagagggaggcaacagcggtaaacgccattcttcagcttttcggaaaagctacagggctcaagaccaacctcagcaagagtgctttgacgccgattaggtgtgatgatgatgtgttggtcggagttcaacagctgcttgggtgtagggttgagaatttcccgatcacttacctcggtcttccactctccctgagaagaccgacgaaggcggaagtgcaaccgattttggatcagctgtccaaaaaagtggccggctggaagcccaaactgctctctcccgacggccgtctgcgcctgatcaaatcggtgctgaccgcgctgccagttcatttcatgtttgtgcttgtgctgccaaaatgggcaatcaaagagtttaacaagaaatgctgagcgttcctgtggaaagggcaagaggaggttaatggcggccactgcctagtggcttgggatatcgtctgcagcccgaaggagtgcgggggattgggagtaaaaatctggaattatttggccaagcgatgcgaatgaatggctcgctagacgattggagcaaagaggaaggccgtg

SEQ ID NO: 88765 - DNA, 4853 bp, Oryza sativa
gaagcggagggcgtccacgtcagcaacaagcatcacgttcggccaccagccgcaccaccaccacggcgggcgccaccaccgccgggtacgagcctgacatggaagccatggcgcaggtgaaggagatgatctaccgggcggcggccatgcgccccgtccacctcggcacggaggccgccgccgacaagccccgccgcaagaacgtgcgcatctcgagcgacccgcagacggtggcggcgcgtctccggcgggagcgcgtcagcgaccgcctccgcgtcctgcagaagctggtccccggcggcaacaagatggacacggcgtccatgctcgacgaggcggccagctacctcaagttcctcaagtcccaggtccaaaagctggaaaccctaggcaccaccaccaccacgtccaagttaccgcagcagtattacagcggcaacatcaacagcagcaataatcaccatggattcctcggattcgcagcaaataacaacaccatttcagctggctacgcaaattctaatgctggaaatgcaacgaaactgttgtagcactgtggctagcacaagtacttgatacgcacaacgtacgcgtggtctcgtcgtctatatacatgtagtaacatgctgctgttttctactgtttctaggcttggtggtgatcagtgtacgtacacacggcacataattggagtcttaattagtggtggagtgcatgctgatttagttcgtggtcatgttcttgtgcaagatttagatttataatcttccgctggcggatcagctgcatggagtgagaagttacatcaaattaaaggggccatctgatggttcgttcaaaaaaaaaaaacgggtgccatctgatagaggaaaacatgtggttcaataatggaaaagagtggcctggacgagcaatttgcgagtgaagatttttagctttcttttttttcttaatttatttatgcatgaactgagtgagtttatcgccactcgaaagtatatagacgtggatcgagtaactagtacatggatattcagatttgtatggttgttgcgcaacgagacactatatataagataatataattaattaaccgtccttaagcttcgtttctatttcacatatgtttaccccgcctccatttttagagttactgtgttagagtataattaagtgaatcgattgtcgttcttaatcaacctaaggtttcagggacgaagtgctaattgagctgttcatatataactcgatattgcgcatgcaagtgtgtcaattgtgctgtcacttactaagctactgtagctgattcgatctctccatatatgtatcattgggtgcatcatgtcatgaggctgcaaatcttgggctgttcatgcttgtgcagtagtggtgaatctttgtgcttccgattttgggcatgataaaacgcttttcctctcagcttttgtgtcaacgcaacgaaatctcaattattccaagtgcaaaagagaaatagagatgtaaaggcttatatacttttttagaccaaagaggagctatcttcttagctagatgctatactatgcctctctatccatctatctatgaataaatatcccttctttttatcttatctatatatctgtatgatggggcaggctttctgcatgctgatgataaaaagtttgggattaaattaacacggaaagggccttttgctaagcacccctttcctccttgcaaatgaccatcgatgcactgcatgcaacgagcaggggaaaaccctaggcactttgcagttctgcatgcatgcatggatctactatcattcacatttcacagccttcgtcgtcagtaaaagctgcaggtcggtgaagtagtactactagtcaatactcatgcaacggtgcatgatgtagctagaataatagtagaatcatggcaaacactccatgattaaggagcccaagctaataagctagtcatgggaatcccgaatccggacacatactttttctatctcacactagcttggtctcctccggcctcttgccttgcttggaccaaagaaagaaaaagttgacgaacacagcagaggaacagtggacgaactgtgatcgaacggaggatatggtcagcacaacagtgttacacaatccttaggtattttccacatgtttccatgtagaaacagtatacttaaattagaaaattgagttacaaatcgatgaggtttcctatgtttttcagtgtctggtccgaaacgtgccctgttttctcatattttccctatgttttttcttactacttttgtaatgtgggggttgttcacagtcacacacacacacacagacacattctgtagccgcggtagtagcttttgcgtgtgccgtgccgccgtgcgggccggccttgttccgtttattcctgcgtgttttcgctttccctttcgtgtcccggaatcaaaattctttgagcagtgtgcgcctatccgccatgagagagaaaccgagaatgcccctagccgcggtgcagcggctggcatcagcagcacgcgctttttgcagggggacgacgctttcgggcctcaggtcgcagctagcgcaggagcgcaggagcgcgcgaatggccgcacacgcacgcacgcagtcaggcgagcagcgtgtaccggtgtactcgtacgtgctgcgcggccgcgtgcagcggctgcttcggttgggctgcatgccgcgcgcgccgtcccggcggcggggcgaccgatgcggcgcgcggcgcggtggccaaaagacattccctttcttccctcgcgggtagctttggggctgaagaacctgaacgccccatgcgaggacgtactgacacggcatgcagctatgatctactacaagtatgcgctcctcctgacgtctctctctatcccctcccctggactcgtgtcgacgacatggagcgtgcgccttgataagaacacccccccgaaaagccgcctccttcctctgccagcgccctcgttcccctcccctcctctcacatgcgcgcacgaattgtattttatcttctgatagtctaaactaaagacgtgttttattatcaaccatactttttacatagaaacacaagcgtcgtaacacgcacacatacacctatttctatgagcatttctaaaagactgggctgggatatcttaatattaacaaaatcatcctaccctaaatagcatctccagaagactaggccggtatatttgagattgacgaagtcaccatggccgttgtcgactaaagattagatcggcatatattgagattgacgaaatcaccctacccctataagcacctccagaagatgaggccggtaaatcttaaaatcgatgaagtcaccacgggcgggccagcatggtgaaatcaccctacccctatagcacctccggaagacgagggcggtatatcttaagatcgacgaagtcaccacgggcgcctcgttatcgactaggccggcatatcttgagattgacgaagtcaccacagacgcctcgttgtcgactgacccgatatgaggacctccggaagactgggttgattgaggaagtcaccatgggtgtcttgctattgacaggtacattgcctaccaccgaaagagtaatgagccgtaaatgcaagtaaccatgtcaagtttataacttgaatcctggtgagctgattccaccatgtgtaacctaaccagttaaacttgttatatatcatttataaacatactgccgcatttggcttattaagttgagacgatcaaattctctgtacaccatagtaagtcttaaaaaaatattaccataattaagtagtagctaaacttcttttttttaaaaaatggaccaatatgattttttaagcaactttcatatagaaactttttttttaaaaaaaacaccgtttagtagtttgaaaagcgtgcgcgcaaaaaagagagagatgagttaggaaacctgtggtaagaacacagcctaagactacaatcaaacaattgtcaaaggcagtgtagacatggtaaattatggttggtttcccaaactgttaaacaatgcgttttttaaaaaaagtttctatggacaagtttttttttaaaaaaatcgtattaattcatttcaaaattttatagctaatacttgattaattattaattatgaatctattgtttcgttatcgctttgtttttgcgtgagaagggaggggtttccaacccctaaaaaagcacagcctttgagctctgttgaatgttgatcatcagttctatggagcgtcaaacttgcatctggactgctgaataaaaccggcaatcttgaagcgagctatcgatcgagtatgcacatggggattgcacatgcctggaaaatacaaagaacaacaagctactatttattaaacctggaccacgtacccacgaccttaattcggtccaaaattcacaataacaaacaggaagcaaagtacaccacgggatataggcatggaatttatttaaggaccatccatgttggtggcaacataattgacttttagtgtattgtattattattcagttcccttcctgatcaattattcccaggaggaatctaatttgtcaaacgctccgtttctcacgagattgagagctcgcgacttttctcgtcgtgtctcgcttgtcccggttgtaacaaacaaactcgatccatcgatcggtccgtcagttccggtgcgtacgtgcatcatccaaatcaaccggcgtgtgatcgcctgatctagctcggtcaaaggcgtacgtggactacgagtgtgaagagaatatataaaacgcgatcgagtacgagttcttttcttccttgcagctttcatggcgct

SEQ ID NO: 88766 - DNA, 647 bp, Oryza sativa
tcgaccccaataagctcacacacacacacacacacacactctctgactacatggctcgagctaactaacgccggtggcgtttgcatacaatgggaacagggggagggtggggacggaggcgagcctgtagcagtggttgacaagcctgccgtcgctgaccacgggagagtccaagttcggggtgaccttccactgggaggtggagaagatgggcatacccggctccatcatattcaagaacaacctctccgcccagttcttactcaagaccatcaccctcaacaacgtccccggccacggtgccgtcgtcttcttcgccaactcctggatctaccccgctctccaagtatcgctacaaccgtgtcttcttcttcaacgacgtaattaactaattgatcaatcaatcaaccaaattataatgctattcgtaatctaatcaaacgtctagtagcttaattaattaattgactggttatatgggtcttttctgctagacttcactgccagacaagatgccggcggcgctgaagccgtacctcgacgacgagctccgcaacctgcgcggcgacgaccaggagggcctgtaccaggagcacgaccgcgtctaccgctacgacgtctacaacgacctcggcgagcccgactcc

SEQ ID NO: 88767 - DNA, 1137 bp, Oryza sativa
tcagaagcaggtgggaggactttacgctgcagcaagtgtgatctgcgcggccatacttacaagaaatgcccgaagaatgcagaagttccaagcggcgcagatgctagtccatctggacattcaagtgatggtaggcgaccacctggtgaaggaacaacaagcaggcgcgcacggccaaggcgtcgtcgcgcagcgggcgattccatggtgtaacaatgctatcgatttaggaaataaaatgctgttgtgatgtgatgagtgttcggactaaatacttctatcgtgtaatttcaattgaatgttgttgtaatgagtacctccgactattgttgtactagtagtattgcgaactatttggtgttgtatcataatgttatcgtgatgagtgttcggactaagtactcatatcgtgtaactgcagttattgttgtaatcagaaatattccgtatggtgacacttttgtttgtttgtactcttgtttaatatgtgttagtaattcgcttatgaacatttattacttatgttgaactaattatttatatgtttctgatcaatctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttattgaggcggcggcggacgaccgtgacccagcgaagcggtgggatgcagaccggtcactccttgccgctctggtagaccgctggagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctagaaccggccaacacccttcctccgtactctacagtcgggcctag

SEQ ID NO: 88768 - DNA, 5967 bp, Oryza sativa
taaatattaaacgtagactattaataaaactcatccataatcttggactaattcgtgagatgaatctattgagcctaattaatccatgattagcctatgtgatgctacagtaaacattctctaattatggattaattaggcttaaaaaatttgtctcacaaattagctttcatttatataattagttttgtaagtagtctatatttaatactctaaattagtgtctaaatatagagactaaagttaagtccctgatccaaacaccaccagatcaagcataatgtccctttctatgagaaaattcaatgaacaagaaatataacaaaaactagtaggagcatgagttaggtgctgccctcctcccgacacgcaaaacgaaatatatattattacataattaattaattaataactattttttcctaaaaaataaattaatatgattttttaaaaacaactttcatatagaatttttctacaaagcgtgtgcgccctggtaaaaaaaacaaagtgtgcgcgcggaaaataaaagagggaaaactaggagaagaacatagccttagtggtgagtacagctggtgaacccagatcactgcttgaaaagcttttttctttttgctacagtctataaatcgaaaatagattatcaaagtagcaaaaataattaaggttatatttttacattttaattcttagttgtccaaaaggaagtctaggtaatgaaagcaatgaaaaaattaacaaattaattctaaaattcaaatcccaaaaaatgcaaatttgctcatgacctccgagtttttgacacaacgggctgtaaaaacacaactagcatgcttttatccattaacctaagggctgttctaacaaccacaggttgaaaatggctaattagtggcatgtaaaatgaaaaacctaattaattgagtatttttcaaaattaaattatgaattataatttattttattttttaaaacgattttttataaaaagttttaacataaaacatatcgtctagcagtttaaaaggtacgctaaaaaatagagagagtagcgaaacaaatcttcactttacaacattccccaagtccaaacgatcatgcaaacaaaatcgcctgaaacattttgtggcggtgattactcaacttaaggtgaacaagagagaacaaaatcacaaccctattagaaacagagcgaatagttttcgctgcttcagagaaaagcgaatacaaatatctttcggtttggataattttcagatagctcggatacagatacgaatacggatatttcctcccggatacgaatacagatatggtatcagggtttccgccggatacggataataactcggatatccgactaacaatgctattcggatatccgcagaagccatgagacataccccaaatctttataactctatgactttcaatatacatttttagattttaatagaagttcatctcttaatactagtccacactattaatattatttaattttttaaataaatatttataaattatactacattttaaataaaatgaactaattatatatgttgatatttgtttatattagaaattgatttgatttttcgtgttccgagaaaaaattgtttccgtattcgtgtccgatcatattcgatttttattcgtattcgaagtaatctgtatttgtttctattttgagttgtccgtattcgtatttaaagaaatataaaaacaaatatgatatgagcattatacttccgtattcattccgttttcgtcctaaaaggaactagggttgggtgagacgaggccgtgaaggagaggtccagtcgtcggtgaaacggcgtagccgcgtaggcttttctttctacggtcgcgcggcgtggctttgttggtggtaggacagctcaccttttccctgcggtgagttggcctcggctggcaaacatgggctttgggtcgccgctgcttaattagactttgcgtagttgttgtctacttgcccgttgaatacgcggatggttttcttgtaagatcggtgctcttgaatcttaactgaactcgatccttcttcatgcatgcacagcgtgttgcatagtcgccgaaaattgctagattatgctctaagtttccgaaaaggcctcattgggcattgaaccatgattatgtagctgggcacaacgcttagtggaccagtctctggccttgaactactaggcagtgctttgtagctagactaactgggccaaagattcctggtgagtattagaaaaagaaagtctatattacaatctgagtttcctcgcaatcgaaaaatcatgtatacaacctccctcaattatcaataccaattcttcattttaccttcctatgcagttcacactggtatcatctggcacctacgtggcacttgggttgcattacaatcaataaaataaataaataaatagtaaattttagaaaactacaactttagtgacaaaactatcagtttgttgcaacattagcgacatgttttagtttactgtaacaatagcgtgagaaattattacaaaactgcaacttttatattatatgctgctacagttgtcacctatatgtactgtagcagcatataacgtaaaagttacagttttgtgataatttcccacgctattgttacaacaaactgataattttgtcactaaagttgcagttttctgaaatttactcataaataaataatgccatgagacctatatgtaaaagaccatgtttatcttcttcctcctcgtctttcccttctctcatttcatgccatagttgggattttggtcttgtggggctcggctaaggtcttttttccatggaactccaagactgcataatgaatttcctccaagcaatgctcttctcctccaacaaatgtgttgctccctccgtttcatattataagtcgtttgactatttcctaatcaaaatttgttaagtttgattaagtttatagaaaaatttagcaacatccagaatatcaaattagttttataaatctagcattgaatatacttgataatatgtttgttttgtgttgaaaatactattatatttttctataaacttggtcaaataagtttgattaggaaaaaagtcaaacgacttataaattatagtaatatgaaatggagggagtaacatttattgcactaagaggtaagctcaactcccttcaaaaaaaaaagaaaaagtaaagctactatactgtagtcattctgtctaaagctcagatatatgttggacagtaaaattgtaaaacatgtcactgcaatgtattagatggtatgcaccacagctacaacagacatgattctgcatggtcacttacaggaatgaatgaagtggtatgtacaatccaacgagcacttccagaacttaagcaaaaggcaagacttcaggaccatcacctctgcagcaaaaacatgtttccaggtttccaggatgatcagcagcacaagtttggctagcagtgtcactgtatgacacgatagctgacataaatcaatatcaatgtacaagaacatgaacatgaacttcatggagcgtggacccgtggaagagaattccaaccaaagcaaaagctgtacttgttagaatactggagaataataaacgaaggacattggaaagaacctttatcaaaagataaaagcgttcaaagagagaaattatgcacccgcttttgatcaaccaattctctttcttttctcttcattatatatattatgaacaatacacaaagaattagcaagaactcaacatagcctgataggccaaataaaaaaaaaggttaatggcctcacacaccagttgttgagatcacaactcaccacactgagacaatcaattgggtttattgtcactcattgctgtactcgagaaaaacctcgcaatctctcatgacaaacactgaaagaaagccaagaaaaaaaaatgcacatgatcattgtagtagtccctactttgtaccagcatgtctaccatttgatgagagccttctgctatcgctaccacttaaaggttgccgtccagatctatttccattggaggtttttctcgaagcagatggtatttgagaatggagtggtgtcctgatgagtaaatacatggaagcatggaatatcttaatcagcctttcatggagtaaaatgatatatcttatgcgaatagtttagtatgttatagtttagattatatatttttctttttaaataaatattagtatcaaccaaatataaaagaaccaaaagttaatgggattaatatttaatagatatgtacttccagtacacatttttcatactaattaaatttcagagaattagcaactctgtgactagccttagcagaccacaatcttgaaattcacagcaatcactattatgcatgaggtgaactatatctttaaataacaacataaagataattttccatccatgcactattagtcataacccacaattcacaattagtgtagtcccaagtaatacgctaatatccaagtccatatgactgtttattcaagttcagttcatcatagttaaattatttatatctgctttataccatgagtattgtgggtgctaaaacagtgtaggatgattttacttcaacaaaaacgggacaagggagttattagccctgttattcttaaaaaataatgtttgttgtaaaaaaaagttgttaatgtaaaaaaaatggttacctggtatctgagctctctcttagcttcgtttgtggtttcttgatctttgaaccattctcgctaattgaactattgatgctttggacattgaactgccatagtgcatctgattctgaggaatcacttgttgcaatgtcaatgtcatcagaatcatcagtatttgtggaataaaatcttggtctttgctgctcaaactcatttccgtccttttttcttgagttatttctcaggtattgcttatctcttgtacctgaatggtacctttggtaaaagaagtcaggtaaagctgcactgtcgccttcccaatcacctactgagttattgttgttcactacaaccttatcgatccattccccaccaatagtcactctttcttctcccatttgaaaatttgcccttgaaatgctatctggccatgatggggaatcatttgacgctaataagtcctggagatcaaagcttggtttcttctgtcttaatgttggattggctctaacctgtataaaaaccagatcaaacatgatgggacaaaaacgttaacaacagcatggccgctgaaaggacagttgtattatcataatttgctaatatcacttgtgtaacttgtaaatgtcaaacaaatatgaatcgtagaaaggtttatagaagaaataatgcaaggcattagtacctctatgtttccaacgtcctccattggttgtctgaagttagtttggctagacaccaactcacaactaccctgtcgcctatttgaaaagccaggtgaaggcatcttcatgttaaatgcctcagggtcacggttaatgttttgctctgatcctgaatctttcattgctaatgatgatttgagtcgagcaatctggatagagatagaatatatgcataccttaaacaacaaatgcagtgagaaaatatgatacaaagcatagtagcagaaacaaacctgctccttaagttctttaacttctccagactctttgttcaaccgagcagcgccaagttcaacagtggatacacgctcggcaaacttcaatgtgcttatgctttctcctaaagcatcactttctgggcttatatgaacaaacatcaaggttttggcctgacctcctgtagacgcattgttaaaattcgaggaaatataaattatactcagcagtcagtgacagcacattaagaaattgcaagaaggttaaatcttaccaagagaatcttgcaggagttgtgttaattta

SEQ ID NO: 88769 - DNA, 597 bp, Oryza sativa
gccgtgttctccacgccgatgccgcgcatgaagaacccgttgccgatcgcctccatggtggccgtgtccttggtggtgatgttgagcatgaagctcttgttccccgtgatgatggtcttggtggcgccgtcgccgatcatcaccaggttcgtcacgttgcgcgccaccgacacgtactccttgtacgtcccggccttcacgtacatcacgtacgtccccgtgctcttgaccggcaccttggccagcgcctcattgatggtcttgaagtcgccgctgccgtccgccgccaccgtcacgtccggcttgaactccttggagcccggggtcgcctccagcagccggcgcttcgcgttggacatccacacgggcacgccgtcgtcgccgagcagccggcggctgaatccggtgatgtccaggttcgccagcgtgtcggcgaactggtccacgatggcgaggatgttctccgtcagctcctgcgagctcttgagcgccttgcgcatcttctccgacgcctccgtcgacgtagagttctcgaacccgtcgaggcacgtctcctggtacgtcagcgccgagctgagccacgtcttgacgtcgtcc

SEQ ID NO: 88770 - DNA, 539 bp, Oryza sativa
tgtacgaggcgctcaactccggggacgcgcgcagggcgcaggagctgctcgcgccggacctcgagtggtggttccatggcccgccggcgcaccagcacatgatgcgcctcctcaccggcgccgaccacggcgagtcaaggttcctcttctcccctcgctccgtcgacgccttcggctccaccgtcatcgccgagggcaccgacgacacccgccagctctactgggtgcacgcctggaccgtcggccccgatggggtaatcacccagctcagggagtacttcaacaccgacctcaccgtcacccgcctctccgcctccgccgccaagaccaccgccgccatttcttcctccaactccaccacgcctccttttcggcgccgccgccgccgccgtccaagcccaagtgcctgtggcagagccgccgcgccgaccgcgcgcacaagtcgctgccgggcctcgtcctcgccatctaagaacgaactcaaaagacatcaagaactcaaggcgcaaaaagcttccctaaattaatcacatataaaa

SEQ ID NO: 88771 - DNA, 1297 bp, Oryza sativa
atttttccttctgccatcagaaaataccatatcctatattttgttgaatatttctctgatgcatttcatatcctttttattttcagattgctgctttcattgctgaacctgtgatgggtgctggcggtgttatccctcctccaaagacatactttgagaaggtaaccagaatcacatgttagccccacagtccatacaaccttgatgcattttctgaattcaagaaacgtttattgcatgttgattgttgaacatattacatccatcatatcctcagttcagtttgtagtatttgccagatttttagctgactactgaagagaagttatttattctatgtccttaggattatattatttcaattaaacttggatgtaaaacagagaccttctgtgtttatcatttcccggtcagcccatgcactgttctgggaatgcataaaaaatgcattgatatttagatagaattttgttactataccgtctctaagatttcttacattttaaacaacttccaacacttacgtaaaaaacaagttgcaacaagaaggtagccctgattttcttttatgtagcttcattattattttcatggtgctgatgccaattatttgttctttccacataaaatatttagattattgtgctgcctctaataattttctgtgggtttgttctctaccaacagattcaagcagtcctcaagaagtatgacatcttattaatagcagatgaggtactcgaaagtttctctattagaaagaaagtctgaatggtagaatatttactttatgggaaaattagtacatcatcatccatttgtaggtcattacagcatttggtagattgggaaccatgtttggatgtgatatgtatgacattaaaccagatcttgtctcaatagccaaggtgagttcaggcttcaataacagcagagtgcttatctgataagacaagaactctcctctctcttttatttgtttgatgaaactgatagagattcgtttttctcatttcttttctcccatcaggctctatcttctgcctacatgccaattggagctattcttgttagtccggaaataacagatgtaatttattcacagagcaacaagctcggtaaagacaattccatgggatgaatttattttttgtgttgcttctgaattgacaagcaaaatcctgtttgttacaggttcttttgctcatggatttacatactcggggcatccagtttcctgtgctgtcgccatagaagcattgaagatttataagtaaaacacacttttcataataac

SEQ ID NO: 88772 - DNA, 12439 bp, Oryza sativa
  unsure (1)..(12439): unsure at all n locations
taagtgtagcatcaccctgcccctactccacgaggtcgtgccttcgcgcctcgagcgacgatgtaggcagcgacactagttgggacagcagcagcaaggaacgagggtctcgagccgagagaaagggagaagagaagaggagaggaggcgctggtgcggtttgctggtgagctaagcggcgggtgcctcccatcctcacaacaaacttgatactacttgatatctagtaggtaccacgtttggtatctataggtactaggtttgatatctaagtattatttatgataccatagctaccagccatagaatctacgggtaccacctacagatgatatatggtgcagtgtacctacacaccccagcaaggaacatgattgctctagatccaaaagatccattggccgcacccctctagcaccatcgacacaaaacctacacaaatattttaattaagtagttgaattaaacctccctaaccgtatatgtattggagcagtgtattactagaaatgcaaaatggtgttcactattataaatttcagaggtctatgtgacttggctaaatttagatttatttcggagacttcgaaagagcaaaagctacactttatcgctcttttggaaacaggcaaaaataatttttcaaacgcgtgtttaaaaaacttatgtggaggaggtgaattcttttaggagtgaatttgaaggttcttgacatttcgagtattgttgagggagagttctatgttaagtttcatgtctggaacaagtcagatggcttccaatggattcttgtggcagtctatgcggctgctcaagaggaattcaaggaagcttttcttgttgggttggtgaatgcttgtagcaagatgtcattacctattcttattggaagggattttaatataataagaaaccctaatgagaagaacaatgataggtataatgacaagtggcccttcttgtttaatgctgtcatagataacttaaacttgagagaaattgaactttctgggcataagttcacttggcaaatgggttaccagtaccgacttacgagaagttggatagaattttgatgagcaagaattgggaacagaaatatcctttggttacagcaagagctctgaacagagaattgtctgaccatacaccgttattactagattcgggtactaaggcccaaaataagcaacctctattcaagttcgagcttggatggatgctaagagacggtttttatgatctagtagcggaagtttggaaaaaagaagatagagggttgactagtattgtgaggtggcaaaacaaaatccgtagggtacgtcagtttttgagaggttgggcaaaaatgagagtggcaagtataaaaaaaaaaaagctaggctgtaaaaagggtggaggcacttgataagaaaccagaagtgcaggtgctctcaagtcaggagttagacattaagaattatgtgaaaaataggctggcaaccttgctaagagaagaggaaatcaagtggtatcaaagagcaaaaactaaacggatcgtggaaggagatagaaatacaaagtactaccacatgattgctaatggaaagcatagaaaaacaaaaattttccaattggaacaagaagaaggaataattaagggtgatgagcagttaaaacagtatatcgctaattattataggaagctctttggaccatctgaggaaaataatttctccctcagtgagtcctagattgaggatattcctgaagtcacgctcttggaaaatgaagtcctgaccaaggatttcttcgaggaggaagtgaaacaaagccctccttcagatggagcataacaaggctccagggccggatggtttcccggcagaattctttccaggtgttctgggaggttataaaaaatgatctaatggccatgtttagagacttccataaaggagaactaccgttacatagtctaaattttgatataatcacccttttacctaaacaaaatgaagcgcgaatgattcaacagtatagaccaatttgcttactaaatgtaagttttaaagtctttacaaaggtcatggccaacagagtagctctagtagctcaaaaggtcgtgaggccttcgcaatctgcgtttctaccagggaggaacattatggaaggaatagtaatcttgcatgaaacgctacatgaaatgcataggaaaaggatgagtggggccgtgctaaaactggatttcgaaaaggcatacgacaaagtagattggaagtttttgcaacaagctttaagaatgaaaggttttgcgcctcaatggtgtagctggattgatttgattgtgagaggaggaagtgtagcagttaaggtcaatgatgacgttgggaacttctttcaaacaaaaaaaggcttgagaaaggggacccgttgtcaccaattctttttaatttagtcgctgatatgctagccattttgattcagagatcaaatgaacaaggaaacttccatggagtaattccacatctaattgataatgggctctcaattttgcaatacgctgatgacacaatccttttcatggaacataatctagaagaagccaaaaacctgaaattagtgctaagtgccttcgaaaggttgtcaggtttgaagattaattttcataaaagtgagttgttctgttgaggcaaggcaaaagaggttgaaaaggaatattgtttgttatttggatgtgaaaccggagtatatcctttcaaatatctagggattcccatgcaccatagaaagatatccaataaggattggttgtttttagaggaaaaaatccagaagaagctaagtagttggaaagggaaacatctttcagttggagggagactggttttaatcaattccgttttaagtggcatagccatgttcctgttatcctttttcgagattcctaaaggtattctcaagaaattggactattatagatccagatttttctggcaatttgacgaacataagaaaaaatataggttggctaagtggaacatattatgcaaacctaaagagtgtggaggcttggggatacaaaatttggaattacaaaacaaatgtcttcttagtaaatggctttataggcttctaaatgaggatggggtttggcagaaacttttgagaaggaaatacttggcaaaaaaacattcactcaagtgtagaagcaacctggggattcccaatttttgtcagggctcatggtgtctaagaacgcctttgtgtcatgtggatctttaaaggttcataatgggacccaagtgacattttgggaggatcgttggtgtggaaacaattccttggcaaatgattctcctaggttgtataacctggtgagaaataaaaatgcttctgtggcaacagtcctggggaaaataccacttaatgtatcttttagaagggctatttgggggataacttaaaagcttgtttggaggtagtagcaagagtaataccggttaatctcacagaacaaaatgattcttttgtttgggaagtgcataaaaaaggtttttttctctgttagctcgatgtacaaggctattatatatcgtgacattgtgccaaggaaagaggcgttttggaagttaagagtaccgttgaagatcaaaatctttctatggtacctaagaaagggggtcattctaaccaaggataatttggctaagagaggatgggttggtaacactacgtgttgcttttgtaattctagtgaaacaatacaacatcttttctttgattgtcccctagctagatttgtgtggaatgcgttgtttataacttttggaatccagccgcctactaatgtcgctagttgttgggtaattggccttatggtgttcatcctaggcttagagctcactttccttttggtgttgcggctttatgttgggcaatgtggctttgcagaaatgatgtggtcttcaatggatccaaagctaactcttttgtgcaggtaattttcagggggactttctgggcgttggaatggtccttgcttcttaaagaggaagagggccaacatgtgaaagatgggtgcaaaaagctggaaacgacaatgttggacttcttttcaaagtttggttggaaccaaaggagaagattggaagcttgaggcattgctttgatctatttcgttccccgtgtttttgtcttgttgtttttgctctgagcaagttgaatttgggttgtttggaaatttggagtctaagtactcttttatttgaaccgttggtttttctctcgccgtgtgtaaggagatgaatgttgagtctaagaactcttgtaagtttggttggctgtgtacatccgtttggatgtagagcccggtttaatccattatctaaaaaaaattataaatttcaaaattgtgtttatttgattttttttaaaaaaatcatctaatatattttttctacgtaatgtttagtagtttttgaagcctatcgatattctagatcgataataataataaaaaataacatacgagatataaaagtgaatgagtaaggggataagagtttagataggttcaggccttctcgatgatatgtaattctctacttatttgagggatcgtatccgtcggatgttgtattgatataacaatcgagttgtgctttggatggtttcttgcccaccttatacaagttgtgggggcatgattacacagaggaaaacctagctatgcatgatatcagttttctaatccattacatgatagaatcaaaccaaaactatgggctatgccgtaggatacaaggtaacattatgcccaagtcctagtttattacataattacgtatctaggccacctccgatctctaattggatatgcaggccgagtgggtatggggtactcatgatttctaatcaactcgagaaataaatcgctgcaaaaacgataaacatacctttgctctcaacgatgaagccaccgacgcaaagatgagccacaaccaacgctcccaagcactgccgccgaaggttttggctctcccaagcaccaccgctgccctccctccttcggctagatctaggagggaaagggtgggagggaggagagggccacccatcttccgccgtcgtcatatccttccccctcctgtcggatctgggagggagagagataggaggggagaagctagcggtcgtggaggggaggtgcagtcagggaggagctgacctgccgcctcccctcctcatcgctaccgccgacaccctcccccaccgctgggctcgtgtgctctgagaggagagggagacgggtgctctgaggagaggggtggggggggggagggagaggataagtattggagttgttgtggtagaattatacggggaagaatagacttggggacttagatttttttagtgagttgtttggctctttttcaggcagcgcttctagtggttcgcccgcgaaaatccaatttttgcaagtggacgacttaagagatatatccacttgcaaaaataagaacattatcgcaggtgatcgttttaagtcatccatctgtgaaaattgatcttcgcaggcggcctaaccgttaatcctccatccaacggctgcaagaggggggcggatgctgtaatcttgccacgtggaggggctatttgcatggaaatccacccaaatttcgatatttagagattgcacggagtacctatcgctgtcagattcattgatgcaactcgatacgcatgttcattttttgtgttcaaagatgaacggattaatcacttctgtagcttctgtgttgatgtgctaggactaattatgtggagatgatagggctgtaataattctgttttagtagtgatttagttggattgagaaattatgctatatatcacgaaggttcatttttcggctggtcagtttcttgttaattgcgagtataaacttccttttcagattgacctactcccactacgccagatcctcacacctttgacgacatatctgtgacgggcataagtgctggtcagtgatgaaggtcacctttgatgggtcctaccggatgccgtcatctggcccgtcacaggtgactagttacctatgacggatcacaaccggatggcccgtcagaggtgaggtttactcacctcaaacgggtttaagccctaacccgtttgaggtgagttgtgccactatatatacccgaagccaagccggatctgatatttcttctcccaggagataaggccggcttctccacttctctcgattcttctccacttctccattctctcttcctctctttctctccactaacatctctcgatactcctctccactaacttcactacagctgccggggaaggaggggaggcgcgacggcccggtggcatgctggtccggcaagggcggcggcggcctcgcctccttccgatacggcaggggcgggaggggaggcgtggcggtccaatggcggcgaggcgagtagagggcaggagggtagtccnccgcctccaaccgcgggccagccgccgcttttgccactgcccgcgggtcggccgccgcctacgcctccatctctgcccgcacctccgcctacaactccacgggcccaagcaagccgaaggcttctccaccacgagccgttcttctcgagggccggccttcgccatatccgttctggagcttgcaggcgccgttcggatctagagctcgtgggcggatccgagccccaaccgctggatctggcggtgatgaattccagatccactcgagctccgccgccagatcccttccccttcagatccattgcctcccgatggagtttatcctttctgttctctgcctagatgaatatgattgtgattatttttgtgattttttttgtgcccaaatgattgaaaatgtgaagtgattttgttctttggccacataaatgtgattgtgatgatttttgtgattctattttgtgtccaaatgattgtgaatgtgattatttttgtgatttgtgaatgcctaatgaaggcttgcgtctagctatgcttataatattttatttttttgacgcatttttttaggtttgtgacggatctcaattgagacccctcatagataaggatcaccatcaacgagttaatatttttacccgtcacaggtgaaggttaaatgtgacggattttacttgctgtccttcaaaggtatcttttaccattgacgggttaccccgtcacagatgactcaatatcatcagtgaccactgatatgtgaccagcgcttaatccgtcacaggtaagggtatgagcccatcagaggtgacctgattgagcgtagtgtctgataacacactagtaaatactagtacattgttatcaagtttgtgatcaaaacagatcaggttaaatgatgctctgcgtctgagtttgtgagttttgcatgatatcgcccaaggatctgaattctgaagggtgaaccgatctttactaatctcatcgcatctcatctcaataattaaattaaatgaacgataaatgtttattctttctcttattaagccacgtatatgctagatagattaggtgaaccgttagatttattgcctcatcagatggcaaatgctttggctgatcagccatttaagcaaaataagctaacttgcattgaagtttggctgaattggagatagctgtggctaatcagccaaagtatttggccaaccgatgaggctgttaataagaacggttggatatatgcagagaaaaatgcatattggaagattcaggagacttccttgagagaaggtctgggactgtgagtaaaaaaatatcatgagtaactttgatcagattaaaaggaaatggccagaagatgacccttaaacagtctcgatgttcatgaaagcgagaaaaagaaaaatggagcagatgtaaaaagagtaacattggcatagataccctaggtaaattagaataatccaaacaattctaataaataccatcattctcaaatggttcagaaatttacttttttaaaaaataggatgttcaaaacttaccacaaaagaaaatcaagcatgtttataaaatttgatcccaagtgagttagatttaaaacaaatcccactaacacaataaattctacatttttttctttaacatgctaatataagatttacaataaatttcacacgctaggcataattatggtcaattatttgttatcacagtaatattttccaatatatagctaaaaagattgtaactaaacttctggtcaaaattcgttcaacaaattgcttttagaatatttgtatactttacatatcataacatttaatagggagggatgtcattgtcgcgcgaaagcgcgaatctactggctagtattttgtgaagggagtaattccttctgtgattcacagtaaaattgtggagaaatattctttcccgtgcaatcacatatttcatctacatgtttgtttcatactttcagttaggatgcaacaagaattacatggctatgtggccaaatgcatgaatcatgaatccaattcacatctcattgtacagttgtcatgatcaactctaggactacatatcttatgaacaacacatcttagatcatacatagtaaccaagcttataaaatgcatgggtacatagatacatgcgtgtaggatatgtaacacactagttatgatatttagtaatttttattatatgttaatatttatatgatagctagttagtaatttttattatatgttaatatttatatgatgttagaggaaactgaacatgaactcctagaggatggttgattaactttacttgtatcaactcgaattattgagagcttacccaaattcatccatgcaaactagatacgttaggataggaggaggttttatattcatattgcggattagataaataatttatgaaataagattactcaaagttatacattaaggggtatttactagtagaagcatatgaaagagaattaaaaaaagaagcatatgaaagagaataaaaaaaaggagggtgtgatctgctttatatcagagtagtgcatgttgcatggagaagtcaaagtgagagggctttgcgctcgagcataacccaccgcgtatagctgcccgccgttggtcaccgatagaccagaaccagagggtggtggtgtcgttgccatcaacgtcgccggcaagtaaatcgatcgcgcggtcgatctaataattagttgctttctggtgggctccagtcaacggagttatataaaaattggtaaccgacgcggaacagttttctgttgagataacaaggtataaatattttcaagaaccgtcacttttaacgttgtagagatcccatcgcgtcaaaaaaaatgcaaaacagtacccgattttaccgttaattttgccgattattttgtgtgggctctggaggatttttttttttctttttgttacccaatccccaatggattaatccgatccaagcaaatatttagatctcgaatttgctatatatctatcgtgcgatttaaacaagggtataaatatttctagaactgtcacgtaagacgagggaacgtcttctcgtccctgaacgaaataacttaacaaatcaacccttattttcttattttccttcaaataggaaaatccggcgccccatcccctagcatgcatgtcactttccgatgtgcatacaacctcccccatcattttctctctcttactttatactcaattagcaagttataaactactttttgtcataaattatatgtctaattcgtaatctgattgcactattgaattcgtaacaattaaatctttacgaagagatctcacaagactatatttttttaaaaaaaataatgtattataactgaaacatttttatattatgtatgaaacattaagttataaccacttaaacattaagctataaccactgaaacatcacaaaataatcgatgaaacaacctagaacaccatatgcaacattccaaatgacctagtgaaacatcagttgaacatcataaatatacatgtcgaataacatcacgtgcaacaatccctagtacaacatcacaaaagacctactgaaacatcacaaattaagtacatggtaaaacatcaaaataataccatgtgcaacatttcaaaatgacctagtgaaacattagccgaaacatcacaaaatacctctaaaaaaacactcaacatttcaaaatgacctagtgtaacatcattaaatacctattgcaacaaaaaaaaactttctaaaaaagttaccaaaatatagtcaagtgacgccttgttacgatgatttaattgcgatacaatggcatattcagattacgaattagataaataattcaagtgggatcttgtttgaagttttacattaagagtataagcatgtactagtagaagcatatgagatagaataaagaatgagagtatgagctcctttatgtcagagcagcgcatgttgcatggagaagtttggccctgtatatatcacaccctaaaatttttcaccctgtcacatcacatcgaacatttgaacacctgcataaagtattaaatttatgctaaaaaaataactaattgcacagattgcaaataatttgtgagacgaatattttaagcctaattgctccatgatttgacaatgtggtgctacagcaaagatttgctaatgacggattaattaggcttaataaatttgttttgcggtttactaacggattctataattatattacacgcaaaaactttacattcctggatctaaacacccccttatgtgacggatactgtgattattcttagtagtaggataaaaaaaacagacattagacagtttgaagagaggcgtgtgaacatcttttttttccgtttgatcgggcgccctgataaaagcattttcgaatatataaaggtaaaaaaatactactttatccttaaggttagttttcatgcatactgaggttgcccttatatcaaggccgataacataattttcaaattttcatattaaatatatgtgcggcatatggtctcctcgtctttgatttttctcgtgtcgtgtcatcatatataccactaccactagtccactacggaatcattccaaataaaaagaaaaatgcaagtttcttttactatttaggagtaggacagaaaatgctacaatcactttgtctgtcgcatccggcatccctcgtcaccaacaataggttgatgttgtctgagtcatttcaggtctcctttgtttgtcgtgtcctcagacacgctgaggtggacatgctcagtggagtacatggatgataaaatgcttaagtccacacaatcgttgtaaccaaaaaaaattcgtgtaatctcttgagcaaaaaacaactaaagcatggagtggtatactcatcgatgataagtgcctttttcttggatatttatatagtcacaccaatttcatatgtagaacttcaaaagactgataaacaagtacctcaaaagacggtggagggttttttttttctgctttgcgttgaactcggtaaggaggagaatttaatttgttataagcttattttccttcttacaagaataaattagtatgtgttttttcaaaagatatacaccattctaaatggattatttgtagattattcatgtcacgcttctaaacatatgatgttttttccaaaaaaaattttctacatcacctataaacataaggcaattgttctaatttatttgttaggttcataaatataaaatatttaaggaaaaagtatgaattaccccctaaactatcgtggtcggtcgaattaccccctaaactcgaaagccagacattctatgccctcaactcttcaacgcggacaaattaccccctgaacactgttttggatggttttgggatagactggctaacggggcattacaacatgaaaaaaagtattttagaaaataatgggcccacctgtcactctccataactcctctctctcttcaccttagtccccctccaattcgctccatctctctttatccctaacttaaaagagaagaaatggtgacggaaaaagctagggtgacgatgaagagtgggtccccctggggcactggtgactgagcgcggtcggcgatgaaggcgaaaacttagtcgcccagggcacccaatggtggagcatggtcggccagagactgtccttgacggggggcgctgtgggcatacccgccggggtgtggctgcgcgatggtggaggagaaagaccattcgccacattaccgggcgccgtggaagggggatgcggcggcgacggcaacataagggggaagccaccgcctcgcctgacgctttgtgcgctaacccctccgtcctacttgaggtgcgaccctgttggatcgacgaccgcagcgtcagatcgaggagaggc

SEQ ID NO: 88773 - DNA, 2363 bp, Oryza sativa
gcctccttttctcgggggcggattttgttttgtcgcgtatctctctccctctgctctgtgagtgcgtgcgtgggagataaaaagggtcgcgatgcggtttgatgggctttcttttcgtagatgggccaaacacatggtcccaagatggaccgggccgatttatgagcgcacaaaggaataagtccactttgactcccttaaaagtgacccgaatctaatccgtgactctcaaccgtaaaaccggataggacgactccccgaattattgaaaccagtacaatttgactccctcagcggttttggagtgtggttttgctgatgtggcgctgacgtggcgatattgacctagtctacgtctcacgtagcgcttacgtggcaatagaataaaaaaaatctatgggactcatatgatattcacacataaaaaatattatgggtcccactgattatgtgggacccacatgttatcctctatgttcctcttcctcctccctctctcccttctctctttctctctcttgggcaatctgtgggcaggggcggcgacgtcggcgggcgagggctggagcagcgtcgggctgcggctcatgctactaggtacgaaactggtcagattttagcgtcgcaacgaaccagcgttccaattagcaagggagtagctatatttatggcgccatatttttcataaaaaatagtcggcatgcatttacattgtaagtccctaaattacatatgtaattttagtgtatttacaatgtaagttctaaaattacatatgtaagttataaaattacatatgtagttttagtgtatttaccatgtgaattgcaaattacatatgtaagtagatataaatagaagagatgctagtgcaaattcaatgggaaactaatgtataacaggagcaacatgttcgtagtacagagagatcaaataactacagacttagcaaatcaaacgttcgttaagtcaatcattaacagtgcaacatgaatctacatgatatccaagggtcagattaaccgactgtgatcaagctaattttatgtcgccataaatatagcatgtccgaattagcaatcatttgatttgattggtcaggaggtgctactccatttttctacattaacatcgagacggtgatcatcaccaacatgaactactacccggttggctgttgccagctaccacttcgacctgagcggcacggcgttcggcgccatggccaagccggggctcaacgacaagctccgccactccggcattatcgacatccactttaggcgtgtgccgtgcaactacccggggctcaagataaactttcacatttaggaggggtccaacccggtgtacttcgccgtgctcgtcaagtacgaggacctcgacggcgacgtcgtgcaggtcgacctcatggagtccaaatcggcgtacgggggcgccatcggagtgtggacaccgatgagggagtcatggggctccgcattggcagtgacatcggcaagaccctttgtcaccaacaacgtcatcccagccatctggtctcgaatcgcgccatcactgcctccgtcaccccttccgggccgacctcgttccgcgctcgcccactgccgcgcctctcccgcctcggtctctccctctgcccgcgcctccccgacgccaccctcgccgcgctcaccgccgcaccgtccatctcgcagtcgacatctcctgctctcggggattcctgctgctgcgcttgtcgttgcatgcccgaatctgaatgatctcgacttctccaatgaccactatggctcgacctcaggaatgcggcggcggcggaggtggccaaggtgcgtcgcctgcagagggagagaccgaggatgacatgtgggcccccacatgtcagtaggacccacaatatttttttcgtgaataatagatgggtcatacagatttttttttttaattctaatgcaacgtaagcgccacatgggacctggactaggtcaacgtcgccacgtcagcgccacatcagcaaaatcaccctccaaaaccgctgagggagtcaaattgcactggtttcaatagttcggggagtcgtcctatccggttttacggttaagggtcaaggattaaattcggatcacttttaagggagtcaatgtggacttgttccgctcacaaaatgctaaaaaattcacaaatatttatcccttcaaaaaccaaattggctgtgttcggctgggctagctgctgctacaattgttgtgacttgctggagcctgctaatggcctaagacccgctccattcccaatccacaccacaacagtcagatcaaatagttcaaaccaacccaacccgcaaatctcctttcagaacccaa

SEQ ID NO: 88774 - DNA, 6291 bp, Oryza sativa
agttccatattctagtgctgttggttctttgatgtatgccatggtttgctcccgtccagatttatctcatgctatgagtttggttagtaaatacatggctaatcctggtaaagaacactagaaagctgttcagtggatttttaggtacctcaaaggcacagccgatgcttgcttgaagtttggcaggactgataaggggcttgttggatatgtggattcagattttgctgcagatttggataagagaaggtcactcataggttatgtgtttactattggtagttgtgctatgagttggaaggcaacgttgcagcctgttgttgcctagtctaccactgaagcagaatacatggctattgctgaagcatgtaaagaatcagtttggttgaaaggattgttcgctgagctttgtggagttgattcttgcattaacttgttttgtgacagtcaaagtgctatatgtctcactaaagatcagatgtttcatgagaggacaaagcatattgatatcaagtaccattatattcgtgatgtagtcgcgcaaggtaagctaaaggtatgcaagataagtactcatgataatcctgctgatatgatgacaaagcctattcttgttgctaagtttgagctttgctcaagcttagttggtatagtggtttaacccaagaggctattcggcgccgaaagtgtttttgtctttgttgtattcagggtgaaggattgtttcatgctacaagaaggaattcgtctcaaagtggagtttgttgagttgtgatccaaattcatttgcacttaataaaggccaacttctgccgtagtggagcggaggcccgtcgccgggaggcttgggccgaagcgaaacggatcgtcatcccttttaggattccaccatatatatacctcttgtaagccgccgtgcggtgtcgacccccgtttttataacaggaatcaatcgtgtaaacagtaccatttccctggatcaagtagtttggtacacacgaattcatagctggaatatcaagtgcacatacacgagtgtctaatacgaattattacatcataggcccgcaggcatagtcttaaatcatcggaccgagaggtccggaatacatccaaaagcagaaatagataaggcagcggaattcaggcagcggcatgccattgccacaggcaacgaccgtactaagacctactggacgccatcgtcttcatctccctcctgatagtaggcatagggatcctccgaggcttcatctcccgcttctgataaattttatatttgcaaggatgagtaccaaccgtactcagcaagccaccacaacaatgatgcacatgacagaggaattcaaaggatggctatggttctcttgcgcaaagcaaattttgtaattcttttcacaggcataagacctagcatagactgatcaagttttaataccagtgttcatattaaacaatgacggttctgtccactatccattgtgatcccaaggatagcttcccgccattgaatcgttatggttttctgaggatgtccaccttcccacctcttgggaagtggctcccacagcataaaattcatcatgcaatattccatcccacacaagttaaagaatttagagtctagccaagtgtaatacatgtctcggtgctcaataaccgcgagcacggctattcgaatagatttggttcactcacactgcagtggatgtacactttacccgcactccgcgactgcccaacacataagcctcgtcccaacacacgagacgcgtcacggcaaagcttttcgataaccccgcattggcagtacccgctccatgaacttaaatcctcatgcactctaggcgtccatgtttctagcagtgagaggagttctggcgctcccgggaaagagaagtctcacacacatattaaattatggttcaagttaagttctctctctcacgcactcatggcagtcctaccaatggcaacaccgatgtagggcacgcctctcggccctacctcaacggctgtcccaccatagcgcacctgcctcactcaggggtgaaccatctatgcagggatactgcctccgctcggctatctaatccgctaggtctatacccattcgagaagtacggttgtacgggggggtcgttttatgcttaacttcatggctcggtccttaattgaccggggacggtactagcctttcccagataccacccaaatcctccgtccgccccagtcgaaaacaattgtttaattttatttatcctttcacaaatcatgtcatcaacgtcatggcaatgtggcgctcatgtctccacatgccgtatttcaattaccttcccaaaggtaattgcccaagcatatagcatttgataaatatgagtatgcatgattctagaatagcatttctaagcaattgtcatagttgactagggactcatgcgtaaacatggttacaaagatttaagggtaaacaataatcaaggcatggcttaatcacaagtaggatgttcatcattgcatgcaattttatttgtaaacaaaacaatttcgcaattaggatcaacatgttcaaggaatagtgatgacttgccttgctcgaggttttgcgggtcttggccttcacctggatccgcggctccctcggtctctatagttacgtgcgagaattgatctgaattcggttagaattcaaataaaaatccaagtaaatccaaatggaagtcgaacgcgaaagtcatttcctttttattaattttactatccgcgaactatggcaaaccccaattttggtttaaattattttgcggttacaatattttgttgtcgtatgtttttaatttaatctaccctagcattatatccatatattaggttagaaatttcttatcgcgagctaaatgtcggacggaatcctaaaattatcttataatattatacgacttaatttagtctatgattaaatataatacacggctaacaccctagtaattaaatccgaatcgctaccgttgatcgattatttatagagattacccagaaataatccacaataatttacgagaattcatacatttgtttaattattaattacatctaaattaataccgcgaattgatttcttatggagagtactaaaagttatctataatctataggaatttatccaattataatttccttaatcctacatttaaatgctagtattttaggtatctaattagtaagagtttatctaaccatattttcattaatcctacaattaaattctagtatttgtaaatattttaaattcccccctaaattcttccccttttctttttctctttttctctccctctattttattttctctctccctctattttcttttctttcctctcttttctctcttttccttttcttttctttctcttctttttctctctccctctctttctttttcttttctccttctctctccctctctttctttttcttttctccttctctctccctcccggttcctctcctcctcccttctcttttccctccctcggttctccctctctctctcggctctccctcctacccgagcggcgcggcgacaaaagaaagagggggggggggaaacagcggctcaccgacggcggcggcggcgacgacggcggcggcgacgacggcgcacggcggcacgagaacggcggcgcgggggcacgggaatggcggcgcggcggcacggaaacggcggcgcggcggcactacggcggcggcacgggaacggcggcgcggcggcactacggcggcggcgcggcgaaaagggaggagatggaggggaatgggtatgggggagaagagatgggttgggggttttatagggtgtgagagggggagaaagagggggcggtgaggggatgcgacggcggcgcggcagcgcgcggggcacgaggcggcgggcacgcggcgcgaggtgacgagacggcgcgcggcgccgcagcggcgacgggacgcgtgcgacgacggggcgcggcgatgggacagcggcgcggcgcggggtgcggggcgcggggcggcgacggcgacggctcggcagcggcgacgcgactgcgggcggcagcagcggcgatgggacggcgcgacgggatggcggcgagcgatgcgcgacggcacgggcgcggggcgcgaggcggcggcatggggcttcgggatgacgtgataggcggcagcggcgacgcgacggcgggcggcacgaggcgcgggacgacggcgatggggaacggctcggcagcggcggcgcgcggctcggggcgggacgcgacggtagcgcggcgcgacggcgacagggcgagtcgacgggcgagcggcgatgggacgggcggctcggggcgcgaggcggcgatgggacgcacgagcggcgacggcgacagcggcgacgcgacgggcggcgacggtgcgcggcggcggcagggaggaggcggagcggcgcgcggcgcgcggggcgcgaggcggcgtggcagaggaggggctagcgctagggaaccacgtcgaacacctggcggccgatgaacagtgacttttcctatttatcccgattttagtgtattttccatataaatttgatttcacaattcctaattttacatatatgcattttactcaatattcatgttatcttaactaatgaattcaccctagattaatattactcatattttatttttatataattttcttgaatttaattagagttaattcttattcctacacttttcgatttaattgatacaattatagtcctaataatattttactcatttctatcctctctaaatattattttaaattgctctttaattatttacttagtcaatttactttttagggtttactcctaactaattttccattattcgcgatttataaactccgagatcaaaattcattaaaataatcgaacaaaatcggcatgatgcaactttatttaaaaagtttttgaaggtccgtatttttagagtttagatttcgtcgtcgaatttttagggtgttacatgcggcgtggtaacctcaccccagatatagtgaagatattttgctggctggcgcccgtggttttttctctcctactttaggagggttttccacgttaaatctcgtgtcttctgtgattgatctattgttttctttatcgtttgttagcttatcgtttcctaacaaactgaagaggtccggcctctgcacctagatgagcctctgccagtaagcaccgaaaaagcaggcagcatggccggaacgcctattggccatttctgtcgtcaccttctccgcgacatactagaggagggtggcccagtcgacccggtgagccgagccgtgcctcacgctttccgcggcgcggtccacctcctcgatgatggacacaggaagaggaggcggctccggcgataggtgcagggtgaggaagcggcgccgacgatgaacacggggtgaggaggtggcgccggcgacgggcgcggggcgaggaggtggcgccggcgacgggcgcggggcgagggagcgccggagcggcgttggcgacgggcgcagggcgtggccgtgatggacgatggcggcggcggcggctgaaggagtctcgtcctgctcgcctgctcggtggggaatttggtgaatggccgaatgggccttcactggagtctaaccattttggacccaatactgtattttttaaccaaaaccagatcggtccgaaccaatttgtctaagaaataagtccactttgattcccttaaaagtgacccgaatctaatccatgactctaaaccacaaaattggatatctcaacccccgaattatcgaaaccggtgcaatttgactcctttatggctttggagggcggtttcggtgacgtggcgctgatgtggcagtgtagacctagtctatagggttgacgtggcgcttaggtgtcatttgaattaaaaacgaatatgtgggactcgtttgtcattcacacataaaaaatgtgggggcccactgacatgtgggacccgttcttcttcctcccctcttcctcccttctctctttctttctctttctctcccctttggtcggccgagccgcagagagagcacgggctggagcggcggcgggtgggggccaaagcggcggaagctggagcggcggtggcggtgggagcggcggcggatggcgctcgccctgtaggccgactgcttcaccagcgacctgagccagctcatcatcgctgacgtgatgtccgggtcagtgccgctcgacgcaagcacgagtatcaggccccccct

SEQ ID NO: 88775 - DNA, 512 bp, Oryza sativa
cggcgacgtgttcttcgccgtcaaggcgttcgcggcgggcgtcatcctcgccaccggcatggtgcacatcctccccgccgcgttcgacgcgctcgcttcgccgtgcggcggaggcaggggcggcggaggcgggttcccgttcgccgggctcgtcgccatggccgcggccatggccaccatgatgatcgactccgtcgccgccgggtactaccgccggtcccacttcaagaagccgcgccccgtcgacgaccccgccgacgccgcgcgcgccgccggggtcgaggagggcggcgccgagcacgccggccacgtccacgtgcacacgcacgccacgcacggccacgcccatggccacgtgcactcgcacggccacggccacggccacagccacggcagcgcgccggcggccgccacctcgccggaggatgcctccgtcgccgaaacaatccggcacagggttgtctcccaggtgagctcatcaccaaccgtcaagctcaatctcgttacgcaca

SEQ ID NO: 88776 - DNA, 824 bp, Oryza sativa
atccaattaaattacagcttaattccaacaaaagaatccaccatccaattacaccaacaccattcatcagaagtagttaaccaccagattttttggggcctatggcaaatacagttccaaatacttcaacaagagccagcaaaaaaaaaaagaaataaaaaagaaagaaataaaagaagagaagcgaagactttgacttttcagaactgcgtggtgtttgacccggacgccccggcgccgtagctgctccggcgcggcggcggccgccggatcgacacgagcccctccgacacgacgctcccgtcgtcccactgccggccgagcagccccgtggccgtgaccgccgcctcgtcgtcctccccgcgcatcgcccggagcgtccgccgcgccatgtcccggcccacgccgccggcgccctcggccaccggcgtgagcgcggcctcgacgccggcggcgcgcgcgagccctcggaacctcaggctcccccggctcatcccgtacagcgacgagatgcagtactcctcctccgcgctccccggcgcggcggagccgctgctcatcagcctcaccacggcggccaccgcgccgccgtccatcagcgcggtcctcccgtccgggcagccggcgaggttcgcgaggatcatcacggcgatcctgcggagggcggcggcgtcggcctcgttggcgcggtcgtccctcgccgcctccgccgcggcgagcagcgtccgcaccacccccggcgtgcgcgcgatcttggaccggttcatcccggagagggagacgtggtacagcgccatgccggcctcgcggcgggcgaggtgggc

SEQ ID NO: 88777 - DNA, 1756 bp, Oryza sativa
  unsure (1)..(1756): unsure at all n locations
ggtggtgtttgtggcgataaaatatttaattcgtcaagacttatcagcttttgactcccccctttggtttttaaatagatagccccnccagtctcttgggtcaatttttgaaaccccctaaaccaaatacaaggcaccggtccccttaccccattgtatcgtttgccaaccgatgcgccaagtaaaggaactctttatttgtgggaatccggccataaaggcactcacagctttcccttggtttccccctttaaaaaacaacccatcaagccccgccatttttcttacaacaggttgtaaccctttttttgcatggatccagaccatatgtcattcctcttaaatactgttggatccaagccaattttcctattccccaccccagtgttgccagggttgtttttaaaaattcaagtttggtatttaaccaactttgggatttgcccttaagttaagtcaaattttttttcatcacaagccattttcttttttcagctcaaagacagatgcatatacaaacatttcttattgaacagttgctttcatatgagctattggccaggaaggattagcagctatgagattgccatacttttctgctatcataacagatgcaaccagcctactatccctcctaggtggacaagcatgcaggttgtcaaaggttactatttgccagctgtctgacctagaattcttggaaagcagacatacccagggacaactttcccaatcacactttgccctaaccctttgcccatcatccttagcaaagttgatcactttcctctctgcaatagcatatgttgtaatagctttcttgaattgcttcttacaactgaatttcatccccaattcaaatttagggaccccttggctcttcttataccttgcttgatggctgccattagtcctcatctccccatcactgccaagttcatcaaatgattcctcctcatcactatctgcataaggggtttcattccctgcctcatcaccacctgtatgcattcttggttcagccttctgaaaaaaaatgtcatctaggttctctagttgtcctgccttaaccttcctcttgacctccttgtaatgtttctctatctcaacagccttttcatcatcatctgattgagcatcatcccctggagtataatcactgtcttcatcactgtcagaaggtgggtggctagctatgggtgtactgtcatatgttggatggttaggaatgggtgcattggcagaaggttgatggctaccacagggtgcactttgacaaggttgatggctagcaataggtgctgaatcagagtggtaaataactatcctcctatcagtttcttcctctgccggttctttacccttacatccactaccatcaacctcatcaacccctttccctttggatacatctatatcaacctccattttcccaccctccttttcactttcaacttctaacttcatttctgcctcccaatcactgtcatcatcagacccattacacaaatcaacaatctctggctcttcaacatatacatctgctatatccaattctcctgtatagtcacacatcagtttgcaagccttatcattagaaagagcacgaagatctgtttgcaaatctttaccaggaaacaaccagtggagcaaagtcccagacatcacattgcaatggtcctttaggtggtccaaaaagttggggcaaagaaacatagtctctttgtgcatatccaaggggtntctattgccagtg

SEQ ID NO: 88778 - DNA, 2207 bp, Oryza sativa
cccaaggaaccaaacaatcttgtgtcacaggtatttcccagaggccgaatataaaaggcactctcatagccaatggcttaagaaggttataacaatgaagcgtgccattgtagggctcatgaaaccaattttacaagttctcatcgcccggtgtttgtaactccttgtaatcttagtgtgcaggaaaggtcaaaagctgcggggtagatggtctagtttatgactttatcaccaaaatcgccaagaaagagcacattttggatatgcgcctgtcacaacttcgggcgcattatttctccaccttcagtggtctttgactctgtgcctctgacaccattgacacggttgtggagaaactccctagatatttacataaactgcatctgctaaagttgctagatctggaaggctgtcaatatcacttggacaagaaccacctcaaggacatctgcagcattttacatcttaagtatctaagcctaaggagaacagatgttgctgatctgcctcatgaaatcaacaacctccatgagcttgaggtattggatatccgtcaaaccaaagtgtctgagcatgcaacaaaaaatattgtgctcctaaagctgaggcgcctacttgctggtcaagttgatccaagcacaagtcatgaaatgggcaagccattgcgctcagctgtcttgatcccacgcaaaatcaacaaaatggaaaatatggaggtattgtccaatgtgaaggcttattcaaggaatggagctgagttaaaagaaattagaaagctagggcaactgaggaagcttggtgtggttatcgttaacaacgaaaatcacctcaagaatctgctctgggccatgagtgacctaaaagaatgcctccagtctctttccatcactatacttaaaaccagaaatgagggtgatactgccaacaagcaaaaggtgctaccacatgatctgtacaatcacttgatacagccccccaaggttcttgagagcctaagcattgatggacccccaaaaaatgttcggcttcaaacaatgttcgctaaaggtagcaacgaacttgccaaggtaactctgagacacacctcattgaaaaagaaaaaatctggtccacatcaccatgtttcccaattatgttgcgtcagactccggcaaaatgcataccaagaaaagggagctcactttttagacggaagaattcccacatctcaagaattttcttgttgaagcagctcacgaagactgacatgatcaacttaaaaaaaggagcagctcctgagctcgagaagatcgtgctattccgcaccagcataaagcatctttgtggggtcggtgcccttccaaacctaaaggagctcgagttgaaggaaaacgagcagcttgttctatcacctgaagctggaacagtttccgctgatccagttatacttgaagattggacagactctactgatataattgtacataaagatggagcaacttctgctgaaaagagcgcactcaccttcaagaagaaagaattcaagcatctcaagtactttcttgttgagggtcaccacatgcagactgacatcaaatttgaaggtggagctcctgagctcgagaagattgtcttgtccaatacaaacatagagtctcttgatggagtcgacggccttgcaaaattgatggagattgacttgaagggtaataagaccattctttcattatttgccactgccaatcatattgccaaggtaactctttccgatacttgcctgaagcaaggtgatctacaaatcctcgcgaagaaaccaaaattgtgctggctactgctcttggacaaatcttatgacgaaagccatcttaccttcaacaaagatgagtttcccaagctcaaacatcttactatcacgtgctccaagatctcgggcatcaacttcgccaaggaatctgcctgtaagcttgagaagattacctggtccttcaccgagctagagtctctctctggaattgacaacctcccggaattgaaggagcttgagttagaaggcaaaagtgtccctcttcaagtgtggagagatatcaatgcacataacaagaaacttatacacaagagaacacaggttcaggatgaaccaaaaggaggaccgacactagctaacaagaaaaagtctgcattcttctccatctttccgtccactcatcgctgattcccggtacttgcta

SEQ ID NO: 88779 - DNA, 2265 bp, Oryza sativa
  unsure (1)..(2265): unsure at all n locations
cgcccttgaattcacntctaattggcnnntaccatnncctatatatatattgatgttaagaaatctagatataaatatggaagatgttagaatgacttacattgtgaaatggaggtagtagctagcaagaacaaacaacaaaaattaaaaaggccgataaaaaataatctacatccggagaggctgcaccgttgtagcggcattacgtcgaacgccaccgccgccggccggtgcaagctagctagcctcaactcagtgagcgccggacggcttcgctatccacatccatcgccgccgcattgtccttcagatcacatccccggaggcccggagtcagggggaaaagaatgaggaactccggcgtagggaatcccggcgtaaccgcaagcggcggcggtgcctgtgccggtgcctgtgcctgcttctggtggtggaatcccggcgtcagagggaacagcgggaggcacaccggcgacggcgtaggttcctctttctccccgccgccgccaccgatgatcgggtcgtcctcctccttgctccacccggccaccttcgagttcttcgacgacgacgacgcctcctcctgctgccccggtgttggcggtggcggcgaacgattgccgccggcaccgcccgttgctcctccctctaacgccgccatcgcgttcgtttcgattgcttcctctccggcgatgaataaagtggaagatgaactaaccgaaagtacttacacattacattatctctacgacgtggaaggagttttatatagttatctttgcgacgtaggagtttgagtcgagttaaagaaagtatagtgtttgagattaattcgagtcaggtttaagatagactttgactttgattttcacttggttaagtttattagcttctgcaaattaaattgaatttgatattgcaaattacaaactgttcgtagattttattttcaatttttgaatcttttagttttcaattttaaaaatcaactctctcaaattttatttgaaaattctaaactttttgatcactagcttggcgaacaacatttgttttgtcacgccaccattactggcatggcaaggatttttccatgtcggctaggttggtgtggtaaaataacactagcacagtcaccattggtggcaggggtgaagctaggataaatggtcaccggggtcagtattaaccagggtttatgtttttgatcaaaactaaccagaaatcatgtaattttgatgttttgccgtgggacgaaaagtatattctgagtgaaatttcgaatgttttttgagacttcacagtaaaactagatcaaaacttattaaaatttggtaagaaaaatgtcatatcgctacattggaatccaacactaaatcggaaatatgtcatctagtttgtaattaatgatataagaatatacataatacaggacaaaattaatgacaatacattatgataaaatgaaatgtctacaaatctattaaaaactatacattattaatttgtaaaagacatcaaatgcaccaaagatcatcaaaaccactaatttcttgccttccgttctgctagaaataagatgatactccctccgttttaggatataagatgttttgactttggtcaaaattaaactactataagtttgattaattttatagataaaagtagtaatatttttaacccaagataaatatattataaaaaattattcaattatagatttaatgaaactatggtgatgttgtaaatattactaattttttctacataattagtcaaacttacagtagtataagatatcaagatgcgcaatgccggtgcgggacaaagtgctcgaaggaatacgatgacgcaacaagagaaactcgtggagttgtgggcttccaatgttatttttggatccaaatcccaatcgtatatgtatattcggctaatgtataaattataagtgctagctaatttattgtttgttagtaccgttcctagtcgctatttgggttttgacggaagaatcaacaatattaccggggtctagtttttctcttcactcaacaatattaccggggtctagtttttctcttcactggggtcatggatggcaaaataaagaagggtaccagaggttcgcaaaagatcgtcagggtcaactgacccctatgaacgagtgtagcttcgcccctgattggtggtgtgacacagtaacaacgttgtttcgaaatgtcaccaagccagtcatagccattcganaagaattcaagccat

SEQ ID NO: 88780 - DNA, 3921 bp, Oryza sativa
  unsure (1)..(3921): unsure at all n locations
cctagatatcaaccctcccgaagataatttttatcagaacccgtgaattttgggctcgaaataatattccccccttcagagagaaattccctttaataacttgttgagattgacacagagcacagtcatattcgcaaaatttgcttcccaacctgacccgctttctttttattccagatgttggaagatataggtcagcttctttagtctcacttaatatgtccaaatgccgcagagtttataaataaagcaacttttggtttttttcaaatggacaaccattcatcggtattctaaaaagtggcaaaccagggcttttattcaaaattcatttaaggttagtgttattgacatttggggctagacccatttgttggtgacatagagtgctccttccagactaaggctcatgatttaggggttgttttggacttttggttccttggaaatttttatgtccttaaagctatttcagcctaagtcgggtgacataaaatctactatattttttatctcttacctaattatttgggtgattctgaaggatcaatggatagtttctgtatacattacaattttgaactaggaagcgctgttaatgaagcataccaatctgtcttgcattcatcaattttgaagttctctaaacaactatatataagcttataattgtcattagttcaactttttcgagtactatttttgcaaatctgatgggagttactctcaaatatcaaatctgacttttgccttgagtggcatatacatgaatgtaacctgtttgctgaaacatgcttgataggagttactccagagaagttcgcaaagaataacaagttctggagggaccaggttagcatgtattggtcatttcttggtgttgagaagactagcatccgaaatgtcatggacatgaatgctaatattggtggatttgctgtggcactaagcaatgatcctgtctggattatgaatgtagtaccccatacaatgagcaacacattgcctgttatctatgatcgtgggttaatcggttcttaccatgactggttggttgtttttctggaaaaataaacttttcttttcattatttgtgatggaactaaatccatctatgctgcaggtgcgagccattctcaacatatcctaagacatatgatttgctgcatgctttccacatcttttctcattaccaaagtcggaaggaagactgttcattggaagatatcatgctagaaatggaccgtatcattcgccccgaggtaaccatgccttgtattctactacagagtcaaacttcaaacatagatattattatggtcacagaaacgattttttaatgctatttgtgctagaacagaagttatgctcattggcatgctatgttcctcagcaaatcctagctctagtcatcaagtgttttggcctatcattattgatatatcataaaatagagtagaaatgccttatcagaatatctatatttatcaacaacttgacttcagtgcaaacgtaatgattgatgttttatcgctttgcatagttaataaatattttcccaattcatttttagtaatccacaaaagagattggactgtgtcccatgattctcacaagctaattactgacaacaatatcagattggtgatcactgcagaataaatagtttatctggagaaataagataacatgttatgaaattcaatgatagcatatccttaacctaatgatttgccattcatattattatgaactgtaagctaacagattcacgattcagacattatcttgtgtaggatcaacttttgtgtttttcaattttatattgtttattacataaatatagtttatagagaagatccgtgatctgacaaaattattaatatacagggttttatcattattagagatgagaatgccatcttgtcaggaatcaatgatcttgcaccaaagttcctttgggatgtcaccacacatatgttggaaaatgaggaaagcaagccggagaaagtcttggtttgcaggaagaaattctggtccatcgtttgaggtgtgcttaggcctaaagctgttgtttttatgacctattttgcattcccatttatatcgctgactaaacgtgggtattctgcaccagtgagcggatactattcaggccagttctttccagatgagtgtcctattattgaaaaagcagatgtcattcggcaaaaggaacacagaaaaatacatggaaaagaaaagaggacaacaccgggtttccttcagcaactatttagattcgtatttcagtgcttgagtatatgtcgatttttctgactttaaaaagggcagaccaaaggtgtaaagatgcaagatgactttttcacttgtttgatgacgatgctagtatgtgttatgtactttctaatttctaactagtctaagttaacctaggtgttttagcaaaattttgctggtgtttctgttcttgtatgggagcacatgtggtactactacgactgaacggcatgaaggctaaatttacagtggactttgagggataattatttcattatctgtttaatttgatttattatcctagtttgtatggtgtggattatcaaccatgcgcttgtttgcaatatctgcctactctgtctctacgttgagctacccagtgttaacacatgcaatcgccatgaccatgcatgttccatgcctgcctgtttctttatttgttttttttaaaacaaaaatattagcatgctattctgctatgttccacggcacattgttctcatttttgttccctttttttttaaaaaaaaaactttggagttttaaaccttatgtttttatttttccgatatgctttatatttagctcggattctagttttattttaatttccacatgttttttttcctttgcatattttctgaccgattcttgcatgttgattgttcgcctttttaaaacctgcaacttctaagttcttttcctgatctgctttatgccttttcccatttctgcatgatctgcatgttttattggtttccttcttatgtgtgatattctaatttttgtttactttgttgtttcttattattaaaaggtctgtaggagatgttccattatatcttcacacgcaaaacggaataactcattagcgcataattaattaactatcatctattttgaaaaaagattaatataatttttaaagcaaattttccgtaaaaagcgagaaaatgtaaaaatacaggcacaaaggggagagaagctagagcactaaaaaaatatgtacttcctccatttcacaatgtaagtcattatagaattttccacattcatattgatgttaatgaatctagacatattgtgaaagtcattctagcatttaccacattcatattgatgttaatgaatctatattgtgaaacgtagggagtatattacaaactctgtaactaatcaagcaaatctaatgaaggggccggttccctcatcctacaaatatggatgtgcaggtctccacatccgttaaaatattatataaaataatttcattacgctgcttacagatatgtcaatatgtcaaaaacatgatctccgtaaaatttttttttatgatttttagcacgacacacgttgcccgaaggtgtgcacgtagtaaaactcatgcgctttagaatttaattagaactcctggcagctaatttaattgtgaattcacaattaattaatgaccacatttatcttgttttttaataatggaaaaaagaattccggcctttgcttcaaaaaaagctacaactacttattacaaaattctcttaaagaaaacaaatactcaggcaacagtaagaacataataataaagccaacagacaaggcannnncanttngaaggggccnatccacngagaattcatggga

SEQ ID NO: 88781 - DNA, 2268 bp, Oryza sativa
gcgcccccctctagtgcttctctatgtggggcaacagaaaagagcccacttcggtgtggcgctcccacctttttagttttctttcttccgctatatagcacgagccataatatgttgggcctccaccaaaataatttggcctgtgtaagagttatccgcccctcctctccaccccaacaatgaaggtgggctaaaaacgcaggtgcgcccttttccttcaccccccaaaaaaaggttgggtataaaaggtgcgcactttaacacgaagaaggctttgtttcaaccttaccttcccccgcaaaaattgggccactttcagagttttcttggtttccccatggaagaagaattgaggactccctccatttttcttctttggaagtttttgttgagggcttttcatttggagacagccaccattgcccttccacaattgtcagcctccacaaatccaggttgtgaagcttttggaatggggaaactattgctttccggttccactttgagcggatcccaccttgttctgtgcaaacttttggctcttccaccaaccgttgccatctcctggttctccattggtgcgtgcaatgacatatatgtgttaattgttaacttttgtttccggttaaagaataactttggaatgaatattttttggctttacccttgctctttggagtgtttggtcctggattggcttgtagtgtttgtggtagtcaggctgccaaatttcctcttcttgctgtgagcagaactgcatagtgtgtttgataacactcatctgctggcttggtgaaggattttgctgttgagaacccactgtgccagaaccactagactgatgctttgaacaactgcttttgttgtgcccaacttgcttgcacctagtgcatctaattacagtaccatacttgggcatcttggttggcttgggtggctcatgcttctccctcctcctttcagtttttggccttcctggcatcttaatgtatccaggtgcatttagtggttccctatcatcctgtggccaagcactcattccttccaatggctgaaggcaatgcacatatgtgcttctaaatgcatccacatagtaacaaggtgcaatatagtcatctagcttatttgttctatagaatatgcatgatatagcatgagggcatggtaatcctaagagctgccaatacctacaagagcactccttcttgtccaagtgtactgtaaacctatggtcatggtgcttaacctcaaaactatcacctccattgcaaatagcatggcaaaaagctgattcagtgatgtaaacattaagttttttgagaattcctgggcatacaacagtagtccacttagcaccagctgctttttgatcattgatcctaaccatgacctttctccaaattgtctcaagcattgtgataattggatgaaatctagattctaatatccatctattgaaagattcacataagttattgtcaactgagtcacagttagaacctaacctgaaccaagctctactccaatgctcaggatgtgtgttcagtatagcttgagctccagcttgagtgacctgtgcaagtttaaccctagcaagattaaatagtattatgcatggagcttttgcacacctccagaacttcttttggaactgcttctcatggaaatgccttttccaattggtataaatgtgcctagcatagttcctatgctcagcctcatgtgcccatttcttcacagcattaaggataccctgcataccaaacagaattgcaaaatttagtcagacagatgtagtgaaaggtgacacaacagaaaattaatcagttcaaagcaaatcaagggattaaatacccaccttttgttgatctgaaatgaagaccccaaccagttctgtgcaactttgattaccacaaagcaattagggacccggtccattctcattggtttactggcaacactgcccagcttgaagaaacatcggatggtggcatttcggctttagacacaacaagttttcattggtttccccttggaaaaacaatcatcaggcccacacttttctaaaccagattgaaaactttttggttgcttccaaaaaaggtccaaccttaaaaacggggggaccagcaaattcctttacaaacaaaaggttccaggtgtttttaaaatcaattggaataaacaacttgttttgccttattaaaaaatttttttttaagaacatgttttttatttaaaaagggcttaaaatttcttttcacgggt

SEQ ID NO: 88782 - DNA, 1145 bp, Oryza sativa
  unsure (1)..(1145): unsure at all n locations
tgatgagnataganaccctntgaaganccgcgaatngnngntgccaccttcattctccctttggcttgtcatcttcagcacaatatcatagtagagaccaacaagggaatatgttataggctcccacggtgttgaacaaaatccttgggccttctggttgttgtttgtgatcactatcactgcattgccattggagcaatccaacaggctcaaagcattttttatcccctcccactcggatatgtagcctctatcatcaatgaggatgaaaagggtcctttttctttctagaggcaccttaatcttgtccactatccctttgatgaacagtgaaaatttaattgctgacgatatctccccaaccttctcattggtttcttgtattgcagcattagtaccttttgccttagtgtcccttgggttctcattcatcttctcctctgtttctgagatggcagcatcaataacactattttgatcacgaacaccctgcaggacacctttggctagttccttgacagagttgccttccggaagctgggaccagcgaagcaactcccgaacgatgtctagtgcaatcttgtggttgttgaggatttctttgatgtgatcctcacccaatgtagtagcagtattggtactggtttccttggcgtgtgagggcttagtgtctaggaacaccttctgcaggatgtctaggtattggatatcatccaattgaattgggggcttaggcacgacagattccatgtgttgtttaagcatcatggccgtctcctgcattatcttggtatccgatgatcttnnctatatgctgagcccttcacttgttaacattgagcgcattgccttgtggaacatggcaattgaaaatatcagtgtagctttcaagtacttggttcctccatcttggtggtcttgacttctcagtgtttcattgacttntcatcttggccttaattcttcaatcttgcggcaaaatcaattttcaaaccttttcacatttaataaggggggtaagntggctggaaagctttcgcgtttttggataaactccctttaactttgccggctgttgtgttgaacaaagtttatataggatctcccaggttcccccgaaaaccctggtgggcaatacctcgggt

SEQ ID NO: 88783 - DNA, 5055 bp, Oryza sativa
  unsure (1)..(5055): unsure at all n locations
tcaattcaatttcctgtgcaaacaaggattccttctacagtcacacatgcattgagtgtttgagttgaccttgttgcttgttccgttacggttgtgttacccatttataagctctggcccaagttctccaaagtcaatgtcttgattcctgacgaagtcaagatggcagtaatgctgcacacttgatgaagagtgcgttgtcatcatgtgctcatcttctatgaccccaggcgtacaacaagacctaaagatggggttaaagatgcaagatttgtgcggccnttccttgcttggaatctccacgcaatactcaaacggcggtttgcaacatcgctcaccgggtccctgagctcacgcagcgcaagggctgcgtttcgctggtcatgcatctttcgcacaagccaataggtccacaagatgtagcgccggacaccgccctggcgaaggtggaccgccaagtcgccgcttcgaaggtagtcgtcgacgcagttgctgcagtcgtggccgaggtcccggacctgtttcatccacgtgcggacctgcttgtcgtgcccgctggcgagatgcgccgtcctggacatgctctccatctcctccttgatgaactccacgtcgctccccatgcggcccagcagctgcgcctccttctggaggaggcccagcagcgagctcacagctccggacgcgagctcggccattgttgcgccgccactccaccgccggctgcccggcgtatgtctggctagctaggaagggtgtgtggatttgtcttttcttttatctttatgagctgtgctggtctttcatcaagattgatctctaatgctttgatttggctgtgtcatggtgcctggtttcttttctcctttattttggtggtggcaaccgggcaagcattatacttccatccaggattctttgagtcttatctttagattagtaccatgtcccttactttagttctttgtttattctttttttgcctttggctgtttgtgtttagcatatattgattctaaacatgacgtacatggagaacgctctacatttaggcttaagtggagagtactcatgtttctatagaaggaagaaatcaacttctttaaaaatggaaggctgctacagaacagaactctccataaaagcaaataatcaacttcctacttttgttactaaaactggaaattcactctcttccaagtatgttaaacttttggatggtttttaaggagctcaagtttttttttttttttggccatccattagaataggatccaatggaggatacaatctattaccttgatggaggtaagatcacggtctacctttttgccctattcttactaccgccctgttgcataattcttggtttaaagtgcgtaagacttgcagagtacagtgaattgtttccgataactatcgaggatacccaagcacatgttggtcacacatatcgagtattatcaggattaattcttccgcatgttattttgtaatgaatggccgaatagctaaataactgaatgatttccaataactattcaagggtacaaaggaattagataactattatgaagatgggaaatggattcaaaacaatatcataagaaattcatatatagaatatttttgcaacaatctcactgtttagaagtttgagaaacgtgcatgttaattcattcatccattaaacaagccgggtcctcacattggtggtgctctcccaactttaatttgttgtgacaacaccaaatggaatacctacatctgccttgatgtacatgtggaagaaacctgcacacaggaaaggaacattgcatcattgcaaaatttttttttaaaaaaagtgatatccaacaccaacacatcctgcagaaggtgaggcaaaataaagatggggacttcctatattcctattttttcgcataaatgagagatcatttagaagccgagacagctcattatctaaactagctggaccgagttgagccgtgctggcttgttgtcccagcctaggcaaccaggaaggcacggtactattccattctttgagtatttctttaggttagtactatgctccttactttagctctctggttatccttttcttgcttttgcctgtctgttacagcattgatttcacatcctctgacaaaggaaaacccatgatttttattgtgacaaattaaaggataatgtgcaagaacagcatccgacatggccctaatgtacatgtggaagaaaccatgcgcgcacatgcacaacgtgaggtaccatgataaggagcaggggaaggccaggttagacagcatgctgagggagcaaggcaggtagctagctcagccaactaaaaaaaatttcccctaccattgctaattttattgatgatctaaagctttgtttcaaagtgtagaatggaatggggagaacacctcacacccaatgggaggggtggccatgcattgatataggaagcacatgtacatgatcctcaattagaggagaatacaaggaaagagacaatacaatacaatctgtacatatatggcaaagtattcctaatacccgcccgcagtcgcagcgggaggctcacggacgcaaaggctggaccgaaaatctgtaaataactgcacaggcaagcccttggtcatgatatcggcgaactgatgtgtagacggaacatggagcacacggacctgtcccagagccaccttttcccgaacaaagtggatgtcgatctcaatgtacttggtgtggggtggtgaatcgggttggcggtcatgtagacagcactgacgttgtcacaaaagacgacggtcgcggtggagatgggagcatgcagctcctggagtagctggcggagccaacaacactcggcaaccgcgtgagcaacggcacgatactccgcctcggcgctggatcgggagaccgtcgtctgacgcttggaggaccaagacaccaggttgtcgccgaggaagatgcagtagccggaggtggagcgacgagtcggggcagccggcccaatctgcgtcggagtaggcgatcagagacccgaccggaccggtaccgatgtggaggctggcggagagtgagcccttgatgtagcgcgggatgcgtttaaccaaggcgaggtgaggctcgtgggggttatgcatgaagagacacacctgttgaacggcataggcgatctcaggacgggtgagggtgagatactggagcgcaccggcgaggctcctgtactcataaggatcggcgacaggagcaccctccgaggcggtgagcttggcgcgagcatcaaccgaggtggcattcagacatgccggctcgctacagaaggtcgacggcgtactatcgctgggacaggaagaggccgttgggtgtgcggcggatagagatgccgaggaagaaatggaggtcaccaagatccgtcatggcgaactcattgtgcagccgagccgtgatgtggcgaagaagatcagcagaggaggccgtgaggatgatgtcgtcgacgtagagcaacaggtaggcgaggcgatcaccgtcccggaagatgaagagcgatgtgtcgaaggccgatggcatgaaacccagctgacgaatatatctagcgaaccgttggtaccaagctcgaggcgcttgcttgaggccgtagagggagcgctggaggaggcacacagcgtctgaagcaggggggtcgatgaagccggatggctactggcaatacaccgtctcatcgagggtgccgtggagaaaggcgttcttcacatcaagttgattaatcggccaggagcgggaggtggtgatgctgaggacgacacgaatggtagagggcttgacgacggggctgaaggtctcgttgtagtcgatgtcgtgttgctgggagtagccacgaacaacccatcttgccttgtgacgggcgagcgagccatcggagtggaacttgtgcttgaagatccacttgccggtaacgacgtttgcgccaggtgggcgagggacgaggcgccacgtgccgttatcgatcaaagccttgaactcttcggccatggcagcacgccagttggggtcggcgagggcagagcggtagttggccgacagtggagaaatggcgttgtgggacaccgagagcacgagtcgatccactggcttgagagaaccggtcttggagcgcgtaaccatggtgtggacttgtgaagaaggtgcgggtgcagccggagccacgacttggggcggaggagtcagcgccagtcgtcgttggtagtggtacgggaatggctccaacgtgccggctggtcgtgaaaaagatgtggcggccggacagctggtgacgacggcgccctccttgaggaagatggagacgcggcagccggctgcatggaacttggcatcgtcccgcccgcagtgtggtgcgctacatgtagtagggcaggtgctcgtcctcagccgagggagcacccgtgggcagccgctgctcgacgttcacagggaatggagcgtgcggctgctcaacaccagccagtggtggagcgaccacagaaggagcagtagcaccctgcagtagaaagtccaaagaggaagcatcgacaagatctcccgaaaatggaaactgtctcatcaaaaatgacatggcgcaaaataatgatgcggcgggtggatatgttgaggcatcgataacctttgtgcgaggaggggtaaccaagaaagacgcaaacggcggagcgaggtgcaagtttgtgggcagcagtggcactaaggttaggatagcataaacacccaaacacatgtaacatggaataatcgggaatcttgcgatgaagaagctggaatgggatggagttgtttactgaggacgatggtcgacggttcaggaggtatgtggcggtggctagaccttcggcccaataggagggtggcatgaaggcttgtaggagagggtgcagacagagttgttgagggtgcgaatcatgctttcggccttgccgttctgtggggaagtatatgggcagtagtcccgtaccagtgcncggccntgtcccatcagagntgcaatcaagggcg

SEQ ID NO: 88784 - DNA, 1698 bp, Oryza sativa
  unsure (1)..(1698): unsure at all n locations
ttttcgtagtctttacccggtccttggtgtttggtgtagaccggacttgctagatagacgccgtactatcaagaggggtctatcaagcgagcacgtgaatgatcttgtgccatattagttcatatgcatgtaggtacatttagtgggcttgtctagccaagtgtggtgagttttctcaagtcccaaacaaagagagaagtgggcacatcctataggtttgggtagcctcatatggttttgtccggtggagtatcttttggagtgtgagccctttctccctgagaaaagttgtgtttcttggatggattgttcatgggttggagtagaccggatttgctagataggcgccgtactatcaagaggggtctatgaagcgagcacgtggatgatcttgtgccatattagttcatatgcatgtaggtgcatttagtgggcttgtctagccaagtgtggtgagttttctcaagtcccaaacaaagagagaagtgggcacatcctataggtttgggtagcctcatatggttttgtccggtggagtatcttttggagtgtgagccctttctccctgagaaaagttgtgtttcttggatggattgttcatgggttggatagccctttgaataagctttccatagagtacaagaacgtcaaattacgatatccgagtcaagagatatcgccgttttactaacggctggttggctgaaaagtgaaatgcggtctgaccgtgggccttaggtcggtctgaccggggctgttagccggtctgaccagcgtggtaaggccggtctgaccggccccactggtctgttgcactggtctggttttcggtggcgatacaaagccgccagagccgcaaccggtcagaccgagccgacgacggtctgaccgagcggtggacggtctgaccggccactacactgcgatcagaccggccaggttgagtgggctcaatgattgccctgtaacagctagttttctagccattacaaagtagtccagtctgaccggccactctatggcggtctgaccgtgttaacaaccaaatttgataatctgagtatcgaagaagaagattagatcgatgcggaattgtagacaaagatcgtttcggaaacagagcaagattcggctgaaatccaaatcggctacgatcaaagacagccgagttcgagttggacaaggtagccgattaagccgaatctgacaatatgactcggtgtatgtcatcgggttgagttaatgcgcttcacacggattgccacactcggattaagtcctgaagaaggcaattgtatctattaattaggaatagtctgttagtttcctttttatctttaggaaagtatgtttagtgtccgattatgactttatgttttccttttatctttagaaaagtttctttcttgtcctacaaggactagtatccacccatgggtataaatatgtacacccggggtcattgtaaactatccccacagatcaatacaattcggcgtttcgccaccttttaccttttctactttatttatcatccggcggaaattggcacatgacgcggggctgcatcggttcagttcgatctccggcgaaggggtaagtccaatgttccgttggatcaggcaattgtatcatcttcgtcagcgtcgttcaaggctgcatcagtacattggtctacagangagatctaatggggct

SEQ ID NO: 88785 - DNA, 963 bp, Oryza sativa
aaaatttaactcgtagattcactcatgagttaaaattttactgggagttaaattttaactcatggtgacgtggacgaatctcggacgtccatttctcgatccaacggtagtttccaagtttccactacatatgtggtttgcactacatattttcccctgctaatcatcacatccaacaaatatcatctataggttcttacaagcaatcaagattgcattgaaatctacactcactactgaacatgggacagaaaaaacgttctacttctaaacaagtcaggactcaagattacctctctatatactctgatgcaccatgcttgaagtgagtaccacctccaggaaaccaccaaagcttacccttctcgtgcacccagttctgtcctccttttacctcagcaaggcgtgaatggttgacgttactacgccaaacatagtcccgacttgttggccatcttataggtatcttgtagtcatttggtgggggcaccaaacagaacaagcgtttctcttgtggtgggcaaatactttcaagatcctcatgcctagatctatccagtttctttaattggcttatataggatgcgtcgtgacagggaatatactcgttgtatttcaaaggacaaacatcaactccataatctggaactgagattggttttgttcgataagaaagagagactctgtttgtaaactttggagcacctgcatatgaaaatcaaacagatttaataatttagcatggaaataatatacaacaatacaaattaaacagtgggcttgggtctaggttatgtccactaaaatgtatactgtaccatcaatacaaactgcagcacagagaaaaagagatcagagaaattcatatctaagacatacagaaatgtgtcaagatctaaaaaatataatgtcacgaattatgaactgaataggagtggcctgcactcttttgattttctatac

SEQ ID NO: 88786 - DNA, 1301 bp, Oryza sativa
tatgctgctgctggttgtgtgacctttgctgcgattagaggaagggaaacagatgagattaaaagatgccttgatattatatgtggatagtatttctacatgggtgtgctgaaaagaggatctttggagcagagaattgaatacaacgaaatgttgttgcagaaagtatacatcccgtaatttctgcgtatattttcgatatatatatagcgcggaataatgaataatgatatgcgtgaagtatctatgtaattcattaattacatagtgtgctcgttttgatttgtatccatttttcagctcatttattttgacccatataaaaatgtatagataatctgattcctcaattgatgagttaatctttccttggctccagatgtgtgtagcgagttagggacgcacattgttttagatgatggaaatagtttacgtctccggtatctgtcgacatgcaccgttgcgcacacacacagtcaataagttttacagttgagaaagaaaaagacaatatcaagtaatgggacaatgccccaagtgctctaattaaaaagataaccattatatttaaattaaaatttaagacaaatcatacaaatttcagcaagtaattttataggtactataccattcaaagcgggaaaaaactttttactaccaattttaagagagtatagcaccactgcacatagatcccgttcctcctgtgatagcgtcaaagtgcaattgcgaagctatttagtagacatgaagatattatgaatttgaaccttgattttgataaaaaaaaactagcgattctgactagttaatgtttattcttagggtgtgttcttatccataaaaaatattatggatcgatgcaacagtacacttcccaagctggttttaacgattctacatgaatttcttaaaagaaaactatatcaaatctatttgttaactttgtaatagttaatttattcgtttgcaccatcgactcacagaatcatttaagtactattcagctattcgagaaattaaaacaagcctcgagggattaatttcaccatccttgataggtactaggaggtaccaattcttttttttttaaaaaaaatattgacaccttttagtacttatagtgtagaatttataaattctacacactagaaataaaatatagttactctcggtatcctctcaaaacaaatgtaaaatttctccattaatttgtaggatcgaatcacaagaactaagccaaccagatggggggggggggtgaatggttggtatacccaaaaaccgaaaacttttagcgg

SEQ ID NO: 88787 - DNA, 1911 bp, Oryza sativa
gccctaacgagacgagagcaacgccaagcccgggagaccgaagcacgtcgcgaggctgagcgtctccgactggaggaggagcgtcaagcacaagaacaagaacggttacggcgtgagcagcaggagcgtgagcggaccgcgaaggaggctgaagatcgacgacagcgagctttggaagcagggcgccgagcgcgtgatctcatcggccaacaagatgttgaagggacaccggttttccgcacccctcagcagaatgcggttgccgcgatcaccctcctcgacaccctcctcaaggaaaacgagctcaatcaatctgatcacgtcgtcaacatcttgaaccagacgaagaccatgattgcggcttcggtcccagttaactccgaaagcgtccacacgccgactggcagccgagttccccacttccgatctcatgactaccgtcatccaagcctcagcatcaccggcgcaggatccaatcgtaggagcaggggtcacgacgggcggtccgttcactcacctcccgaccatcatggggagcgccgagtggaacggcctcgctcaccacctcgtcgccgccccgtcgatcttcgcgacacgatcatacagcgccgagcaactcgaggccatcatcattcgccggaccgccacgacgacgaccttgacggagtagcagccttcaccgacgatctgcgtcgagtggattggccagccggcttcaagccgactggaatagagaagtacgacggtaccactaacccagaatcgtggcttaccgtctacggtctcgcaatccgcgcagcaggaggagacagcaaggccatggcgaactatctaccagtggctttagcagattccgcccgatcttggctccatggattgccccgtggtacaatcggatcttgggccgaattacgcgaccacttcatcgccaacttccaaggcaccttcgagcgtcccagcacacaatacgacctctacaacgttattcagaagtccggagaatcccttagagattacatccggcgattttctgaacaacgtaataagatctccgacatcaccgacgacgttatcatcgccgctttcaccaaagggattcgccacgaagaattggtcggcaagttcgggcgtaaacctcccaggacagtcaagcttatgtttgaaaaagccaacgagtacgccaaagctgaagacgccgtcaccgcatcaaagcagtcgggtcctagttggaagccaaataagggtacgccggctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgcccgcaccatcctaactccaaccacgtggccaaagattgtttcgtctacaagcaattcgcggatcaatacaccaagactacacggaagaactccgacgaagaacaaagcacgtcgatgaagaaggacgacggcgacaccccggcaggatttcaagaccaccgcaaggagctcaaccatatcttcggcggccccttggcttatgagtctaaacggaagcaaaagttgactgaacgggagatcaatgctgttcaacccgacacgccccagtatcttcgatggtcagaaattgcaatcaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccttggatgacatgcagatccctcgctccgagctaaaaccaagcaatgcgcctttccacggagtaattccaggattatccgcaactcca

SEQ ID NO: 88788 - DNA, 1722 bp, Oryza sativa
tgtgttgattatactgacctcaacaaatcctgccctaaagtccttttgggttgcctcgcattgaccaggtagtcgactcgaccgccggctgtgagcttctcagttttttggattgctactcggggtatcatcagatccgactaaaggaatccgactgcttgaagacttcatttatcacgccctttggagcatactgctatgtcaccatgccgttcggactaaaaaacgcaggagcaacttatcaacgtatgattcagagatgcttctcaacacagatcggtcgcaacgttgaggcctatgtggatgatgtagtcgttaagaccaagcaaaaggatgatttgattttggatctagaagaaaccttcgcgagcatccgcgctttcaggatgaaattaaaccctgaaaagtgcaccttcggagtaccgtcagggaagctgcttggttttatggtgtctcataggggcatccaagccaacccggagaaagttactgctatccttaacatgaaaccgccaagtacccagaaagatgttcagaagctgactggatgcatggcggcgctcagccgatttgtttcaaggctcggcgagcgggggatgcccttctttaagctactaaagaaaacagacgacttccagtggggacccgaagcacagaaggccttagaagatttcaagaaactcctcaccgagccaccagtcctagcctcaccacacccgcaggagccgttgttgatgtatgtatcagccacctcccaggttgtgagcacagtcttggtcgtcgagcgcgaggaagaaggccatgtccagaaagtccagcgaccgatttactttgtcagcgaggtcctagccgactccaaaacgaggtaccctcaggttcagaagctgttatatggtattctaattactaccaggaagctatctcactactttcaaggtcactcggtaacggtggtcacatcatttccactcgatgatatactgcacaaccgtgaagcaaacggacggattgctaagtgggctttggagttgatgtctttggacatatcattcaagccccgaatttcgatcaagtcccaagcgttagctgattttgtcgccgaatggaccgagtgccaggaggatacccccgcggagaagatggagcactggaccatgcattttgacgggtcaaaacgactttcgggcactggagcaggagtagttctaatttccccaactggagaaagattaagctatgtgctttggatacatttttcggcgtcccacaacgtcgccgagtatgaggcgctccttcatggactacggattgcaatctccctagggataaagcgtctaatagttcgaggcgattcacagctggtcgtcaaccaggttatgaaagagtggtcctgccttgacgacaacatgatggcatatcgacaagagatacgcaaattggaagataagttcgatggactcgagctcagtcacgttcttcgacacaacaatgaagctgccgatagactcgccaactttggatccaagcgtgaggcggcacccttcgatgttttcgtcgaacacctttatacgccgacagtacctcacaaagatgctactcaagttgcgggcactcatgacgtagctatggttgaagccgactggcgagagcccctcatacgatttttgatttctcaagaactcccccaagacaaagatgaagccgagcggatttcaaggcgga

SEQ ID NO: 88789 - DNA, 1357 bp, Oryza sativa
gtagtcggcggttacaccgcacctctttgtggccattgacaaattctccaagtgggttgaagctacaccggttgtcacaatcacagcggataacgctcgagatttcttcatcaacattgtgcatagatttggagtgcccaatcggatcatcactgataatggcagacaattcactggcggagtttttaaagacttttgtgaagactttggaattaagatttgctatgcctcagtggcgcatcccatgagcaatggacaggtggagcgagccaatggcatgatacttcaagggattaaagcgcgtgtttttgaccggctaaaaccctattccggcaaatgggtgcaacagctaccatcagtactttggtctttgcgaactacacccagtcgggccacaggctatggggcagaagcaatgttgccgagtgaagttgaattcgagtctttgcgctttcgaaatttccgtgaagaacgctacgaagaggaccgagtggatgacttgcaccgattggaagaagtccgcgaagcagctttgattcggtcggctcgatacttacaagggttgcggcgttatcataatcgcaatgttcgatcccgtgcctttctagtcggcgacctggttttgaggaaaattcaaactacacgggatcggcacaagttatctcctctatgggaggggccgtttatcatctctgaagtcacccggccaggttcctatcgactcaagcgcgaagacggtactctcgtcgacaactcttggaacattgaacatcttcgtcgtttctatgcttaagcttatcattgtacttccttatcttaactgtcaacatcaagttttcttcttgaagttgtcagtcgggggctatcatcataataatggagtgtgattttttaccaattcaatttgcttacttggtttatcattgccttgttcgatttttctacttagtctgcgaggactgaaagtttttaatagcttctttgggttttaggctcaacaaagcttgataaaagctttaagaaatcaaagatttcgctagaactatcaagcacagcatatatacaccagtattgtacaaattgagcctccatttgttacattcatactcaatcagaatcagtcctttcatcatcagagttattgttgctcggctgaaggtcgttgttgcggaattgctctacaacgtcacttgcaatcttgtcagccgcgttttgagcattgctgataagatcaagagcagcctcttcgcttgtcccgtctgcaaagccatcaatggcatcaatttcaattctcgggtacaaggacttggtcatcgccaatgccatctagctcccatacttccagctttcttgatgt

SEQ ID NO: 88790 - DNA, 2679 bp, Oryza sativa
cacctctcctcctctcccgttcctcccctccacctctcctctcctctccccccttcctcccctcatctctcctcctctccccggcggtggctcccctcgctccctccctgccagatctgcccggagtggggagggggaggctggtggccagcggcgtggggtggacgccggcggggcgcagcagggcgaacagtggcggctcccctccctccatccctccaagatctggccggaggggggaggggggaggccagtggccggtgtcgcggggcgaacggtggcggctcctctcctccctccctcccagatctggctagaggggggaggagggaggggggaggccagtggcgcgtccgtgcgacggcagcggcggatgcagagggcagtcatggcgaggagggtggaggtagggtcttctcccctccctcctcccagatccggcgatgcggagggcggtcgctgtggcggctaccagcgaggatggtggaggcggcggcgtacgtctcccctccctcctcccagatccgatggcgtgaagggcggtggcgtttgttttgattttgaatgttaattggcgatgcgtttgttttgattgtgaactatgatacttctatgttaatttgtgatgcttttgtgaatttgatatggattgatggagcatggaaactggattggattggggaataggaactggatggagcacagataacgggaagctgctgctgctgctgtgggtggtggctgccaatttttttaatgctcagagctcttttctcaagcggaccagttggaactatgatgcttatatgttagtttgtgatgcttttgtgaatttgatatggattgatggagaatggaaatgggattggattggggaataggaactggatggagaaccgagaacggtaagctgctgctgccgtgggcggttgctgccaattttttttaatgctcggagctcttttcgcacgtggaccagttgtccgcctgtgaaaatcaactatttttttcgtagatgctcatttgcaggcggacagctggtccacctgcaaaaaacacttatttagtccgcctgtgaataccttttttctagtagtgtaatgagtaaaatgtatggagcttcccttaacttgtttagacgtgttaggtaagtcactctactttcaacatatacatcaagatcactactactaaacggtgtgtttttttcaacaaatatctataggaaagttactttaaaaaattatattaatcataaaatacaccgtttagtacttttgaaaagcgtgcaagcggaaaatgagggttgggagttgggaaccctggggaacgaacagagctaccagaatcgcgaattcgattggctaaatccatcagcatgtgtgtatacgttcagttttacccaacagtattgtcagtttgtcacgtctggactcacgagttgatcatggacaccatgaggaagcgagtacaagctttcacagaaggcgtcgtgctaatggtgtgcccggttcttctcgccgtctcgctcaagaaagccgacctgaagagcaacgggaacggatcgcttgtcggaggcggcatctcccctctcgccgccatcactctcgaagccggcttgctggccgtcctcttcctcggcatcaacgatagcctaccggcgtcccacggcctcctgctccgcgcctccaagctcctcgtccacctctgcgcccttctcctgatggcgctggccttcgtcatcctcctcctcatcgacatggacaggcacatgtactgcctcgccggcctggttcttgcgccgctggtgcctctcactctgttccgctgctaccgaggcgcgcgtgacggcggagacgaccacgcggcaggaggaggcgacgccgcggccacgctcgaggactccgtgaatttctcggccgctgtcacgacgcttctgttcctggggctggaagggctggcgttagaggggcagagcagcgccgcgtgccgcgggatggagcgcctgttcaccgcctccctcggcgtcacgtacctcacctgcgtgctcggcgtgttcgtcatgctggtggggacggtgcctgatccggcgatggcgagcaccgacgaccaaggcgacagatcagccaaggtgtgctacttcgccgagttactgaacgccacgttgtccgtcgccttcgccgtggtcgtcgtcctcatcacggccgcgccgctgagggagcaggcgtggctggtgttcgtcccgctaatcctgtcgttcgtgacatggatgtacagagctatagtcggcgacggcgtcggagagattaagccggcggcgtcgctggagctgaccaaggtcacgttcacagggttcctggccgtcgcggtgccgaccttcagtaacacgccggttggcatctcgacgcgcggcttcgttgcgctcagtgccgcggccgtaatgtcggaccttggatggaggctactgatgacgggccggatggaccgtaatgaccagaggagggcgtcgccggccatggtgtctgtcgccaacgttgcttctctatgtgctcatctttgcgtcgctgctgctgtgctcccattcgcaacgctggctgtcaacgccgtcagctcaagtgagccaggtagcggttgccactaattatgcacgcacgggtatgcggcagcggcactgctgaa

SEQ ID NO: 88791 - DNA, 1224 bp, Oryza sativa
tcctgcagcctttttcctttttctttttttcttctcttttttccccttcctctgtgacccgtgcagaggaaagggaaaaaagaagaatgagaagaaaacgaaaaagaaaaagaaaaaaagaaaaaaagagaaaaggacatgtcacgtccatgtggcattgccacatcagcgccacgtaggattctagagtggatgtgtcaatttgagacctagatgatacactttgacaagttatagaacatggatatgcattctgagagtttagggatctatatgacacaactctacaagtttaaggaccgccgatgcactttactcaaaaaatttcacagaggtcacgcgtaagatctcgatactagccaactaaatcatagttgaatgcaagttttatataagttattttacaattataatgtggttataatttagttacagtatagttacaatgtggttatactttaattatagtcaattacactatacttacatccaaaacttttttttcactcaaaaaacatgatgaagttttttttagatactcccttttgtcacaccctaaaaatcctaaatatataaattgttgtttaattggaattattagaatttattttaaaagcctagaagagaagatctaattttaattaataaattccaatataaaatggggccagataaaatttcattaaatactttgcttaactctataattcctagatttttctgggatttatttgagctaaggaagtatttttaataaatggaattgcatttcatgaataatttaaattgaaaaggtttttaaaatcctcttttggctttgggccgaaagtcggcccaaaaccttctctctctcctggcccaatccggcccgcagccgagccgcctgctcgcgcgcgcgcatccgcccgctgacaggtggggcccacctgtcagggccgtcgtcttccttcggccggccgccgcccgaaccctagcgccgcgccgccgtcgtctccttccaaatcctaccgcccctttccgtttccggtgaaatcaatagaggggaaatgatccccgggatcccctctaccttttctcttttggaatcgtcggctaaaatcgtttgaaatccgtggattcgagttcgattcggatcgatctctctcctccgaaccctaatctttccttctcgtcgccggtcgccgtgggccttcgccgccgccttccaacccctatacaaggacc

SEQ ID NO: 88792 - DNA, 1092 bp, Oryza sativa
  unsure (1)..(1092): unsure at all n locations
accgcgtgaanttgannattgattnccnnctggcaganggcttctatgcgtattttattcagcacaagcagcgaaattcccttatctggctgcctactgatggtgacgccgaaaactttatgaagtcgcatgttgagccgacgattcgcgatattccgtcacttctggcgctggccccctggtatggaaaaaagcaccgggacaatacgctcagtatgaaacgcttctccaacggtcgcgggttctggtgtctgggtggtaaagcggcgaaaaactatcgtgagaaatcggtcgatgtcgccggttacgatgaactggcggcattcgatgaagatattgagaaagagggatccccgacgttcctgggtgataaacgtattgaggggtctgtctggcccaaatctattcgcggctcaacgccaaaaacaaaggggacctgccagattgagcgtgctgccagcgagtccgggcatttcatgcgttttcatgttgcctgtccgcactgtggtgaagagcagtaccttaaattcggcgacaaagagaccccgttcgggctgaaatggacaccgggcgaaccctccagcgtcttttacctgtgtgaacataatgcctgcgtcattaagcagcaggagctggatttcactgaagctcgttacatctgcgacaccaccgggatcttgacgcgcgacggtttatcctggttttcatcaacaggcaccgaaatcgacccgncagacagcgtgacgtttcacatctggacggcatacagcccgtttaccaccttggttcagatcgtttaagacttgctaaaaacgaaaagggatacanggaagcgtaaaaccctcgtgaacaccactctggccgaaacatggnagccctaaaatggtgaaccggcctgacccgnactcatggcccaaccccaaagagtctttgggggcatccgtacccggacgtgtggttatttggaaaccggatcgactcccaactggatcaaattgaaatgcgctcttgggatgggggcccgtgaagaaacttgcttatttaccgccaaacatatttggccgccatgatgatgacccgacctctctaagg

SEQ ID NO: 88793 - DNA, 607 bp, Oryza sativa
  unsure (1)..(607): unsure at all n locations
ctgggcaataagggccctttacgtttccccaattgttccggcaaaagtgatccgctcccgtgccggcagcacgtctgaattcacgccgggttatgtgaagccgaaacacgaagttaacccactgatgactctccgccgcctgccggatgaggatccgcagaatctcgctgacccggtctatcgccgtcgccgcattatccttcagaacatgaaggatgaagagctggcgattgctcaggtcgaagagaaacaggctgtttcggcggtgctcagcggtaaatacaccatgaccggggaagcgttcgagcctgttgaagtcgatatgggccgcagcgctggtaacaacattgtccaggccggtgcggctgcatggtcaacccgcgacaaagaaacgtatgacccgaccgatgacattgaagcctacgcgctcaacgccagcggtgtggtcaacatcattgtgttcgatccgaaaggtccgccctgcggcgttcttnaaggctaaagaangaagatggttgggggtcggggtttttacccctgacgctggcnccctcccttaaannnccgggtggncgtagattgtaggcctaccgttnnnncacttccg

SEQ ID NO: 88794 - DNA, 2315 bp, Oryza sativa
  unsure (1)..(2315): unsure at all n locations
aacaggccagggaccctgacttctccccgtgggcagcgttgaaagagttccctcccggaacggggcacggcgcgcgcgcgcaggtcggggacgccgccgaccacatcgtccacagcttcgagggtacggcccctcagctcgcgttcgcgctcgactccgacgaggagggcggtgacgacggtgcggacgacagcgacgacgaggccggcgacccgggcgcgtcggagtgagcccccaggcccccgccaatcttaataacttttccttcttcttccgaggcctttgagcccccttcttgtatagactgatttaatctgtaatcaagtaacgaggaaatttctgcatcagttctgtttgttgtgtgtatgagacaaggatggtctgtgccgcggtccttctgtgtcttggcttgaacaagggctcgtgcccaggtcccagcctcaaacggcgcgggtcggggctagtgcctggggagatccacgtgtcgagactggccaggccgggagtgcggtgaccgagggttatggatgacccgattgtgggcctttgccgattcccccccggagttcaccacgccccggggcacggctcggttctgggccccgtttggcgattttagccggcccgtgccaccaagggtagggtcgagcacgagcgtgctaattcaagccaagattcttcaaaaggaaacaatggcacagacacagtcctcaggaaatcgaaaatgcttttatagaaatacggaagagaaaaaaggtaagtatatgcatgtggtagcccccggccaaccctgcacgcccggggggggtgcggggttggcccgagcccgagacatgacacccgacccccactaggggtagaagcgacgaaggtgttcgatgttccgcgggttaggcagctctgtgccgtcgcctgtggctagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctgggagcgcgcggctcggagggccgcgcgctgccttcgctcttccaaatagtcaaggtcgtctcggcgaagctgatcttgatcagcctcgcaatacatggtgacccgaggggacctcagggtaagctcagatgggaggaccgcctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccgcgttggcgcgctccacttggccattgcttctggggtgggcgggggaggcgaagcagagcttgatgcctatctcttcgcagtagtcaccgaagagctcactagtgaactgggtgccgttatccgtaatgatacggttagacaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatatcgagcccccaaacaggaaacggccacgaaagaggtatggtctgcagggcctgggccggctgatgggtttgcctagcgtggaactggcacgccctgcaccgccggaccaggtcgaccgcatcgttgagagccgtcggccaatagaaaccctggcgaaaggccttgccaaccaaggtgcgtgaggcggagtgggctccgcactcgccttcatggacatcggcgagaagctcgacgccttgttcccgaggaatgcacttcaggaggactccgttagccgcgcgccgatagagggtcccttccaccagcacgtagcgcttggagatgcgccgaacgtgttcactcccttcgcggtcctcgggtagagtcttatctgcaaggtacgcctggatctcagtgatccaagcaatcaatctaggggagctgggagcgctcccctcgggtcccgaggcttggactccgacgggcctcgggggccgttcaggcgcatccgtctcccctagggggtcgggtcgcaccgatggctgggcaatcctttcttcaaaggcgcccggtggggtctgggctcgcgagnnnnnnnnnnnnnnnnnnnnnnnnnnnnnnnnnnnnngagagctgcccacgttncactct

SEQ ID NO: 88795 - DNA, 732 bp, Oryza sativa
  unsure (1)..(732): unsure at all n locations
agtgtggnnnagtggatcatnnnnnnnnnnnnnnnnnnnnnnnnnnnnnnnnnnnnnnnnnnnnnnnnnnnnnnnnnnnnnntggcgcccccaatcgtcgggaacggacgcgtctttcccggccgccttccatggccgccggccgggtttcccgtcgccgttccgccctctcccatgcccggcttgcttccctccgctataaaatggaaccccctctttgcgttctctcgttttagccccttcccgagctcccccgtggccacaccacctttccccgccttttccttctctctctccggggccggccgggctccagccggcttttccttctcgtccgagcgcccttcggctgtgccgtcgcctcctccagcgtcgcaacccgcttcttttcaccgggcttgccttccgttcgcgcggggacatatgacatgcacaacgctgatggagtagaaaaggatgagcatacacacaaaataaagggtgcaatatttcaatagctctagaattagcagatgcttatctagggggacagcaaatattttatcagcaagataaattcattaattactttcctaattctttcagctatggtttcttctgtatgtgaaacatttattaacctaaagccctaaactcttttttgtaattggccatcttcatcaccaaatgaacaactacgcttaggaaattctctctagctctactacttcatatatcttgagtaacacaaac

SEQ ID NO: 88796 - DNA, 1158 bp, Oryza sativa
  unsure (1)..(1158): unsure at all n locations
gctgtccagggtaatactctgtctnnnnnnnnnnnnnnnnnnnnnnnnnnnnnnnnnnnnnnnnnnnnnnnnnnnnnttggctgccgcgaacagcacggtgctggacgggttaagtgcccatatggaggccctgcaggcggagcgggcggagctcgacgcggtgtgggctcgcgtttaggaggggtggcgctcggtggaggccatggtggaggcgggccgcaaggcgcaccgccggcacgcctcacagctcgaggcccatcgtagggacctggcgaagatcgccagggaggtggaggaggagcgggagactgccctcatcgccaccgccgtgctcgacgaggcgcgggacgacctccgcctacaatacgggagccgggcgcggagctagaggagaagctcgacgccgcccggggagtccttgacgccgccgctgcccgggaacggcgggcggaggagaacgaggcggcgtcccggcagcgcgaagaggccctcgaggctcgcgccacggcactggaagagcgcgcccgcgccctggacgcgaaggagagagacctgcggaccgcgaggccgccgtcgccacccgggaggcaacactggcggcgcacgaggccgcctgcgccgaagaggagtccgcactccgcctccgcgaggacgcgctcaccgagtgggggcgagctctcgaggaggccaaggccgcggcgcaacggctggcggacagcctgttcctccgcgaggcagcgcgggaagagcaggcgcgccgcaatctgaaaggcgcccgcgccgagagggccgcactggatcagcgggccgctaagctcaaggcgcgggcgaaggagctgaacgcgagagcgcacagcggcggagcggccgcgggcctcggcgacctagccgcccgcctcgcagccgccgaacacaccatcgccgagctgcagggcgcgctggactcgtccgccggggaggtcgaggccctccgcatggcgagcgaggtannggcccgcatgcttcgggacgccgtcttccgtctagaccgcgccgggcggcaggcgggccttctgggcgggcggtacgcgaagtacgccgnncaacagggggggcctcgcccagggctttcagagatggccgggccctcgagcggctccccgaggagctcgaagaga

SEQ ID NO: 88797 - DNA, 743 bp, Oryza sativa
  unsure (1)..(743): unsure at all n locations
cgcgccatgaanacctgatnnnnnnnnnnnnnnnnnnnnnnnnnnnnnnnnnnnnnnnnnnnnnnnnnnnnnnnnntgtgccctacccttgccgcactcgctcgctctcaagctcctcctccgccggcgtcatggcacggggctgcgcaccgctcgatggtagcgtgctgccgccttcccgcatcgtgagcgagaggcaggccgggctgccgcacctattcatgccggaatctgccaccggcccggaggtggtgacgctgggcgaggggcgcccagcgccacactacccggggcggtccgtcttcttcctctttttcgcaatggcggggctggtcccgccattctctatttttttcatggatattctcgagttttatgatctacagatggcgcacctcacccccaacgcgataatgacgttggccatcttcgcgcacctgtgcgagatgtttatcggggtgcgcccatctctccggctgtcccggtggttcttcaccgtacagccggtgtcgccgccgacggtagtcggtggctgctacttccagccgcgggggcaggtgctgaaccgctacattccctgcgtcctccgcaaaaagtggaacaattgaaaaacgatgggttttaccttcctttgccgacaaagcgcgcttcaacttccggagcagcccacaggaaggcctccatttggcgccgcgggtaaatctgagaacggttacaacgccttttttgaccgtcgggcggtt

SEQ ID NO: 88798 - DNA, 718 bp, Oryza sativa
  unsure (1)..(718): unsure at all n locations
aaaaaaaagtgactgcntctcttgtatacccatattgaatatacacttgagtttggaatttgttattctacttcatcttctatatgcttaagtggatattctgatgctgattttggaggttgtagaattgataggaaaagtactagtggaacatgttattttcttggtacatcattgattgcatggtcttctaggaaacaatctagtgttgctcagtcaactgctaaatctgaatatgttgctgctgctagttgttgttcacagattctttggcttttatctactttgaaagattatggtcttacttttgagaaagtacctcttttttgtgataatactagtgctatcaatattgctaagaatcctgttcaacactcacgcacaaagcacattgatatttgtttttactttttgagggatcatgttgagaagggagatgttgaattgcagtttttggacacaaagttgcaaattgctgatattttcactaaacctttggattctaatcgctttgcttttctttgtggtgaattgggtataattcatccttttggcatggtttgagggggagtttgtacctcatggntttatcgagcaataatatgacaatgagaaaaattgagaaaagagagncttgttatacatatgagattttcttgacatgctagcaatctttgaaagttatttgtctaagctagcttgatgtatctaatctttg

SEQ ID NO: 88799 - DNA, 1213 bp, Oryza sativa
tcttaagcatggtgataatcaactttttgctcagatttatgtggatgatatcatctttagttgttcgactcacgctttttttgtagattttgctgagattatgcgcagggagtttgagatgagcatgatgggtgagttatcgtactttttgggattgcaaattaagcaaacacctcaaggtacttttgtacatcaaacgaagtatacgaaggatcttttgagacggttaaagatgaagaattgcaagccaatttcaacaccaattggttctacagctatgttggatcctgatgaagatggtgaagctgttgatcaaaaggaatatagaagtatgattggatttttgttgaagctaactggctttaggccagacatacaatttgctgtgagttgggtgcacgctttcaagcttctcctcgtgcttcacattgtcaagcggtcaagcgaataatgaggtatttgaatcatacacttgagtttggaatttgttattctacttgatcttctatatgcttaagtggatattctgatgctgattttgcaggtggagaaatgaactggaaaagtactattggaacatgttattttcttggtacatcattgattgcatggatcgtgtttatgaaacaatctagtgttgctcaatcactgctcaatatgaatatgttctgctgctagttgatgttcacagattctttggcttttatctactttgaaagattatggtcttacttttgagaaagtacctcttttttgtgataatactagtgctatcaatattgctaagaatcctgttcaacactcacgcacaaagcacattgatatttgtttttactttttgagggatcatgttgagaagggagatgttgaattgcagtttttggacacaaagttgcaaattgctgatattttcactaaacctttggattctaatcgctttgcttttctttgtggtgaattgggtataattcatccttttggcatggtttgagggggagtttgtacctcatggttttatcgagcaataatatgacaatgagaaaaattgagaaaagagagctttgtttatacatatggtattttcttgtacatgctagcaatactttgaagttatttgtctcaacatagcttgatgtattctagtcttttcatgagatttagattttacttttaagggagatgatgcatgacacttaaattctatacttgaatt

SEQ ID NO: 88800 - DNA, 944 bp, Oryza sativa
ctttgaatatgaaaatgtgtttggtatggtatggacattttaacagtattgactcttacaatccattaaaatatttagtattcaaagtgtttgtgtgttaattcctatcaataatgacttatacagttttcagtgtataaatgtttgacttattttgttaaatctattaggaagtattttattatttttgatgctattgtaaatagtatggttttttaaatttattttttggatagttctttgttagtgtgtagaaaaataattgatttttgcatgttgattttgtatcagatactttagggaatttatttgttagttttaacagtctttttagagtcgttaggattttttgtatataagatatatgtcatgtgaaaacagatcaagtttcataacttcctttgtaattagaagcgcactttctccatgatctccaccttcctcccctcttccacctccttcccatcgccgctcgccccaaaccctagcgccaacccaccgtcatcaccaccaccaccaccgccctcgaagagcgcgacgagggcgtcgagccggtcgggcgagacgccgaaggggcggtcgggcgggagcgacgccccgaaggcggcggaggcgacgaggcagcgctcggagcagaacttgcgggcctcctcgaggtcgtacacgcggtgctcccggagcgagatgcggaaccgcggcgccgccttgccgcgggcgtcctccgaggggagcgggttggggcacgccgggtacccgcaggcgtcggcgatggagcgctccgtgacgacgtcggcgtagtccggccccgagagcagcgaggccgccgcgcggagcagcggctccctcgacgccgcggcgccgtcgtagagcgccatctggacgcggtgcaccgccgacgcgacggtcgtgatgaactactgtaccgtcggtcatcaatggccgcg

SEQ ID NO: 88801 - DNA, 702 bp, Oryza sativa
  unsure (1)..(702): unsure at all n locations
agcgttctncaaacanngtgaaaaaccannnnagaaggaggaaggaggtccccatggtgataatcaactttttgttcagatttatgtggatgatatcatctttagttgttcgactcacgctttggttgtggaggttgctgagattatgcgcagggagtttgagatgagcatgatgggtgagttatcgtactttttgggattgcaaattaagcaaacacctcaaggtacttttgtacatcaaacgaagtatacgaaggatcttttgagacggttaaagatgaagaattgcaagccaatttcaacaccaattggttctacagctatgttggatcctgatgaacatggtgaagctgttgatcaaaaggaatatagaagtatgattggatttttgttgtatctaactgcttctaggccagacatacaatttgctgtgtgtttgtgtgcacgctttcaagcttctcctcgtgcttcacatcgtcaagcggtcaagcgaataatgaggtatttgaatcatacacttgagtttggaatttggtattctacttcatcttctatatgcttaagtggatattctgatgctgattttggaggttgtagaattgatacgaaaagtactagtggaacatgttattttcttggtacatcattgattgcatggtcttctaagaaacaatctagtgttgctcagtcaactgcttaaat

SEQ ID NO: 88802 - DNA, 697 bp, Oryza sativa
  unsure (1)..(697): unsure at all n locations
gggcccgaggactacatgaggacccaccaggggcgcaaatgggactgggaccctgaggacttcaggatggtggtccaacgggtgctgaatctcagctccgtgnaggcatccctcatcccccaaggggtcctccccctctgctgcgatctagagcgcgccaagatcctggccatcatgcaggtagtcggggcgtcgggggagcgggccccccgaggccacgatggcgcgggcgggagccgcaggggggaacaatctaccccgggagggggtcgtgcttctgggccccgcgacaggggcccggggggcagcccccctgccgacgcccgggggaagaggaagcaggagggtacccctcccccttctcctccccaagggggcggggcggtgcgtgccagcagcaggcgcccggagggtgccgtgccgacgccgcagcccgagggggagcgaaagaagaaacggctccgcaagatggggggaccgagacatgccgggggaacctcatctcgcccccgaggtggtcgtttagccgacctccccgcaggttcgtccccgcgcccaccgcggccatattcactcttccatctcccaaggcgagttttcactcacccgtttccttttgtcttctggtttttcttctgnnnnnnnnnnnnnnnnnnnnnnnnnnnnnnnnnnnnnnncaggtgtctacgcagcggcg

SEQ ID NO: 88803 - DNA, 709 bp, Oryza sativa
  unsure (1)..(709): unsure at all n locations
ttaggccacgcaaagattactgaangtantacgtacagcgncttnnnnnnnnnnnnnnnnnnnnnnnnnnnnnnnnnnnncagggaccctgacttctccccgtgggcagcgctggaagagttccttcccggaaccggggacggcccccgcccccaggtccggacgcccgccaacccattgncacaagtttgaagggtccggcccttaagttggggttggggtcttaaagctggaattttttttggttttcgggttttgggatttctttacaaacaagatccaccaaaacacaggagtagggggtacgctttttaggggcccgaactgtctacggtgccggggtttgtgcactttttctctcgctgacgntcttaaatggaaggcgaggaacctcacttaacgcccccgggccgacccggaaaagggggcctgcgccggtctccggtgaggagccccacgctccgtcatctggcgcgccacagtagggtgcgcgtgtctttctaagccctcgtcctctttcgtgtgcgccaaagctctccccgctaagccaaatgccgaacgggcaggggcgcacagnctctctccgaacgctagcggtgacgacggggagcagaacccgcgccgtnggctctcaccccaccgtnccctctttgcgaaattttggcgggggaggcgctccgngaggtccgaggatccgcgacttcgtcgc

SEQ ID NO: 88804 - DNA, 711 bp, Oryza sativa
  unsure (1)..(711): unsure at all n locations
cgcgggtgaangcccaactgaatcgcctcgttgcgnnnnnnnnnnnnnnnnnnnnnnnnnnnnnnnnnatgccgctgacgatttgttaaacacccccgtttaagaggctatcatggcaattactgaagttttcacacataaccagccgctcggtaacagcgacccggcgcacactgcgtatggtcctggcgaactgacggcttccactccagccatgacgccgctcatgctggatgccacttctggcaagctgaccgtctgggatggtgctcatgctggcgcggcaatgggcatcctggctgtaaccgcagaccagaacagcgcggaactnnnnnnnnnnnnnnnnnnnnctttccgtattgaagatgtcctctggccatctgccgtcaccgacgacaacattaaacgtaacgcgttcgccggtactgcaatcagcatcgtttaatccgcatttctacaaccatcatcattcataaaagccgcttgcgcggctttttttacgggaaaaatctatgtccgtttacaccactgcccaactgctggcggtcaatgagaagaaattcaaattcgatccgcttttcctgcgtatctttttccgcgaaacctatcccttcagtacagagaagggttacctgtcgcaaattcctggcctggtcaatatggcgctttacgtctcgccgattgtctnccgcaaagtgatccgctcccgtg

SEQ ID NO: 88805 - DNA, 2988 bp, Oryza sativa
gctccttgtcgtggatggaagtcctcgtcggtggctccaccatctcgaacaccttgaacgccgacgtcctcgtcggcaagagaagaggatcggtgacgagcctgacgaccatgaggagattcccgccggactccacgaggtagcgaacagcgacggctccgccgtaatctcgcccgccacgcgagaagcgatgaacctccacgggcggtatctcaagattgccgttgacgtcttcgtggaagcccgctacaggaaaaacatggaggttttcttctcttgtgaggaatttgaaggctttgttgtggtgtatgacatcctccagaactgacgtggtgacgaactcagcaggatcatgagtcgcctcctccgcaactcgatgcctcaggatcccgaatgcatggattcgtggattgtccatcatgcaggaatggctgatggcggcggcgacgcagcgttcgtcgcccggaggcgaagagagggtcgcggccaccatgcccatgctcatgtcggggacgtggaatcgcgtgccgttgcggaggctgagtagcgcgtactccagaattcggccgaaggcgacgaagacccagccaccgtcgtaggcgccgaagtagcgcgcagcgcgtgcttcggccgggagcgggtggccgaagccgtgggtggcgcagccggcgagggcgcacgcgaaggaaggcccgtcggcgcgcgggacgaggatcgacgggagcggcctcgtccccggcggcggctgcggctgcggctgcggcttgacggcgacgcgccagttgtggcagactcgggccatgcggcggcggtcgacgaggcacgggaggcgcttgtggacgaggcggaggacgtcggcgttgaggttgaaccatggcgcgtccattggagagggcgaaagccgaaggcgcggcttgccggtggcaaggtgtgtgtgggattgattcctctgcttctgaaagcgggtggagatgacggcttcgtttggaagaagaaggtgggtgggccagcacgcgatcagtttggacctcttttatagggctagctttcttgggccccaagtgtatctccctcgtgaggcagattaatgggctcaaatgtataatgggcctcatttattctctatgggcttttagatggccttttatgtagcccacgaggccatgaacgcccaatgcgagaaggatcagacgatcagtatcatgtcctcctagtctcctactgatgtgtgcaatttttcctactctgaatcagcctcgtctaagataatttttctcgtctaagataattcctaatcctaataaaaaatttcaaaactaaaacaggggagtcggttgtgacgccaactcgtcatgcctagtgttttgaggtcggatgggtgccatgtctagtgttttgtgtagcacttttttaacgaaccggcacttttgagtagcattgaaaggaaacatattgaatgatgttgaaataagaaactatgcgaagtacaatatagaaaagactcctaactaaatacaaagtaattatattgagaggagaaagtaattttctttatttggaagtaatcactataaatattttgtaaagagtaatttagcgtcatatagaaaataactctttaggtattcaaagtaattacacacttggaagaaaataatctttttataaaaagaatagaagtaactttttatggtgttagatgtaagtacacttctagagggaagtaaaactgataagatagaagtactttttatgggattagaaaaaactttgaagaaatagaagtagcttttaacattactagagtaactatattgctagaaaaaaaagcaagtctggagaaatagaagttactcttcacggtattagaagtaactcagtgctagaggaaagtaactctaaaaacaaaataaaagcaaatatttaccccacgttactagaaataactatattgctgtaagaaagtaacttttcatggtatctaaagtaactacactgctataagagctaagaacaagaatacaattttaaaataatttaaatatattaaatattggacttgttttatcacatattttgagcggagtacaataggtcaaacggatgttaaaaataatatatctctatctctactattataaaaattgaagatgtttttaccggtattttggtaagtcatccgtatttgaatcggttattaagttcgttctattttggaaatacatatccatgtttgagtcggattttaagtctgtttgctttagaaaatacaaaagaagtcatataaaaaatttctttaaaaaaacttgtatggtcacttgagagtaaagttggactcctaattataactcatgattttctaaaaaaatattcaagcgaattcacacagtgaatttcatcccatgtaaatcgtataacaataataggattaaaataacattcacctgttgcaatgttgcaacgcacatgcattttttctagtaatttaaaagatataagtggagaagaacagcaaattaatagttatgaacttaatatgtagcatccgcttaaatggatcctgagaattgaagcaactgaaaccaatctcaagaagcaattcatcgatcttcactgcaaatcggttttgatgcaatgcaatgcattcttttaacagaaaaaacgctaagtaatgttgagtaaacacatcgcagaaaatgcattactaactacaacacgacgatgatccactaagcatgtgtttggtttcgggactagatgggatgggatgaaaccattcatccctaattttggggttgggatgattccactcacatgtttggtttgtaggatgggacaatcccaatttttttgtttggttgaagggatgagggagaaatgggatggacgctgtttgccatcaccgtcaacgaccgttgactgcgccacctgcatccacgcgtggaacaaccggatcaagcacaacggtagcagcaagacggccaccat

SEQ ID NO: 88806 - DNA, 861 bp, Oryza sativa
tagcacgacgccgagcgggccgctcggcatgacgaggccgtacacgaacgcgccgaacacgaagtggatgccgatggcgtcggtgcagacgccggcgaccatgacgccggtgaggatgagcgtgatgtgcacgtcgccgatggcctccccctcggggacgcggcggacgatccaccacatgagcgggcggacgacgtagaagcaggcgagcacgaaggccaccccggcgatgagcacccagagggaggagaaggccgaactgttgacctctgagatggcgatggcgagcgcgaggaggatccaggcgcacatgtcgttgacgatggcggcggacatggcgatccggccgaggtcggagttgagcagcttgacctcggcgaggatgcgcgccagcaccgggaacgcggtgacggagagcgcgacgccgaggaagagcaggaaggaggcctggtgcacgttcttggacacctggtgccggaagatgaacgacgtcgccgtgccgatgcagaacggcagcgccatgccggcgacggcgatgatgagcgccttcttccccgacctcctgatggtgttcacgtccatctcgaggccgaccaggaagaggaagtagaggagccccaggtgcgccaccgtctccagcgtcagcaagctccgctccgggaacactttcaccgcccacgtcgaaacctgccccatcaccgacggccccagtatcacgccagcctgcatcaccaccacgacgacgacggcggcgacacagttaaccaatcgaccaatgagaatagaacaatggcggcggcgaaggtggcgggcgacgtacgaggatctccgcgatgacgcgaggctggcggaagggcttga

SEQ ID NO: 88807 - DNA, 729 bp, Oryza sativa
  unsure (1)..(729): unsure at all n locations
aggccttgttgctgcantcctgaaaccacctnnttagattgagaattccgtacccncgttataagtttatcagtcgtcttcttttttttcttcacataacatgtctaattccgatcatgtttattgcagcgtcgttacgctcacgtccaggtgagacgaggttacccggacttcgtgttcgagtttgaccgtctccagccgagcgacgtcatctgggagccgtacacagaagaggccgtcgctgcgagagcaccgctaggactttcgtcgttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgttcttcctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaagtgatcaacgagcttttccacacacggaggagaactaccgggactaccttcgctggtaccttctcgcactcgtgcgcgtgtggcctttacttccaaaccccccaaagcccgaacgttgcccctgtggaaggaccccg

SEQ ID NO: 88808 - DNA, 3172 bp, Oryza sativa
  unsure (1)..(3172): unsure at all n locations
ctcacgcgttctggcccatgcggcgtcaatctgcggctgcgccggagaaggcggcgaaacctgcaaaggtcatcagcggccacgctctggaggatgtcgtacaccacgacgacgccttccatttcctcacgagagaagaaaacctccatgtttttccggtagcgggcttccgcgaagacgacgagggcaatctggagataccgcccgtggaggttcatcgcttctcgcgtggcgggcgagattacggccaaaacaacgctgttcgctacctggtggagtccggcgagaatctcctcatggtcgtcaggctcgttccccatcctccccaattgccgccgaggacgtcggcgttcaaggtgttcgagatggtggagccgccgctggggactcccatcaacaacgacgaggcaccatacgcctggaacgagctggaatcgctgggtgggcggatgctgttcgtcgcgcgaggctgctccagatcgtacgacgcgaacaacaatccgggctccgagttcagcgagggcgtctacttcctggatgacgggagactctacgacgaggagttgatgctcggtgagcccgatttccgggagtatccctgcagagacaccggcaagtggttgccagcggcggaggcgaatccccgagtggtcgagttcttgccggagcaagccccgtcgagctactcgccgccggcgtggcttctcccctgagattgccgtcgagctacaggtttttgcttgctgtcgattcgatcccccgagatgtggtttagcttgcagccgttgtactctgtcccgtctcctcttgctgcgatcgattagtgtagtttcagtccagatttgatgtcataatcgtggattggtacagctgctacaatgctggagcagtggagattgtacttggtaaattctcctcttctatcagaaagagtatgcaagccagaattacatgaataatgaatgcagtatattcaactcagcatgaatatgtgatctgatgaattctacatgaattacaatggttgccattcttggcttggatttcattagtcggtaagattgcaatgtgtaattttcagtgcttatttttcaggatagaagcatgttttgcatcaaatgtattttacagtgaagctgaatttgcttctgcagcctgctttcagttgcttgctgacagtgcaagatggacttggctgaattttcaatggctgctacacatgttcctaactgaattaactattcacttgttcataagttagctgaatttcagttgcttgctgacagtccaggatgggctgaggtagtgccactcttcagtggattttagcagaattttcgatggctgctacatattttcctaactcataatgtagcatgttaagtttaccaaattactgatacacatcggtttcagctagctgtgaaagatgccgatagtttacctgtttgttcttgatactagttgctcggttctgttgttgtataatcgtctgaatcttagtggagtactattgattctactgaatttatttactgcaccacaatgtattcctttattctgtgcataaggtagaacgttgtgtatgttttagtagcagaagaatggttaaacagttaacagatggttattaatccaaagttatcagcatttaggcattacttcagtaacacagcctgatgttaggcgtcatggtaatctgttcactagtactgaactactgatcagatgatgatgttcttctgccctccctgctctacagaagactggattaaatgagagaaaaagttgacacgcggagaggaggatgattatctctgcattgcccgttcatttttctgaatttgcatgcaggatcttgtgattgatggtaagaaattgttggtacaatttagatggttggttggttaatcaccagcattaaccacgagaaaattttggcagttcactacgactttgatgcatcacttgcagattctttactgttcagtctggaactcaataaacaaaaagtcataagaactcacagactccggaaaattaaaataacacgggtctcaagttattggtccatgggaaattcgacatgaatcaagctgattgagcataactgtcacggtagatgccatgctgattaagcgactttcgaagagggaagaggaggattagcctgaaaaattgaaaaattagcatgaacaggataatgatgcaatcccccagactgaatcattgttcgttgcaatataatgatgcaattaatgcaatctgagtcatgagaaccaacaatttctgcattagtctaacatggtgaaaatagcagagtactgaagagatgttatgatggatcaagcaattgcaggtacacatggatctcgagaacacatcatcgattaactggacaaatcaacaaccaccatatcagcacgacaacaagtcatcagacgatctaactaagaacatggcagtctcacggcagaatccaaaccggcgacgtgtagtacgacgggccttgctccggcaagagcttgtccacgcggccggtaaccgcctccgccgccgccgccggcggcggcggcagccacttgccgttgtcgctgcaggggtactggggaaggggattcacgaattgggacgcctcatcgtagagtctcccgtcatccaggaagtagacgccctccttgaactcatcgcccggatacttgttcgcatcgtacgatctggagcagcctcgcgagacgaacagcatccgcccacccagcgattccagctccttccaagcgtatggtgcctcgtcgttgttgatgggagtccccagcggcgtctccaccatctcgaacaccttgaacgcccatgtcgtcggcggaaagaggggaggatgaggaacgagcctgacgaccatgaggagactctcgccggactccaccaggtaacgaacagcgaagcctccgccgtaatctcgcccaccacgcgagaagcggcgaacctccttggccggtatctccagattgccgtcgtcgtcttcgtggaagcccggtaccgaaaaaacatggaggttttcttctttcgtgaggaaatggaaatggaaggctttcttgtggtgtatnnnnnnnnnnnnnnnnnnnnnnnnnnnnnnnnnngtcgtcaggangagcntcacctngcagtggtggcg

SEQ ID NO: 88809 - DNA, 771 bp, Oryza sativa
  unsure (1)..(771): unsure at all n locations
agtacgaacgtcgggtggaaattgcaagcttagactggaggaacaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggagccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctatcaaaaacatgccctaccaatattttggtaatttgaatagtacttgtgtttgatttcgattgaagcctattcattggtaatacgtaatctagatttgagattatgtagaacattcttnnnnnnnnnnnnnnnnnnnnnnnnnnnnnnnnnnnnnnnnnnnnnnnnnnnnnnnnnnnnnngatatacaaagnttnacaaannncatcaca

SEQ ID NO: 88810 - DNA, 1102 bp, Oryza sativa
  unsure (1)..(1102): unsure at all n locations
actggcatggtaaacggtagaccaatccannnagacncgagaattcggacccccataaggatgagatgaaggaggcggtgaagcattgggcagtttccttgcatagagagtttatggtggtcaaatcagggaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacactataagctatgcaaaggcctggagagccaaacaaaagattattgagatgaggtatggcacatttgaagcttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaaaccgaggtcagatattgacagcaattgggtgtgatggatacaaccaggttctacctatggcttttgcatttgtagagagtgagaacactgaaagctggtactggttattagaaagagtgcacattgcagtggtgcgtatgaggcccaacgtttgccttatatatgatcgtcatgtgggtatgttgcgggttattgactacttgcagaacggttgggatgagaagggacttccagctaagtggcatgatgttcggagtcggtagtgcatgcgtcacatgggtgcaaatttctacaagcaattcaagaacaagcatcttatggagctctttaagaggctatgtgcacagagccaagagaagaaatttaatgagccgtgggacaagttggatgagttgacaatgaagcaaacagatgagcaatctcgcagaccacaagttgaaggt

SEQ ID NO: 88811 - DNA, 3651 bp, Oryza sativa
  unsure (1)..(3651): unsure at all n locations
aggccatctgcgacagctcgagcagcgccccgttggcgcccgcgaggttgcccaccgacatggccgccgcgcactccatcagcagcgcgatcatccgcacgccgtgagcctcctcctcatcctccaccgccacctgttcgacgtcggcccccgccatcggcacgcccgtcctctcctccgccgcgccgccttcctcggagtacacctccttgcacgctcctaactccggccgttgctcgaacgtcccggccgccgccgccgccgccggcgggtcgacgaactccggcgagtcgtcctcgccggcgcaaccctcattggcttcaagaaatcggtggtgatgggacaacaaaggctgctgcagtggcaggttgctgctactgctgctgtatagatactggtgatgatcaagaaactgcatcaagcctagagaatcttgcatgtctgaacctcttcccgtcataagttgatttatcaaggatcaatcaatcaagtagggtttctgcatagctgaagatgagtggagcaagagaaagcaatgtgcttatatatactccctccgtctcacaaaaaacaaacctaactggatgtgacatctccagattcattgtactagctagaatacatcacattcagtactaggtttgtattttgtgggacgaaaggagtactttttgtggcaaccagcagaggctgcttgcttgtttattatcaaccgcaatcaaattttaaattttaaaacttaattttagaatattagctgtagctcaaataaaatgtttccattaccttaaaataactatagtgtgtgcaaactccgtagtatccaatacgtaacttaaaatattgaatagggaggatatctagtcctctgtcttttccgaattttttcataactatttatgtactttacaattggaaagagattagagcgccctagttatcatttgagtagtattactaggtcaacctggaagctagtggcagtgtgagagcaatctacacggcaggaatctgcgaaacatcaatctgatgattctttggctgtattcagattggccagtgtaagcttggccggtacaatgagccagcagagctgcatggttttggtaagagtctttggtaattggttaattagctcatagtttcactgaatatttaagcagctaatgatcatcctgatcacatgtgtacatcaatccggtattttccagaaaattcagaggtaaatttattggagcaaagcaattctgcatctctctactagtatccaacaaagctcctgcaataacagttaagctcgacattgacacttcagattacaagattgattgatgaacaagtcattctgatgtgtaatcttgctaaggagagaaaaaaactgggtaggatgttaactcctaagaggtttcagagtactgacatttgacgattgcgatgcgtaattttctttgcttttctcaaggaaaaccgaaaccgagctactagaacccctaagaattaatcgaagtcatcacatttcatgattgtgatgtgtaattgagaaatgagtaagaaaatagctttgaagcagtagcttcttcctaatggcgagctgatagatcacttggtgatcatcgctagttgaggacgagtcgacgaggagctaggctgcgcttgcaggcagcgaatcaatggctggcgatatcatcaaccaatttggccagttagcttgcttaattcttcagctactaattgagtaattggccggactaattggcatcaagcagcagaattccagcatcaatctgccggtgcctccacatgtcaaactcatcgtttcctatgtgctattacacactgaactcatagtagtttgctacatgtttaattgtggtctgttaatttgacctggtattgttacaaggccatgcgaacatatttatatatgtatatatcctgctaattaattcaggctgacaaggccatgcgtagatgtaccgtgctaattaattcaggatatatgcatcatcgatcgatgacaatgtaattaaactacgtatatatactgaagctgatgatgcctaccgcttgcctttgtctgcacttacatggacgcatccaggagatattgcagagacaaacctggcaaacagacgacgatcaggaccaaaatccaagtgattagtgactgattttgcatttcttttagataatactccctccattttaggttataagatgttttgagtcaaagtcaaattgattcaagtttgactaagtttatagaaataaaatagtaatattttcgacccaagataaatttattataaaaatatatttaattattaatttaataaaactaatttggtaatgtaaatttactatatttgtctataaacttagttaaatttaaagcagtttaactttgactaaaggcaaaatatattataacctgaaacagagagattataaatgtattacatcttggcctattccataatacacggtcaatgagtctttaaaagaacaaagaaaaagagtgtgggacatatctactcttaagtaacagattttgtacgcacgagtggttttcaaataatcaattgattgattacagtttagttaatcatcaaacaagcaagctagtaagcatttggcttccagacagcgttgcatctccttttacccaagtcctaatctgtcttgacgcattgacttcggttggcgctggacatggccttgaccatccccttgcagatcttccggaaccagaggaggttcatcgccgacatcgccggcggcaccgccatcatactgtagaaccctagcgggaacaccgtcctcacctgcaaattaatcgaacagccaggaactaatttaacaacagactgtcacaaagctgaaccctgaagagaagacgattggttgattatgattacctggtcgaagtgaaggtacacatgagcgaagaagtatacgaacagtatgacgcgagcaacctgcatccaagaacaagaagatcagtatcacttggagtataagtgaattgttagttttttttcatcattttaatatttgggttgaattggtagttatatgcaactcaataaggtatcgttagtttaaaaaaaaaaactcaataaggtatcggagctacaagtctcaagttcaaatcttgtcggacgcacacttaaataaataattgcagcttccattccatgtctgagcactcaaaaaaattcaggcatgttttgtttttgttgttatttactatcggcttagtcttttatatgaaaattcaattctgttttttttgttgtttacttattggcagtcctttagatgaaaattcaggcgtgttttttgatgaacaaaagatgaattggttggtgcatggaaacatttacaaagagaaattataccagccatccagcaaacagtgccaccccgttgtacaggtaaagcttggagtccttccggcctgcaagatcaaggtacctgcattttcagaaagaatgcatgaataattgtgatctcagacatgaacaagcaagatgattaatgagcaatttgggaaaactgaatgagtnnnnnnnnnnnnnnnnnnnnnnnnnnnnnnnnnnnnnnnnnnnnnnnnnnnnnnnnaatagtgatataataagtttntacaaa

SEQ ID NO: 88812 - DNA, 3155 bp, Oryza sativa
  unsure (1)..(3155): unsure at all n locations
agcgcttgattgacnatcnnnnnnnnnnnnnnnnnnnnnnnnnnnnnnnnnnnnnnnnnnnnnnnnnnnnnnnnnnnnnnnttcgtctcccctcatcacgaacaaccgcccggtgtgctagcttttgcccgtatcgccggggttcgctccgccgctcgccgccgccgcccgctgtccattcgcggccgggtcgtcgtctacctctcgccggcccgcgtggcagccacgtaggcgccacatcggcgccagctcagcctaaaccgggtcgagccgaccccggtcagtccctccccgtgcgcgcgttccaccgcgagccgtgaggctgcgcgtgggcccgccgcacctgcgtccaccgcgaaccgcgtgcgtgcaccacgtccatcctccaccctagcgccgcgccgcgtgctccctccgcacggtgagccgagcagctgacaagcgggtcccacccgggaccgcgcgtggtgagcccggtccaccggactctctctctccttccaccgcgcgcgcgcgtcttgggccgccttgggccaccttcttgggccggccggcccgttaagctcagccgagccgccctttctctcgggccgcgccctaaccgcccgagggaagtctatattccctccctctccctttttcttttcttttcttttccaaaaaggatttaattaaatccttttcctttagaccaaaaatccaataatcttagaaattcaatatcttccccaccgtaaatccgtttgactccgttcaacttccaaaattccccaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctctggatctcgagcaaggcaagccacctttgaacatcttgagcctatacttgaaatttaattatattgcttgcaaaatattatgcattgataggatcacacttaatctgttgttccgtctgcaaggcagattggcggacctgcctaatttgttgcatttgatccttcctttgttaattgttataccatgtccccttgtaaccacccagttgcgcctcgatattcgtgcactctgtgcgagtatcgacggtcgccttcaaacttaaaatctgagaaacaacttgggtaaaacttgggttttacaaaagacttggaaaacccgacacctgggtcggtgcttgcgaactaaatgaatttctaaaaccgcggaccggggaacataccgggtgtacggttttcccgctcccgcacttaaggaccgattccttggaattacatccgaacataggacaagtgcgaccacatgggtggaatgggacacccctggctgagtaactagcttatcaggggagccatgatgccgagagacatgtggattcgccggggtggtgtcagagaggacccctgggcttcctggcacagtatggtctaggacctaacctgttgttggtctgggacccctctcgtcggcatatggtaagcctgtgtcggctttggaaatgccttgtcatgaaagcttggaggtctcccgacgtggctgatccccacgggctgggtgatccgggttagtaatatcgtgtgggtaaagtgtaccccctctgcagagggttttagacaaggttgaggtcacccttttatagctttgaccatcaataactttaaaaatatttagtttaaagaaattagaacaacatatatagatttgtctttcaaagccactataataaaagtaacacacatttatttattatatatattataatagaaaaataaggtcaaaaatatattttatagaccgtgtcattgtccaaaacgtcaattaaaatgaaaccagcggaagtacatcctatcagctaagtatccgtgcgttacaacagattccggttgaacgataactggtagtactagtagctaggtacaccatggtttgtgtgtgagtgcaggtacgtatgtatgtgtgtctgggcccgagtgccactagggttatctggttgggaggggacaaaaatccacgagagaatacggggagcagtgcacaaagcgcggccggtggcgggctccatggatggcgcacgcagctaagctagatgatcgatcgagcaagccatgtgcattgggttatagaaataaagagatcgatcgatgcaaagggatgaagaggaggagtagtaggatggacgtgataaagcggtaaaggtaaaggggatcagattcagagagggtttagtgatccaagaaaggctctggatttgagcccggataaaagcagtatatccccagctacatatgggcatgatacgtacattccctttgggcatttgcgtttgcatgtatatgcgccccatgcgaatgatgcgagatgcgtttctcgacgcatcttgcgcgtaggatgagatgaaacaagcgcagcgcggcgctctgtcgcttcagtagctagcttaggtgcagtaccacgtttccttcagataaaacacacgtcgcgtgcaattcagggtttacagtctcgtcgagccttcgaaaccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtcttcaagcagcagtgctgtccatcggcattagttcccaaaaataaccttctggtgctttctcttccttccaaaaacaccataaaacattaaccgttgttttcaagaaggggcaaccgttttgggaaaaatggtggttggaatcaaggtacctttctcaaaatgactgaaatggtctcgggcttttggtggaata

SEQ ID NO: 88813 - DNA, 1846 bp, Oryza sativa
  unsure (1)..(1846): unsure at all n locations
ctggatatntgtgtagtctttttgaagagatcatttcatcccggttcggaaggctcgaatttaaaaaattatagtgaatttcgtcgaagttgtgacccttggtgatattcagagtggtgttttgtaatccctttcttctttacagagcatgtaccatcgtgggctttagtctcgtgcaaaagataagggcttgcgctcttgggccggaaaacattgggccgtttgatgacgccgttcatgttccccgtaagacatttcttgatttctgatggctctctgcatctctgatcactgtaattgagcattagtgcacgatgttatctgaatttggttcaagtctctggacaatgtacttgagcatgatgttttctgaatttcatgcaagtttttcggataaaaaaactccaaatcctagcatatgtaatccacacgtactacatattgtaacatcctgtttgttcttgcttcgacaactttctgaattctgatacaacgaaactgaccactctagcttgcatatgaaacatctctaagaacaattagttaagaacctagaagagttaaaacacgtagtagtacatgtaatcgatcacctctcacactacaggagggatcgatcacagaatctgaccaattaaacacgacatctacaaaaacaatcacctagaattgtactccgtactacacaacaaaaattaattaacaatcataattaattcctaaaaataattaagcttcgaaaccctactactaccaatcgagcgattaactgacggcgattacagcgaagcgctcgatcggatcggagtccggtcagtacccgccggcgccgccgctccatccgcctcggtcggcggcgcccatctggttgccgccgatcgccaccgacggccgctggttggcgttggtcaaatactgccggacggggtcatccgtcggcggcccggcgagcgccaccggcggcggcagcggcgccgtgatgacgtactgctgcatgaccagcacggacgccatcttggagaactcggaggagacgaggaggtcgccgatggggccgagctccggcgactccatccactcggcgagcgccgacgtcagcggcgagctcgcctcgccggggtggcggccgacgatgtacagctcgtgcgcgttgtccagctggctgcggatggcggcgaccgtctcctcgctgttggccaccacctgctcgacgtagaggatggcgtcgttgccgaggttgcgcgaccggaactcgttgaggtactcctcgtccatctgccgctcgctcttggcgacctcggggacgacgttgatggcgcgggagtgggcggcgggcatcggcggctgcggcggcgagatcgccggcgccgtgtaccccggcgggattaagcggacgatggtgaggcacacgcccgggttttcgaccatccgccacgcgtacgcgagcccctcccggtcgtcgggcccgccgaagaagaggagcgcgacgtggtgcacggccgccatcctcgccgcggcggcgctgaggccgcggtcgacgaggatgccgacggagcacggcgccgacgcgaggatgctctcgttgaagccccggagcgacgcgttgatgggctccatgccgccgtccaccgtctgctgcttgtggaacgggagcacgatgagcgagacgtgcttgtcctccgccagcacgcacacgttctcgtgcatcgtctggtacggcgacaccgccgtgagcgcctgcaccgacacgccgccgaccatctcctcgtagctctcgaacgcgttgaagatgtggtcgctggcgccgcccgggttcgacgcccagtggtgcgcggcgagcatgttg

SEQ ID NO: 88814 - DNA, 706 bp, Oryza sativa
  unsure (1)..(706): unsure at all n locations
gtggggtnnnnattgatgatcgcttatnnnnnnnnnnnnnnnnnnnnnnnnnnnnnnnnnnnnnnnnnnnnnnnnnnnnnnnnnaagattcctataatgaggaagcgggcgacaactcatgatccgatgaggaaagttatgtaatgggcactggttggtcaaatgaggacttctctggacttgttataactggaggagatcatgctcccctgggagcataaagagaacgaggtgaaagacagagcaaggcatgctcataaagataagatgaaggaggcggtgaaacaaaaggcagtttccttgcagagagtagttaccggtagcaacataacaaattatgtgtatgaagcgcggtgcatgataggagaaagtacgaggcctttccatgcctctgatgcttattggaatgattattggaaagttagcattgtgaccgagctcatggctaattacaagggttgtgatgtgtcacctaccaatgctatctcttttggggctagcagatgtgcactaatgatcgtgctcacattggctttagaccaatatgcaataattatgtgcaatacgaacaaaatcaagttcgctttatgctatcacaaggcctggaaagctgagcattgactattgagatgacgtttgtcccatttgaggcaaatcatacaatttgacatttttgtatgccaccattggccatagagataattat

SEQ ID NO: 88815 - DNA, 829 bp, Oryza sativa
  unsure (1)..(829): unsure at all n locations
ggacaagaatgatcggtctgtgactggtctgacgccggtcgcgtcatcggcagacaaccgtgctcccacgatgcatctgcctccggtggagtggaggtaggtatgacccatctcgtcggatggtcatttggaaagcagccatggcaaatctccgcccattaatgagggagtaacagggagatccccggtgtcaggcgagtgacggcgctgagcctcactcaaggacaagttgtgatttagcttccaggcgaaaggtgccaaggccaaagtcgaagtcaagtagaaataagggngtaaggggtcaaaggggcccccaatacgcaacccncnncacnnnanngttgnccgattcatatataaaggaggaccttgccaccaaaaaggcgaacaacaagacaaagtcttctgtatggctctccaggcctttgcatagcttatagtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatctgctgacttgaccaccctaaactctaacaagcaaggaaactgcccaatgcttcaccgcctccttcatctcatccttatgnnnnnnnnnnnnnnnnnnnnnnnnnnnnnnnnnnnnngcagnngtcntacgaagcac

SEQ ID NO: 88816 - DNA, 919 bp, Oryza sativa
aatatgattcgttgcagatccttaaaataaataaagaacttattaccgttaacttagattccagctcaagccaccctgggaatcacgcggaagacgcaggcggaggaaacaccagcaacagcagcagcagcggaaccaacggtctaacacccaacaccacaggcgacagctgggaaccaggacgaaaccctaatcttcacttcacttcatctttacttcaaggcggaggaactatatatatttatatagagcaaggtgagtactttcatactcagcaagtcacggggacttaggtgtttaatgcaagcttagaagagaggcaaggttgttttgtaaatcctttgtttgaaatcatttttgaaatcactaagtgatttatttctttttaagtttgggtcgaaaaggagacttgcgtctcgattcgacttaagagatgcttttcaacaactcaaatggcaatgtatcgaccccccgagtcagatcattacttatcggcttccagagccatttcacttgattaggcggctcccagagcctttttcattttctcggactcccagagtccagctgcccagcagcaaagcaatccgcttccactcgggaagcctagtctatgatgcccgcagacatcccgaatcacacagattcgtttctgaccactcaggtcatccatctgccacataggctgattctggttacgattcccaatccacaacaacttttcacaaagtacaggcaaacaaatctacgcaacgggaaccacctcacacccgcccattaccgtttgtacggctgttccaacagttagtttacctttgcagaagggtacactttacccacaagatacgaacttactccagacacttgcccggtgtcagaggctctcgacaaaacctttcccaagccgcaccatgttacc

SEQ ID NO: 88817 - DNA, 1557 bp, Oryza sativa
  unsure (1)..(1557): unsure at all n locations
tatatatatgtgagcgatgaaatcatatgtataatataactccaccattacaatggtttttagagggcatatcgaaattacatccagctgacgacgacggcgctcagcttcttcataggacgtacgtttcagtttccactcctcttttgttcttcttttcgcggggacatgcaataagcacgagcccaaattaagttgattatttcgccagattaagcaaaagatcacaaaaaatgtcaagaacaagagaagaatgtcatcgggttcagtacatatatgcatcgatcgatgaattaggccgggaggtaggacggcggcagcggcaggccgacgaccttgccgcagcggagggcgttctccggcatgttgtactcgtcccggagcgacctcgccggcgagacgacgctgatgtagagctgctcgccgaggtagtgcctctcccagatgttggacctcacgttccacatcccggcgttgtcgaacgtcagcatgatcgccgtccacgacctcgggtacacctggaccgagtgccggctcaccccgtccagcaggttgtacgtcttcctctcctccgccgaccacttccccggccccatcctgcgccatcagtcagtcagtcaacggtagcatcagatcgtatccatcatttatcttatttaaaaattttatgtaaatatagaaaaatcaaatcgtatttaaagtacactcgacaataatcaaattacaataaaattacaataaaatagatgataactgcataattatttttaaataaaataaatggtcaaaactcaaacgtttgtgaaaaaacatatattataaacgaatgttaaaagtaaaaaaaacatcgtatattataaatggaggtaatttaaaaaactttttttatatcattcgtcttattaaaaaattttattattatgcgcatcagtaagttagttaacagtagtatcagatcatatacatcattcataatattcaattttttatgcaaatataaaaaaaatcaaattatgtttaaagcacacttgacgataaatcaaattacaataaaatagatgatacttatataattttttaaaaataaaatgaatggccaagcctatctttaataaaaggttaatggaggtagtagtaatggggggcgatgtatgtacgtacccgacggcgaagaaggcgtagccgtcgaggtggacggagtccatgctcttctcggggttctcgaagatgatctcgatgaaggtgcggaactcggcggtgatgacgttggggacgacgtggagggggccattgacggcgggcggcacgtcggtcatctggttgtacctgaagacgccgtcggtgacgttgaagtactcggcgagcttgagcggcgtctcggcgtcgacgtgggagacgccattgaagccgtacttgagcttgccgtcgatgtggccccgggagaccatgagcctgatggtgcgcgtgatgttgatctggnnnnnnnnnnnnnnnnnnnnnnnnnnnnnnngctgcgtcaccaggcggcatntcaatctcgaanntcaatnggcccac

SEQ ID NO: 88818 - DNA, 1307 bp, Oryza sativa
tggttcattagaaattctacaaaggaagccactatcggtgttctgaattttgaagatttccaagcaacacatttggataataggagagttgaacacttatcaccatatgaggagttccgcatcgcttcccatagcaatgcccgaattccaaatacccaaatgagaactgaatatatttcagtgtttggacactctcttttcttgcttcctgagctgtttagcaatcttaaacgggtgattgttttggaagatgatactatagtccagagagacttgtcacacatatggaatcttgatttgaaaggaaaagtgattggtgctgtacagtcttgtcgagttagattaaggcatctcagaccatacttggttgacttcccatatgatgctagttcatgtatctggatgtctggagtgagtgttattgatctcaataaatggagggagcatgatgtgactgcagttcgtaatcgagtactccaaaaggttagtattgaatagtgatgcttagcagctgtcttttcttctctctttcaagaattgtttttaagaaactactttcgatgttatatttgacataaggcatattcctcatggctatactcttgattttctgtttgtgttcaactgaacttaccctactgtaccgtgatcttcactaataagataaacttgcttgaagccttgaagtttatttaagatatgtattttttttcttgcacgtttggcctgttaagcgaagagctgcaaattcttaactgatacggttgtgcctatgtctcacttttgacagctgcaacatggccctgaagcgtcatggagagctgcggtgttacctgcaggcctgcttgcttttcaaaatctggtccatcctattgaagcacagtggatccagtctggtcttggtcatgactatggagtcaatcatggtgctataaagaaagctggcatattgcactacaacggcaacatgaaaccgtggttagaactcggcatacggcgatacaggaaatattggagaaggtacctgccaagggatgatccattcttgatagattgcaatgtgaatccatgaacaaggcaattttgttagtcctggagtccggaagtccatgttcgacgaacagcaccaccttgtgcgatagcgagagttcactgtatgcgggaaatttgatgagaggagaggggcttcagtgagcaccgcccaaactactgaggatctttcaggatgctgctgagatatgaagtaaaaaaatatcccaactaccttcagagtttcagagcccaggtaaggagaatgctctggaaca

SEQ ID NO: 88819 - DNA, 741 bp, Oryza sativa
  unsure (1)..(741): unsure at all n locations
ccgccnaggtagactcatctagcatccaccccncgggagctgtcctgatccaagcctattgatttctaacccttggtacctggaactgcaccgatccacaagaggtcttactgaatgggagccaactagttggcggaagtcaataagccagttgatgaacagttacagaaaggatacatccgcccgagcacgtagccttggggtgcttcggatatctttgcgggcaaaaaagacaaaaccaacaggatgtgcgttgactaccgagctctcaatgggggcaccataatgaacaagtttcctttgccaaggattgattacccggttgatcaggttaaaagagctactgtgttctctaagatagacctgcgatcaggctatcacccattgaagttccgcgacgaggatatttcaaagacagcatttatcactcggtacgggttgttcgaatgcacagttatgtttttcggactcactaacgcacctgcctccttcatgaatttgatgaacaacgtgtttatggaatttctagacaagtttgtcggggatttcatcgatgacatacttatctactccaagttctaggaagaacattaacagcatctttcgctggtactttaaaagttaaaagagcaccagctatatgccaagctcagcaacgtgcgacttttggcttaaagaaaatcagtttttcggacacattgtgaatgcttattgaatagctgtggattcagcaaatgtgga

SEQ ID NO: 88820 - DNA, 709 bp, Oryza sativa
  unsure (1)..(709): unsure at all n locations
cgccccattgaattgagattctnnnnnnnnnnnnnnnnnnnnnnnnnnnnnnnnnnnnnnnnnnnnnattatttgtcactcagtcaatccacaacctgctctcggttcatcgctattttgaggttgcaagttgtcatcccaccacttgaccagaataggagggcacgaatcttcggctgtttgtatacggggaatttcttcttcatcaccgatcattggtcctaatgcatccattgacaaaggttacacgatcgatcagagttatttgggtcaacatggtttcggacaaagtgtttacctgtaatgatttctggacgaggacgagtggattcggatacttttaaaggggatccagatctccggtcattgctggcgtcttgtccacgagggttgtctgcttgggtttcgacttctggaatctcttggcttggccctgcgtccgactggtttccagtcgggggctcctgattaactccggcttcggcttcggccgactggattccagtcgggggttgatcaccggattctacattatcggttgccggttgattgtcactcagatgatcctcagcagttggctcggtttctttggaagaacttgtgtccacgttagtcgggtcagagtctttcccagacggatctatatcagatggtttcctgcaaaattgattatcagtnattattgccgcatgggtgcgcatcaatgcaa

SEQ ID NO: 88821 - DNA, 566 bp, Oryza sativa
tataactgcaatataaaggaaatagtgactaaaaatggtatgtgcaattcctctgaaataataagtctatataaatagatagtagtattgctcaagctctttttaacattaacaataacagtggatacgttaatagaccaggttatgtcaagtgagttcaaaagaaaagaatgtaacttagaagggctggcatgcagacaaaataatatggagaaatgatggcatgaaaaaaaaattgtgatcactaattagtgtgtcttcaacgctggcatgataatcaagattgcggattaacgaaataaaatacaaacatacaagacctaccttgaagatatagcattggcaagctgaggattgtgccaccatctaagagagaaactcgaccccgtgtatcatcaacctctgagtgacacataaagagtcttattacactttcttttctatcagcatcaaacatcatatagcaaggatgcgaggacatttaccaccaagataggtgtgcaacgaggctagagatgtgttgaatgtgaattgtcagaagtgctagccacctctcccttgtcgtt

SEQ ID NO: 88822 - DNA, 734 bp, Oryza sativa
  unsure (1)..(734): unsure at all n locations
cgctgttttgnanattggannttgatgaacctatnnnnnnnnnnnnnnnnnnnnnnnnnnnnnnnnnnnnnnnnnnnnnnnnnnnnnnnnntgcgtagggagcactccgcgcggttctagggtgggggatggacttggtgcactcacgcggttcgtgcgtgacccaggtgcattgggcctactcccagccttactgctcgtggtggaacgcgcgcacacagagggactgaccggagtacgcttgacccgccttaagctgagctggtgccgatgatgcgcctacctggcttgtacgcgggccggacagaggtagaccacgaccctgtcgcgaatggacagcgagccgcagcggcgagcggccgagcgatccaccgggatactgacaaaagctagcacaccgggcggttgttcctgatgaggggagactaaccaacggctaggatttgctggtggttgtttgacagctgcgtatttcggcagatgcaaccggttgccggagaaaggggaaacggcgacgatgtcactaggggctcaatcccgggggcgagagcatctacaccgatacaggaatccgatggtagcgtcggcattgacggaactacncccatcgaggaccggtacatgcgctcttacgagcttggccgttacttgagngagcacactggagcgaacgggaacgacggtgcagcctctgttactttgggtaggtactcgagcggatacgaaggttacga

SEQ ID NO: 88823 - DNA, 1077 bp, Oryza sativa
tatctaattgaaatagaaagaaatagaaaagaaaaagtgccatcagatattataagaaaaagtgccatcagatagtttgttccataagtaaattttaactggaattacagtagcattatactcaaattgaaatacttatttactgtaatactacttatggaacatactcatacaggtttgaaaaacatttaaagactatcttgaatatttctttacaggtgtcatacaaaaggacaaagaatgcaaaagttctaaggaaatagaaggaaaaaatataggtaaacaagagttacagtaaattttaactggaattatagtagcattacactgtaattgaaatacatacttagtgtaatattaaaattattttgaaagaattatacaaactgattcatttgttcacttcagtatctataatcaagtatcaaattgattgtagttggatttttaagtagttacagtttctgtttactggaattatagtataatttctctgtaatacaaatatatgttcactgtaaatggacttatgaaaaagattgggaaatacactctatgtttcagaacttgctggtttagaaattcaaaagttctttgcaatattaatttattctttctatgcaggtggcatacaaaaggagaaacaaagcaagagttctatggaaatagaagaaaaagaatcaggtgaacaagataatttcaaattttattcacaaataagaagattaaaatgagtctgaaattttttttaaaaaatgccatcagatataaaaaagcacttcaaagctctgacagaaatggatacagagattataagtcaatcgaatctgacagaaattaacacagctatgttgagctcaggtaagaaacaaaaaattatgtagttcaatgtatttttaaaaaaatgacaaacatctaaatgatctgaactatatactttcaagtgggtactttttaaaatctaaaatattaacattaaaactagttacagagaagaagttataaaaatacatgtaacaataactgaaaatacaaggattattctaactttcttcataatgatttttattttgcagg

SEQ ID NO: 88824 - DNA, 2503 bp, Oryza sativa
  unsure (1)..(2503): unsure at all n locations
agaagtatcttaatttcagaagtcaatttgcctagtaaaatataaaaaatgctaagatatataaaggactaaaataaagaaacctggataaaagaggaggactttataaaatattttacatgagcaaaccacacagtagtttttttgtaagtgcaccgacgaaggaattttctggatgcaaaaaaagtcggttgagatattaactaaaaatgttatgaatgtttttaaaaaaaaaatggttggcaaaataaaattttgaaccaaatagtttaatgtatttaagagtaaaatttgtgcaattaaaagtatgtaaaaaaaaagggagataagttaaataagattgttattatggagaaattgggctaaaataaaaaatttaaaatagataatagaaatatggtaaaggtattaattgtgtaattaaataatgagatttaatagattttaagtaaatgttgtaataanaggannnntacccccccccccccccgagggggtcaggccacatgggtgactgcagctgccccaaacctctagtcaagatacccccggtcccatgtccccgacaataccaacaaggcacatgattgtaattttatttgttctaagaggaggattgacttctttgccttatacgaagaaagatataagcaatgtgagacccccaattaacaaggagacaagcagcaatgatatgatgaaaactttggaatttttcagaaggaaaaaagaaaaagatccacatttcttttatgagtttgatttggatgagagcaagaaagtgaaaaatctgttttggacagacgggagatcgagggagtggtatgagaaatatggtgatgttgtgagttttgacacaacatatttcaccaacagatacaacctcccgtttgctccctttgttggaatttctggacatggaaacacaattgtttttggttgtgcatttttgcatgatgagacttcagaaacatttaaatggatgttcagaacttttttgaaagctatgtcacaaaaagaaccaaaaataatcattactgatcaggatggagcaatgagatcagcaattgctcaagtatttcaaaatgcaaagcacggaaattgcttctttcatattgtaaagaaagctttcaatctatctggaaatttgttcaaagcaaaagaagggttgtatgatgagtatgaagacatcataaataactcagttacagaagaagaatttgagtatttatggcaagaaatgattgacagctttgaagttcagcatatcaattttctaaagcacatgtggtcaattagaaaaagatttattccagtgtatttcaagggtgatttctgtccatttataaaaagcacagctctcagtgaagggactaactcaaggtttaagaataatgttggtccacagtacaacattacaaacttcatgatagagtatgaaagagtaatggatacaattcaaaacttggaacagtttgatgatcacatttcaagaacaaagaaaccaagcaaactttggtcccattactacattgagtaccaagcaatgagaatgtataatcgcaaaatcttcatcaagtttcaagttgagttgaaaagaacaactagatttcaaataaatgaagtagagaagttcaaaacttatgaagtttttttggcattgaatcaaaatattcaagtaatcagaagaaggaagtaccttgttattgtggacttggaaaaagaggatttcaactgcatttgctcaaagtttgagaaagatggacttctatgctgccatgtattgaaagtaatgctccacctcaatgcaatgaagataccagaaaaatatattattgaaagatggacaaaaaaagagtacaaaggtcttgggggaaaaggcaatggaaatatacctttagcatagagctcaatcctgagattcaacattttgtcaaggaaaagtgcagaaatagcatcaaatggatcgaaaagcaatgaaactttccagtttgcagtggaagagatggacaaaatcgctaaacaattggaattaatgtgttcaaataaagatgcagagcaggagatcaatgattcagatccaaatgcagaagacaatttgaactcacatgaacaaggcaatcaacaatctgaggaaaatacagaagaaatattgttggatccagatattgcaaaatccaaaggcaggccagctcaaagatacaagacaattagggaagaaatacagcaaaaagaactatatcattgcagtcattttcagaggacagatcacacatttccaacgtgccctctgaaacacgttgagtttgacttgccaaggaagaagagaagaaaggttaaaaatacaagagaacaggtaacaaaaattacaaatccatatgaattgatttttttaaaaaaagtaataaagaaagatattatttnnnnnnnnnnnnnnnnnnnnnnnnnnnnnnnnnnnnnnnnnnnnnnnnnnnnnnggtgaggatagatcatcaatncacgc

SEQ ID NO: 88825 - DNA, 630 bp, Oryza sativa
gatctgagctacatgctatctctactatcttaagggaagttaaaacagcaccttttagatacgatgaaaccttttctggcatgacctcgaaccatcgtgactatgatgggacagaggaagatgaatggggtttttatgactttgaacattcaaacgattcggtggtacagttggttgtttcaagactgaaggaacatgttgctatggaggtcagttcttctgggtgttcagtattcccataaaaagttatatctatttcacttacagcttaacacgtaacaactaacaatatatccctctcttatctgtttcacttacagcttaacaagatagatgctaggattatgcgaatttcagccgtgattgagcagctgaaactcaagcttgggcctgcttctgtccttgattaccgaacaattatccttccccttttgaaatcattcttgcgagtatgtgtacactaatctctttactcattcaattgctttatacctccttgctttgttcatttcttaatccgggttattgtgtgacgattcagacccatttggaagagctggtggacaaggatgctagggagagatctgatgctgcaagtgaagccttcctggctgaacttgctttggatgc

SEQ ID NO: 88826 - DNA, 558 bp, Oryza sativa
atcaaggctggcctacgaatatgggtctacaggtttggttcttgcatactagtttgccttaagaatttgatcaagatattatgttatgctacaaactacattatctataagggacaattgcccttatatctcattttttcttcatcatgctttcaaaaaagtttgtttcatttccctgcctttgactgtcatgagttggtttagtgattttttaagtgccactcaagtagactcatacttacattcaggacctgcttttacttatgctcactaaattctgtataatttcgaattcatcaaagtcatcacaaaatttgggaccaacacgagggaattatcaatttgattttacagtggagacgtggatggcagggttccagttattggatcccggtactgcgtaaaagcccttggccttcctgttaagtcacagtggcaaccatggtacctaaacaatcaggttgttaccctattacatattccgtgtcatctacgtgtattaatcaaaataaagtgtaaaattatgaattacaatttgtaatattgcacaatttcttc

SEQ ID NO: 88827 - DNA, 539 bp, Oryza sativa
gatttgtccagatgtgaactcttacacagtgtttattaatgggcatatacgacatggtagacctgaggaggcatgtaaatacattgaagagatgatccaaaaagggatgaagactccacagatagactacaataagtttgctgcagatttctccaaggctgggaagcctgacatattgtatgaattggctcagaaggtgaagtttacaggtaaatttgatgcgtctaatgtgttccaccagtgggcagagagaatgaaaaaacgtgtcaagaggaatgtccctaatcagactgagagcaggacgttctaagattaccatttgccagcagaaatgtggatctctttgatggtggctgaaatttgaggtgttgctcctgctttttaggagaaaggtgctagttgttttctgtgttgtatagtaatggtccatgaaatattagtgtgttttcatgtgtgaacaaaatgattcagttaattatgatgtagcctatggtagttttattttagttcagtcatgtgttacgctaaatcttcattca

SEQ ID NO: 88828 - DNA, 1256 bp, Oryza sativa
gcgctttccatccctcacgatgtgcatcttcttgtttgaagggtcttttatgtagaatatctgctcaacttgtttcggaagtacaaatggttcatcagtgtatcccacctttgatagatctactaaagtgaaacctttcttgtcggctttgacaccagtgcgtagattcacccaacggcaacggaacaaaggaaccttgaacttgacgtagtttagctcccagatctcctcaatgcggccgtagtatgtgtttgacccaacttgatcctggaatgcatctatacggacaccgctgttttgcactgtgcttttgtcatcttgtttgacggtgtaaaatgtgtatccatttatatcgtatccttgccatgtgtctacggtccaagacggtcccatccccaacaactgtactgtctcatttgggacatctgtggacattgtcacatgattcttgaaccattcgttgaaccgagaattatgttctctgttaatccatgcatcagatcgccccaagttctcatctcggattttcgctaagtgctcctcaaagtatgggccaacttctgccatatgttggagtacagcgtaatgagcctgcgcgtacgacgcttgatcgggcctaattcttttcctttcgattgtgccaacacctgacaaccttccctcgtgacgagacgcaggaactccgataggatcggcatcggacatgtaattgacacagaactcaatagcctcctcggtcgtgtaaccttcaatgatgctcccctcgggtttagctctgttacgaacgtacgactttaaaactcccatgtacctttcaaacggccacatttcccttagaaaggccaggccacatagttttgttagcttcaccagatgaacagggacatgaaccattatatcaaagaaagatagtgggaaaaacatctccaggtgacaaagggtattcacaatatcggtcggtctacaacccatctagatcttctggatctataaccttctgtccaattgcattgaaggaggcgcacagacgttggatcgtgtgacgcactttcggtggtataatgcctctgatagcaactggcaagatttgtgtgattagcacgtggcaatcgtgagacttcattccaacaagttttagatcatccaatttaacatacttacttatcctcgctgaatagcccgatggaactttaatatccttcaagcatgataacattgcaatcttctcatccttcgacaatgtgtggcaagctgga

SEQ ID NO: 88829 - DNA, 704 bp, Oryza sativa
ctgcaagacaaagcaatgcacaagagaacagcgaaccagaaaaatataacggacaactcaaattgacaacaagcatgttattacagttacatacttacatatgtattatccatgtcaccaaaaaccataaacatttgaatattagttcaagtcagaaatttagccagtattgcagcatctattaccagcttatctatcagctatcactacaatttcggtcaaggacctatgttaccacttaccatcataaacaggtcataatcagcacatgctagttccagttatatgctttcattgagctacaacactatgatgcagacctcaccaaaacatccactagtaggtagtacataggaattgtaaaatggtactataaccgatatagatttcatacgaatggtggcaacttacttggatctttagttgtccgcactccagtaccgccaaagtcacaagctacatcgttagctccattttgctgataatagctgttgaaggcatatgaagcatgtgatgccaatgtatcaggctggtagcagggctgactcggttgaatagcagagcaatcaacattgcctggtccacatgcccaatttaaaccattctgtagatctgtctcagacgcattagcagaagcaacacaccaagtaccatttgcatttgtaatgtttcctccagtcatgatgtccacattgcctctgcca

SEQ ID NO: 88830 - DNA, 566 bp, Oryza sativa
ccttgaaatccgctcggcttcatctttgtcttgaaggggttctttgaaaagtcaaaaatcgtatgaggggctctcgccagtcggcttcaatcatagctacgtcatgagtgcccgcaatttgagcagtatctttgtgaggaccgtcgcgtataaaggtgttcgacgaaaacatcggaaggcgccacctcgcgcttggatccaaagttggcaagtctgtcggcggcttcattattgtgtcgaagaacatgacttagttcgagtccatcgaacttgtcttccaatttgcgtacctcttgtcgatatgccatcatattgtcatcaaggcaggaccactctttcataacctggttgactaccagctgtgaatcgcctctaactattagacgctttatccctagggaaattgcaatccgcagcccatgaaggagggcctcatactcggcgacgttgtgggacgccgaaaaatgtatccaaagtacatagcttaatctttctccagttggtgaaattagaaccactcctgctccagtgcccgaaagtctttttgacccgtcaaaatgcatggt

SEQ ID NO: 88831 - DNA, 570 bp, Oryza sativa
ttttagacggttaaattatacgtttctaacaaaaaaaaacttctgtctagaagttatttttagaaaatctaattattcgtcttttaattttataataattaaccatgtgctaacgagttttctcaatgtctatgttaataatatccattcaattgccttaaaccaacgggccttacaagcggaggattttttttgactttaccattcaattgccttaaaccaacgggccttacaagcggaggatttttttttcctaaagtcaattacatggaagacgtacacacacgaatcacacttatggtggtacgattgactgatcatctcgtctcctctgatgtgcaagtgaaggtggagacgcgggtggagaaaggggacccgagggatgtgatctgcggggcggtggaaaaagcccgcgcggacatggtggtgatggggagccatggttacagtttcctgcagaggacgctactggggagcgtcaacaaccactgcgtccaacacttcaagtgccccgtcgtcgtcgtcaataggcccggcaccaacgccaaagcctcttgatgcgccaactcc

SEQ ID NO: 88832 - DNA, 508 bp, Oryza sativa
atcgcaacttttcttgcccaaatctttgtcaattccatcgggctaattaacaatcgatgtcttgcacgaaaggaggaagatctgtctatgcaaattctccagccaaccgctgccaatagattatttcaagaatctaaacatgggccagaactgggccatgcaaagcctgctctcctagctaggttgggccggtctggctgtaaatgataggaataagttcactttgtgacccttaaaatgatcgaaatttaattcgtgaccccaaaccacagaaccggatatctcaacccctaactctcgaaaccggtgcaatttgactccctgggtggttttggatggcggcttccctgacgtggcccctacgtgacggttttaactcggtcttatttccacgtgacgttgacgtggcgcttacgaggtattagaaataaaaaaatatgtgcgagacccatttgtcatacacacggaaaaaaatgtgggagcccctgtcatgtggagcccacataat

SEQ ID NO: 88833 - DNA, 2121 bp, Oryza sativa
cagtcaagttcatccctcaaaaaagaaaaatccttcagcacacttaatactcttaggtttcttgctgtaaaggtacagaaaagatggatcccaataataagaatcgctatttcatagtgctgcaggtttactatttaatatcttgctgtgttgcagtagtattcattattcaacgataaaaaacaatttattcaaaatgatgcagcagaaagccctaaagcagtgatacactggtctctgcaggtactctcaatgtattctgaaaaagaaatttagagacacctcaagtagggtttgtttggcttgtagacccaacttatacctgcaaaatattgagccccagttcaagtctcctaaaggttggttttatcatttgcctgccccaaggaacatcgtaataccacaaaaaatttataattcaaaattggacattttccgctgcaaaattgtccccactctctttcttaaaaaataatccatgatgactaacaaatccttgtttgattcattatcaaaggcgagttcggttggtacaaccccaggaatgagcgtgggtaatccatgggcagccaatgaccatactgaaaatgctttttttttttcactagctttgaagaaaaaaggtgcattagttcagttagtggatcaatgggtacctataggtggactcactcccatcacaacacaacccagaactcaccagcaatgtggggctaagaaaaaagatcacttatgtctacttagcaaccagcttccaaattattgggcaaccaaaaatttgaaaccaatgtggtccctacttgtcatagagataggtggataggatttttccagcaataatatgcaaggtgctagccaaaaatctagcaagttttcttaaagcatggccaaatgcccaaattacatgggaccaaaatcgaattttggaagagaactaaacaacagctcaacaatgggaataaccaacaattggatcaggaaacctgacacacccaaacttttgtgatgaaaccaacatatatattaccaatgttaactcctttgttaaaactttttgaggatgatacgcatgctggctaacaaaataattatatgaaactcaataaactacagtacatctaaacaagtgatcaatgtggggatttagttgttatgattattttataggataacacgtgattaattgatacgttattctaacaacatataatacaaacagccatgagatatcagatataccagaagcgcatattataatgatcggtttaaagtactgtacacctaatgtgcacattgatttaaagacaagaaagctgatatcccaaccacctattaaatactacaaattatcttcacatatagtagtagtgatgtagagcaggtcaacaattcagaatcaaaacaaggatgcgacctaaccgatgcctagtacacagatacacatgatgtattatgtcaacctcgtgatttcgagaagtctaagttctcagcacagtagcagtagcacacagtttaaagaaccaagggatacagtaacccaggctagtacacatcaaccgcacaaacaattcaattgagatatacaagcacagaaatgggtaaaaaaaatcacttaaaaaaagagggtaaaattgaaagggggaagaaatccaattaccatcatcctccacgcgaggtatccgacgggccctccgcgctcgccgtcgctagcaccgccatactcccctccgtcgccgacgccgacgccgacgccccctctcctgaggacgtccctgacgaagtcgacggcgctgcccctgtcgccgcggtcccagtagagcgcgacggccttctcgacgaggctgaacccggggcggagcccgacgcagtccatctccccgagcagcgcggcgacgtcggcgacgtccccgccgccgcccacgaggcgctcgatccacccgcaggcgatggcggccatgagctccatggtctccccgtcgacgcggttggcgcggcggagccagtcgaacacctcgagcgcgcagtaggcgtcgcggccctcctgcgcgaagtagacgagcaccagctgcagctcccgcggggacagcgccgcgagctgcgccgacgccgccgccgcggcgt

SEQ ID NO: 88834 - DNA, 2817 bp, Oryza sativa
catgctatcatgtatctccatcagtttagccatcaaatcataggtaggttttcttaaaaagacatatgtagacctcaaggtgatcaacatcattacaaatttggaattcaaatcaatttgtactaagaaagaagagaaaagcttttgcacaaatagcagttttgttggccctctttattttattgtttgactcggattcctgtttttgttccttctaacacgaaatgaattctacagatatccacatgtgctattatttcacacttagctatcagccaatgttgagtagaaaatttttatttgcagattgaaaattcaattttcaggcttcaagtttaaatttatgacatgaaagtttcaccagttagttcacttggaatcaccaggttttggttgaagattgatatttttgctaaaagtttgtatgttcaaagttaagaagagttaattagatagttaattagtgaaaattttcactatatagaagctctttcaggtatatttgagcaatagtgtttgtatcagatattgaagtcataaatagagttcactaaaaaaaggtgatctagcatgtgaaaaggaaagcaaatgacggggatttaagaggttagaatgaggtagactaaaagcagcagtgcataaacagtatccattataattcccatcacaaagaagttctgacaataatatcaaaccaagagcatgacctctttccctttgtacatatcccaaaagatatctattaaatgctcctcttctagtgaaaatgtcattccagtaaaaaccacatctttgcagtactttagataagaatgaacttccttcgaatagtctgtacaataagaaaacatctgagttaattttgcaccattaacatgcattttgcaaaggatgccaaatatatataatataggatccaaagttagaaatgccagaaaatatttatcctcgaaactaaaatgcacccactctgtttttgtttacttggcacttttgactatttgacaatcccaaagcacaccttccattttgccctcattaattgccaccagaattagagggtttttcatatgatataaaaacaaatgattgcctaaataaagctgccttagttgcaagtgtaaaacaaacacaaacagaggtcatatatggccacatgagatcaatcaaccacctacatatgcacacgtcaaaacaatgtgttcttctcaaaacaaaaacttaccaacaaaacacatgtctacatataaagacagtatcttgcagactgaaaatagtgtcattgaagaatgcatggaaccaattatagcatagaccaaaactaagtcacaaaagttcctggatcgatgggttgaggaactggaacaaggaacgtaggacgccatcttctaaaaacatggaacgagaggggtatacatcttctaggaacgtgttcctagtttttttggaacgataatcaggaaagttttgctatattttctggaatgagagtgaaatcagtatgctctatcagcagatgaaaggagaaatctcacaaactaagctcattgggccatgtgaaagaaatgaaagaagttaaatctacacattgtcatttgcacaaaaagaaatgaaaaaagcatatcttaattggagatgcaattaaaggtgctccaatattccgcatgaggttgaactttttctgtaacattctttgtcgatatgctgatatgataaccttttataggactatccacaggtaactaagaacagacaagtccatcagtggaagttttgtgcattatttttgagacttcacaatggcagtggctaatgcacaggcccaacaagagcaagtctatggcattagaagagacaagcaagcattctggagctctttgttctctgggtgaggaactattatgtataagatccagaaatacgcaaatttattcattgcctaagcacaagctacaaatgccatctttatgccgattaattacctcttccatagttagacatagttatggtttcccttcaaaaacaaacatagctatggtgctagtataagaaactagtttaaactaaaaacgatcagcatatgcatgactaaacctgatgtgagtttagcaaagaaatgataatgtggaattcaaacaatgatcatccaaagttaccatgtccaacattgattttatcataagaagctgcaagagtgcacaacagttctcttgcatcaaactcctcactgttgttgctgtcaggctctatagaatgtggtgcacttgcttcaggatcagatccaactgcattttctgtctgagcaatactctagaaaggaatgaagttcagttcatcagtatttaccacaggttctaccacatgacgtaaagagcgtggcctatatggaaaactcacctcccatatcccttgtccgttgatgccatacagaactcttagagccactattagtatagccattacacaaacccgtgagggtaccctgccaggattactggacaaccaaagttctgcaggcattgcccactcatagatgcgacatgcatgaggaaggattttttcaattggaagagataactccttcaagaagcgctgagcaatcaagtagaaattaacagaaggaagcaacagtcctatcttttgcgctatggacccagctgcagcttccagctgccatgctccaatcactcgagttggcctaaatagctgccgtgaactcaacgggcagtcgtttaaagaacttccaagaagcttgtcgacttgggtaaacgctgccacataaggaagcttcccctccattgcccacctgcaaatgtc

SEQ ID NO: 88835 - DNA, 604 bp, Oryza sativa
attttattaacataatgttacttacctcaaaccatgtcagacaatcaagagctataactgagagccgttcatgctctttcttgtctctcttttcccgtaaggcccgccacataaccattggctcccagctcagtccagaagttagctcaagcacgtcacgaacaatgactggctgaccattcaaccaatgctgctgaaaatgatctaaagctccactttgaacttctctagcagttggacaatatatgtagttatcattggagtcctctctgcaagctgatttccgtgatgtttcattgttcacttcaccggattcagtgaagcaggaacatttagagccttccaactcctgctctgtttccttattgaccactgaattgactttatccagtaaatcaaaaataaagttcttcttaaacaaacacctaagttcgagaagacaattcccgcaaccacctgcattaagtgggcatggtatgcttcccgtgctttttggccttcatattaaactaggagtgcaatcctcttgaagagctgcactaactatcaacctgtcattcctgtgatcagaagcccctttgactacagcactgctatgactact

SEQ ID NO: 88836 - DNA, 604 bp, Oryza sativa
tgattgctgcccttatagcaccatcctgatcagtaattattgtctttggttgctttccattcattgctttcaaaaaagctctgaagagccactcaaaagtttcagttgtttcatcatgtataaaagcacaaccaaatagtattgtgttcccatgtccagatactctaacaaatggtgcaaaaggcagattatatctgtttgtcaaaaaagttgtgtcaaaacttatacaatcgccaaatttgtagtaccactccctagatcttccatcagtccaaaaaaaattcttcacttttctattctcatcaagatcaaactcatagaagaaattgggatcttcttcctgctttttcttcaaaaaattcaaacattgcatcaaatcattactgcttgtttctctgtttattgatgttctgacattgcttatatcctttttagtgtaaggcaaagaagttagaccacctcttagaacagataatattacaatcatatttcttgttggaatatggcattctttcaaagtcctgattagaatcttttcttctgtcgacatgtatttgtgagatcttagaaatctagctcatctggaggactgagctcatgattg

SEQ ID NO: 88837 - DNA, 1576 bp, Oryza sativa
attttctcattctatgtgttgctcataaagttatttaatgatgtgctctatattgcaggagttcatgatccttcctactggggccgcttcattcaaggaggccatgaagatgggtgttgaagtgtaccacaacctgaaggtaattctttcatcttcattttaaaccttttccccatcttacgtcattgaaaattaattaattttatctgtacagtctgttatcaagaagaagtatggtcaggatgccaccaatgttggtgatgaaggtggttttgctcctaacattcaggtacttatgcctgcagcagtgaattcaattatctttctttccactatgctgttgatccatgtgaagtgcttcacttcaattatgtttccctgttttgctttgtatttgcttgatgttagatgctgagataacttctgttttgatgtatgaagctaatccgtaattagaaatctaaatgaatatacttagcatgtggtttgaatcgtttgtgttgtgtgatattgcaggaaaacaaggagggtcttgagctcttgaagactgcaattgaaaaggctggatacactggcaaggtttgtgtactttgattaatttattgtttatctttctgcataagttaatgtttttgattgactgaggcttgagactttttttgcaacctgatatggtaggttgtcattggaatggatgttgctgcttcggaattctacaatgacaaggacaaaacctatgaccttaacttcaaggaggaggtaggtggcaatctgtttcatttttgatagtagggattggctcactgtttgatatcatgtagatgtatataatgctgtgaacttattgggaacatttgtgattctttttgttgtagaacaatgatggttcacaaaagatatctggtgatagcctgaagaatgtatacaagtcatttgtcagtgaataccccattgtctcgattgaggatccgtttgaccaggatgactgggaacactatgctaagatgaccgctgaaattggagagcaagtgcagattgtcggtgatgacctccttgtcaccaacccaacagtgagtgcatagttttctattacttctaaatatgatctctctttcagtgtggttgataattaatattaatatatgttatgcagagggtggcaaaggcaatccaggagaagtcatgcaatgctcttctgctgaaggtatggttctattgattctttccttcacgtttaatagtttatcttccatgtgcgaatatatcacccttgtctttcaacaggttaaccaaattggatctgtcactgagagtattgaggccgtgaagatgtcaaagcgtgctggctggggtgtgatgaccagccacaggaggtatactgatatgcttacctgtctttattcctggtggacctggtctgactaccaaccatttgtatattgacttgtgtttcattgccacagtggtgagactgaggataccttcattgctgatttggctgttggtttggccacggtaagattctgtgctctacattcactgtagtgaactttacggcatcctgtattagttgtta

SEQ ID NO: 88838 - DNA, 620 bp, Oryza sativa
ctgagagatcccctcataatttccccaaagcgtaaccatgtgtgaataaattttgagctagtagggttgcagccacgagtaagtcttcccttgttattgggtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctaaaatccatggctctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgc

SEQ ID NO: 88839 - DNA, 1728 bp, Oryza sativa
  unsure (1)..(1728): unsure at all n locations
gagcaatggaggggaagtgttcacaaagccgggttcnacggtatcaattagcccgaaaagaaaaaggtggagaagtgttggaccaattcgccggactggcgagaaagggcctgacgttaaacgcggccggagtggggttcacaagaagaataaccctcctctcccacacaatcttctcacgcgacatgaccagcctcgacgaccatggcgcgtccaaggagttccagcaggtggtcacgaacatcatgggggcagccgaaagccccaacctatcggacttcttcccggcgctcgccgccgccgacctgcagggctggcgccggcggctggccgggctgttcgagcggctgcgccgggtgttcgacgcagagatcgaacatcgcaggcgtgtcgtcggaaaggagcatgggaaggtgaaggacgactttctgagggtgctcctgaggctcgccgcgcgcgatgacgacacggcaggcctccacgacgacgcgctccagtcaattttcacggtaaggacatactccctccgtcccataaaaccccattcctaccatctgtggcgaatccaggcctatttcgtggagtcgactgacccacaactttttaaaaaacatcgtataaactttgattttcatgtataaattcaaaagaatttagagaaatgaccccacttaaatacgaatcattagtaattaacccagaagcttaaatttttagctccgccactacctaccatctcaagaagagattagtgaagagtaaaaaattaaccaaaatacgtctcattattgaaaaaagtagtaatgttgatggtagataaagggtatttaagggagaaaatttctcgtcttatgtgccgaggttagatagaatattagaagttggtttttttgaataaaattcaaatttcagaagttgagttattttaatggaggaagtacatggtatttcctctgtccaaaatataaaagcctcgatttttttagtgaatctaaataatctatcgaaattaatggtaaatgtctcatcgaattttatgacgaagagggtgttcagctttttatgtgctgaaacgtctggcgagttccattatagctagtgtaggcaaccacaaacagcaatagttaaattaggtttgctgtcgatgtcgcatactccgttcggttttattttaattgacattttggacaatgatacggtctacaaagataatatatctttgaccttatttttctattataatatatacaataaataaatgcatgtataattttattatagtgttttgaaagacaaatctatatatgttgttctagtttttttaaacaaaatatttttaaagttattgatggtcaaagttataaaagtttgacctcaaccttgtccaaagcgtcaattattatagaatcggagggaatactcgttccttttttagccgatactgttgttaacttattattgggtttagtcccgcatcgataattaatgatgatgaagcataacataaaagatagggggtagtccttacctatcagatagtcttttgggctgtgtaggtccagaacttaaagttatggctttgattgggtctgtggtggaacaggacgatcatacatcaccagtccttaactttttcaaatcgttcaatttacattccttagttcaacatcttagttctaagaaatacgcatgtagctcggaaatcttaattccgtatctcttcaatat

SEQ ID NO: 88840 - DNA, 1767 bp, Oryza sativa
agcggtacctattgacaggaatccgagatggcccccatgaaccgtttattgcagactcagtggattttgttgtgagtcaggtcaggatcaactgtaaacattttatttgatgtttgaactaatttcatacatgttataaatatgagcattcaaactttatctgaaattgtaatgttaggtattgctagttagatgactactctgtgcttgacaacgcattgttactcagtgttgctcttctattttactgggcttgttattgttgttaacaaattaaaatctaaattttgcatgccaggttgagacgctgtcaagagatgatctctcatcaaggttgatgttaaatgttaatgttgcatcagttggatcattaatgctacctgattcactcatcactataatggatgtaagttacctcgacccaaataatacaagtgattctcatgtgtttctgtttatatagggtttatttattattattttccattctattgattggctgcaccagttaagagataatctaaggctagcatggtattaagaaggaatgattcttaatcagtatgtcatgtgtaggtatgctgggagataagcatgctaaatttttgtaccttagaagttacaatcaagtatgaagttgaaatcatcagaaaagggtgcccaagggttcccattatcagagaccttgagcatcccagtgtcccttgaatgctaactgtgtgtgttgaacatatttgcacagacaaacgactattccgctgttcctcagcagttaaaggaccaagtgaatgaaaggtacccaggtgcaaggcgtgcagtactaaagacgggtggtgatttccccttcctgtcacgtcctgatgaggttaatttgtaccttcaggtattgtaaacgcttcttctgcaatctttcagttttgaaggatttatgaatgacaattttgaaaacaatggcagctacatttgagacgagttggagtagaacctagaccagatctggtccaaggtttcacacgtaatggcagtgctgggagctcaaaggaccaaaaagatggtggaaacaattttgacaatcatcctggagataatggtggccctggttcagggggtcatgatcatgagacacagaattctggatcagaatcacatgattctgatgaatcaataccaacgagcacaatgcttgccaataccattctaggtacggttagctcaaccctgcaagcttcactatgtgtgctcttgatacatcattactatgagtctgctttgtatatttcgtcgagacagccattggatgtatgaagtagggaatcaccccttttgcccccatgtagagctcgctttgtagaatatcatcgtggtacgagtgtcatagcttctttggagtgggttcttacttcgttgctgccaacgggaaaggcacatcaacaaccaggaaaacaacttctgtatgtttgtatattagctcttgtttctttatcaatccttctttttgtgtttctaggcctgtaaattgaatttgatctgcctgagacatgaatatgattgcttaattttcttgtagttgcaccataaaaagttgcgtacagtttcatgatttcatccaacttatttttcaccaattcatgattgttatgcctattattatatttgattgccatcaacatatctatcatgaacagatcgtgccaatcttcttgtggcaatttctgtacatggagggataatcagattcagttgaagtatctacctttgctatttctg

SEQ ID NO: 88841 - DNA, 3508 bp, Oryza sativa
gccacaagccacgccgttcgccgggctactgcgcacgcctccaccatccccacccgccccccgccagatctcgccgcggttcgctgacgggatccatggcggcgccggggagccacacccgccgccgcgcgtggccgctgctgttcctcgccgtcctcatgttccactcgctcgccatctacctcttcacccgcggcttcctcctcacccgcaccgagctcgacgtccacagccaccgcgacgaccgcatcggcatctccccgggctgctcctcctggcccccgcccgccgtcgaccgcctcgtcatcgtcgtcctcgacgccctcaggtaaaatcaccacccctcgaatcttagattccccaagagagaaattaaatctcttgttggctactgcgattatactcagtgttgggttaccgagaaagtaggataagtttggagctgacacagttgtgcaatgcactgtcctgcaggttcgattttgtggcaccaagtacattctttcaaggtgatttactccttttatgtattactataatgctcaacgtgtaacatgtgagaatgtgatttgtaactctgagatgaggccatgattcgctgcagagaggcaaccatggatggacaaactgcaggttctgcaaagattggctgctgatgagaagacctctgctaggatattcaaagcgcttgctgatccaccgacgactagccttcaacgtcttaaggtgatcaactctgtttctgttgttgttaatccagatattcattcattcatcaacagagttaccctgaaaaattgttgtcctttcctcaattcagtgcagtataagattatcgcattatatgcattcatgaattgagttgacctgatatgctctgcacgattcagtgcaatcaaatggttgtaactttgtgtgttcttcaccccccaggctttaacatccttgctgtaaaattctatactcaggctctgacgacaggtggtctgcctacatttattgatgtgggaaatagctttggagctccagcaatagtagaagacaacataatgcatcaggttcttgtcacaatctcatcttgcatctaacattacaaatatggtgtcagtaaacttactcagtttattctggataactaaccgtggaagtatgtgttgcctattgtttctttgtactcaatcagtttgccaaaaatggaaagagggtcgtcatgatgggagacgatacttggatccagttataccctgaacatttcaacaagtcatatccttacccttcttttaacgttaaagatcttgacacagtatgtcatatcttttgtaccattcttttccttgttctgcagtgcgagtttttttcctcccataaattttccatgaaattaccagtaattgtatttatcgtatatatcaggtagacaatggtgttattgagcacttgcttccatcattacacaaaaatgattgggacgttcttattgcacatttccttggcgtggtaagttattgtgcattctcttatgccttagcttaaaaatttaatccttttatcctgtccgttttgaataaagaacatgtgagatcaacttcctttaggaccatgcagggcatatattcggtgttgactctaccccaatgatccagaagttggagcaatacaatcggatcctagaggtcagtcacctcatgcacaaatatataatgtggctttatgcttacctgcttatcattcttttaaatttgacctcattatgttctttattcccatatgatggccatattaactatgataatcaaatgctgctatatttaactcatacaggatgtaattgacacattgaaaagtctatcaacatcgggtggtccccatgagaatactttacttcttgtaatgggggatcatggccaaacactaaatggtgatcatggtggaggaactgctgaagaggtgatctatcttatgttttgttgctaaatgctgaagaggaacactaaatggtaatcatgtctacataactaatgctgttactattataggttgaaacatcgctctttgcatggagtccgaagaccccaccaaatgctgtcttgtctgttcttggtaaaaatttatgcaacgctgatctggtacattttcttatcctatatgttctgctaactaattatgatttgagctatcttgccatgtatggcgataatgttatgatcaggactaagttttcaaacaattataattaatattcattggccatattataacctgagttacattttttttgtctagaacacttaaactagaattgcgtacagaagatatttttctaatcccttgcttccatattgaatgccttactgttgtatatttggtttgacatctaaaaccgtagggcaaagtgattgactattttaaactctactctgactgtgttatgcatggctatgaagtactgcatgcagcgttttttaatgaaaagagtgggaatgagggcctgtagattttaggaatgtaaatttgaaataagcagtgattgatgtaatacagtttttggccaagatacatgttaatcgtagtacattttgtttagccagattttgcttgcttttatttgtgactgtagtaatgtgcctactaatcacacgtttatttcttttctagcatggtaaagaggtgtgcgtcagcactatgcagcaggtcagtgctaactgcattcttttatgttgatggcttatatgatcaatattgcttaatttttctccttgttcttagcttgattttgcagtaactatagcagcgctacttggtataccttttccttttggaaggtgtgtacgctttacttggtacttgcttgtttctgttgtttgcagtgtgtgctactatctggtttgactagagacactatctagttgcttttttttttcattatatatactgattcgacttgattttatttttcaattgctattgtccctacatccttccatagttgtagtacttaattcagtatatttacgaaatgtgttctattgtgccatatctagcattggacgtgtaaacccagaattgtatgctctgagtgctggaacatgggataatcaacagatcggtgccaatgattgtacacagcagaatgatctagaagcatggatgcggagatatgctgaagctctctgtataaattgttggcaggtaatatgaaagttcatttgtatttgtttggttgggtggattgctgaagctctacgctgattttcagttaaccctcataggtaaagaggtacattgatcgatattctgccacttctgttattggatttcgagcagaagacctgaaccatgttgcagatctgtattcaaaagctcaggcaaattggtcctctgtcctgaggtctacatgtccagtggaaacaagcagtcaggatgaattaaaggagtgcgcaaataaggaatgcacaagttcagctctgcggttgcaaattgatgcatactctgacttcttggagagctt

SEQ ID NO: 88842 - DNA, 562 bp, Oryza sativa
tttgcttgcccgccgccattgccgttcctctttccccgacacggtgctcccacccagccggctctccaccattggatgccagcgctgccgctccctaatgccagatgccaccgccgccgctacccgccgtcgtccccactgccgctccggtggtgaagagaaaggtcgggggagaaaaagagagaagcgagagatagaggggaggaggaagaaacggaagagagtggttgttcatgtggggcccatgtcacgcccagaaattcccgaatagaatttcaagcagaatgtgcattaaaatccccgtccaggaccggccggggtacacaaacgacaatgttgacatccagatccacgtcttacaaacatcataaaagtcttacataaatgcagcggaagaaaagaaagacaacaggagctaagccttgactaaactgcagcgggaacaccactccacaggcatcctcgacggcacggacgaagcctactcctcggagaaaccttcatctgacccgaacttgaactctggggttgggaaaagtagagcaagactgagtactaccca

SEQ ID NO: 88843 - DNA, 666 bp, Oryza sativa
gagcgtcaattgttcgggatagaggtattagtggaagcagaagagaaagtcagaattatcagggcacggttgaagattgcccagtcttgacagaagagctacgcggataaccgtcgaagggagctcacttttgaggcaggagattacgtgtatcttcgtgtcactccgctccggggagtacaccgttttcagacaaaaggcaagttggcaccacgcttcgtggggccatacaaaatcctggaacgaaggggggaagttgcttatcagttagagcttccatccaatatgattggcatccatgacgtgttccatgtgtcccaactaaagaagtgcttaagggtaccggaagaacaggctgattcggagcacattgatatccaggaggacctaacatatgtggagaagccggttcgtatacttgataccagcgaaaggagaaccagaaacaaggtcacccggttttgccgagttcagtggagtcatcattcagaagaggaagcaacctgggaaagggaagatgagttgaaagccgcccatccgcacctcttcgccagctcctccgaatctcggggccgagattccgtttaaggggggtaggtttgtcacaccccgaagttttcctcccaagccaaaattgtaatttttataaatgaccctaagaaaata

SEQ ID NO: 88844 - DNA, 2654 bp, Oryza sativa
tcaccagaggccgcgcttcactcccggacagcagggtggacctaccaccatgatcgtccgccagtaccgcccgttcaatcctagcaactttccccagggctctagtggcagtcagaaccaccatggaggtcaatccaaccgcggtgcagctccacgcccaccaatggcaccggcacagtcaggcccgtccgcgcaagctaagaaggagactggggcaaaaccagggtcctgcttcaactgtggcgagcttggccacttcgctgacaaatgcccgaagcctaggcgtgccgggccaaggtttatccaggctcgtgtcaaccacgcatctgcggaggaggcacaagcagcaccagaggtcgtactgggtacgttccctgttaactcgatccctgcaatagtactttttgattctggtgcgacgcattctttcatttcaaagaaatttgtcgggatgcatgggttaataagagagaaacttagcacaccgatgcgggttcataccccagggaatagctccacttcggttcaattcagcccttctataacaatagaaattcaaagatcaccatttctagccaacctcattcttctcgaatccaaagatctagatgtcattcttgggatggattggctgaccaagttcaagggagtcatcgattgtgcgaatcgcacagtcaccttgaccaacgagaaggggaaaacggtagtgtacaaatcaccagactcaccaaagcaaggagtctccttgaatcagattgaagcggaaatcccagtggacaccgtggagaagaatttgaggaaattggaagacatacccatagtctccgagtacccagaagtgttccccgaagacctcactaccatgccacccaagagagagattgaattccggattgacttggcaccgggaaccgctccaatttacaagagaccgtacagaatggcggccaacgaattagccgaggtcaagaagcaggttgatgagcagctgcagaaagggtacattcgaccaagtacttcaccgtggggtgctccggtcatttttgtggagaaaaaggataagacgaagaggatgtgcgttgattatcgtgcactcaacgaggtcacaatcaagaacaaatatcccttgccgcgaatcgacgatttatttgatcaactgaaaggagctaaagtgttttctaagatagacctgcgatcaggctaccaccagttgagaattcgggaagaggatattccgaagacggccttcaccactcggtacgggctatatgagtgcacggttatgtccttcggacttaccaacgcacccgcattcttcatgaatctgatgaacaaagtgttcatggaatttctggacaagtttgttgtggtgttcatcgacgacattcttatctattcaaagtccgaagaagagcatgaacaacatctccgtctggtactcgagaagttgaaggagcaccagctatacgccaagttcagcaagtgtgacttctggatgacggaagtcaaatttctgggtcatgtcattacagctcagggtgtggcagtcgacccatcgaacgtagagtcagtcaccaagtggaccccaccgaagaccgtgtcacagattcgaagttttctaggactggcaggttattaccgccgattcatcgaaaacttctccagaatcgcccgacccatgactcagttgcttaagaaagatgagaagtttaaatggacagctgagtgcgataagagtttcgaggagctcaagaagaaattagtatccgcactagttttgattctgcctgaccagatgaaagacttccaagtctattgcgatgcatcccgtcacggacttggatgtgtcctaatgcaagagggcagagtggttgcgtatgcctcgcggcagttgcgtccacacgaaggaaattatccaactcatgacttggaattggcagcagtggttcatgctttgaagatctagaggcactatctgattggcaaccgctgcgaagtatatacggaccataagagtctgaaatacatcttcacccaaccggacctaaatctccgacaacgaagatggttggaactaatcaaagactatgacatgagtattcactaccacccgggtaaagccaatgtggtggcagacgcattaagccggaaaagttactgcactgccctatgcatcgagggcatgtgtgaggaattgcggcaggagtttgagcatctcaacgtgggagttgttgaacatgggttcgtagccgctctggaggcacggcctacgctcgtggatcaagtcagagcagctcaagtaaatgattctgaaatagcagagctgaaaaagaacatgagagtcggaaaagcccgggattttcacgaagatgagcatggcacaatctggttgggagaaagattgtgtgtacctgacgacaaggaactgaaggatctgatactcaccgaggctcatcagacccagtactccattcatccaggcagcaccaaaatgtatcaagacctcaaagaaaagttttggtgggtcagcatgaggagagaaatagctgaattcgtcgcactctgcgatgtttgccaacgagtgaaggcagagcaccaaagaccagcaggtttactccaacctcttcaaatcccggaatggaaatgggaggaga

SEQ ID NO: 88845 - DNA, 5849 bp, Oryza sativa
  unsure (1)..(5849): unsure at all n locations
cgcgtgccattgaattgactaacctcgttgccngcacgncgactctagaggatccccaaacccattaccaatggctaaagcatgcgatgaactgcaacgagttattggatccacaagaagaattgaagaatctgatattggtcgactgccctatttgcaagctgtcatcaaagaaacatttcgattgcatccacctgttccatttttattaccacgtcaagctacaacaacaattcaaatattgggctatacaatacctaaaggtgcaaaagtgtttataaatgtctgggctatgggtcgagataaagacatatggccagaggcagagaagtttatgccggagagatttctagaaagggcaactgactttaaaggtgcggattttgagctcattccattcggagctggaagacggatctgccctggattgccattagctgttaggatggtccatgtggttcttgcatcactactaattaatttcaagtggagactcccagtcaaggtcgaaagagatggagttaatatgacagaaaagtttggtgtaactctagcaaaagccattcctctatgtgctatggccacatcaacttgagttagaagccaggcagccacttcactggactgctcaaaaacattgtatcaggtatgacaatattttgctgtccagtggtctcttttaccaatcatgatggaaacggattgtcaggtttctctgcagttgcttcagtccaaggagaaggataggtctgatttggcatatgttatcaatgcagtcaaggatcttatgggcggtgacagggaaattctctttagtaaagtctgtcgtagtcaaaaccgggttagccaatgtttagcgaataaagctcggtgtgaatctctgtcaggcctgtggccggataatagttgtaatttcatttcatggttagcgaataaagctcggtgtgagtctctgtcaggcctgtgtttgagtaatatagatccttttccccgaaaaaaaaatgtatggcaatattagatgattaatgtggaatattgtaataaatcattacgtgtatttgtggggatatattgttccaataggataaataagctgagatttggatatttactttttcttccacttgctaggaaagcaaaaaacaaaaaccacaagaagatgaacacgacattaaactaattgtataagtggaacgacacggcaaaagaaggccaacatataaactatacagtgtagctctgaatattattttttacaagattaacaggcagctctgaatatttttcgagattaaagtgtgcacatagtccttaaacttattcaacattctaatctatctccccgtactcttaaaaaacggatttacgtatcacaacttgttaaaatgcatcattccgttttgaattgccataacttctctgcgattctacgtggggttgagatgacatgccacacaaacactaaagtggtatcatcactaagtctacactaaccgacaaataagacccgcctagaaaatttctttttatttttttccttctatgttttttcctttctttttcatctcctttttctctcttcagctgcagccgccaccaccgccaccaacctcaccatccttccttctcctagggtgaggaaatccaagtgtgaggaagcccatgttatgcccaccaccgcaaagctccacacccccgccaccacaaagcacggcctcaccgattatgtcgctagttgtgataatgaagcccacattcaagataacaagtggccacctagctgagctcgagaatgttggccctcggtgcgcgctcggttgattggcataagtccgtcgacctctgctgcctcagcgtactcggcttggtgcctaacgagcatctcctgctccagtttgtctatctcctcggtcgtcatggcaaccttcgactgtagccaccagagctcatcatgcccgctgcctatctcaccattgccgaacacgaaagtgtagaaaccctagctcaaccgccagagagaaattgctaaatctgtctgtaccgttggcctcctccaaaactaaaggtacaatcactttctttataacacttccaccgtttcccatctccttcccattgtaactgttgttgaatctcacctaatcatcgcgaggccgtgtcagggggctccatgcatgaatattttccatgtcactcgtccatgtcagcgccggagacaagtcagacacgtgggtcaccctgtatttctcagtgattttgcaaaagcgccccactcttattcacattttgtttttttttctcacgatgaatcagtcacctgaggaattgagggcaaaggtgaggtggagtggttgcctgcctgaggaatcaacaacgaagtaaaggacgatggcaacttggcgatgccttgaaagtggacaacggaaatatcgctccactgagtggcgttgacgtggccaatgtggtggtgtcacatatagcctacaagcagccagtaggcgcacgcatgggcggggattaccaggaggccggtggggaggtgcccggtagatgaaactgaccaggcggctgcgtggggcgtgcttcaatgtgcttttgctgaactagtggtcggagtcgaattgatcgaacaggcaatctctgaatcttcttttgatttgcgaagtaggcattggccagaatctttttttatttattcctaattaatacacgaatcataattacctctaaatttattcctagttttgaataaactagcagtatatacatatttctagatggttaattctatttattttgaaagatacttttaacaccacaaaaaattacttctatttttctagagagttacttcatctaccaatatagctacttctgaaactgtgaagaattacttttaataccgtgaaaagttatttcgattcttctagatttagagtgaagagttagttctatttttatttttcttgattcagttatttttctttagtaatgtacttctaatactgtaattattttcttaattctataattattttcttagagttatttgtcctttgctctataggtacttttaatatcatcaacattaattattttcttaatactgtaattattttcttagagttatttttccctaggtatttctaatatcgtcaacggttactactattctcttagagttactttcctatattatgaaaatatttttttcaaaaaaaatatattttaaaataaagataataattgcatttactcgtgaatgttgtcaacattgtacttcacaaagtttcttatttcaaaattgtccttattttcaatgaaaagaagtaaattacttttgaatgtttaaatatatttaacattgaactcgttttgtcatatattttgaatggagagctatactttaaatggattttacaataatacacgatttaaaaattataaatcatggaaagttgaaggaagccataaaagaaaggagctagtgaattggttggtgttagggcatgtacaacctaaggcacgggtagtagtagcctcatgtgggccataccacctaggctacacaaaggaatctctgtctccaatggaggatacactcaaataggtcctataaaatcaaagggtactataggaagatattacatcccacaatgggtgttctagcccacaaaaccaccagtgttgttttactctcctaattttattcggcgatgcctccgactcatctatttccacctctttctcgtcgcctctccacctgccccagaacgccgcctctgacttcgtcggttcgccccaccgcgccaccgatgacttcgccacactgcgccaccgctgactccgccacaccgcgtcgcccacaagcttccgccgctctctctctccctctctctttcaaagtgtgggagcagcggcggcgaggcccacgaggagcacgagcaggaggaggacgcggcggccgcagcagcggcggcgaggcccacaaggagcacaagcaagaggtggcggagtgagatccagtcggtcttcttctccaagtcgtcaccgtctctctctcccttcgcccgtcatcgccggatctggtaggtcacgcctcctactccccaccgtgctaccgccaactccgccccaacacgccgctgagggtgaaaggggaaactaccactgcgagagcgggaccacaagcgcaaggcttcgccacatcatcacccaacgcgaagccccaagctgtggcttgacgaaaagtagtcgaggagcacgtcccaaggagaggaggaggcgaaaagaagtcaaggagcacgtccctcacaaagacgtcgtggctctacgctggccgctggggaacacctccagctcgaaaaggtacggcatttgaacggcgtcgccagggataggcccttggccccatatccccatcacataaataggcatcctgtggaaggttagtagattgttggtgttagccccatgccccatcacataaataggcatcctgttccacactagagcttctcgatacagaagatcacatgtgcccggtacaactaagaaaatagctataggccgtgtttagtttcatttaaaaaaaataaaaatttaaagtatactgacacatcaaatgtaattagactcaagatgtgcaattgattttattttcaccatgcatacgtcaaatatttaatgtgacagaaaagttaaaaatttaaagggaactaatcacagccataataacaaaagccatactctctgtattaaagatccaacaggttcagagaacacgcaagctcagaactacacatcaccaaaattggagcaagtttgggggtacatatccgctcatacagtggaggatttatttctcgattctacgagctttttaactagagttcgaccgggaagtcaattacggatagaaatgagcatcctgtcttcaccatcaagtttagtagggctccacgggtgcgcggaacttggcaccagcgtagacagcagccgcaccaagctcctcctcaatcctaagaagctgttgaaataagaaatagcatgaattagtataataattttacccctttttaatgactagcttaagcatatgcatggattcgttaacgcctgaacaaaaatatgcatgaattagtggacagtattaactgaactacccattaacgcatgaaagcatctgagaacaaaaaaaatcatgcttgggctaaagtaatcattcaagtctttcagatctaaacagcacgtaagaaatgcagatagaggttggctgggtcagctgattggttttatacggtacaaaatatgaaaaactacttgcctggttgtatttggcaaggcgctctgatcggcagggtgctccagtcttgatctgaccctgtttcagaatgacaaagatatattcagccctcacattcagtacaagagtaacaactaatacaggatgccgtaaagttcactacagtgaatgtagagcacagaatcttaccgtggccaaaccaacagccaaatcagcaatgaaggtatcctcagtctcaccactgtggcaatgaaacacaagtcaatatacaaatggttggtagtcagaccaggtccaccaggaataaagacaggtaagcatatcagtatacctcctgtggctggtcatcacaccccagccagcacgctttgacatcttcacggcctcaatactctcagtgacagatccaatttggttaacctgttgaaagacaagggtgatatattcgcacatggaagataaactattaaacgtgaaggaaagaatcaataganccataccttcagcagaagagcattgcatgacttctcctggattgcctttg

SEQ ID NO: 88846 - DNA, 853 bp, Oryza sativa
  unsure (1)..(853): unsure at all n locations
actgtcagtctttctgggtttaaggtgcgtgttttggtgtngnctnngtnncatacncttttntttnnntcttnttgatgatgtgtatattttnttnnnntnnnnnnnnnnnnnnnncagttggttgattgcacatcgtattnnncnnnncnnnnnnnnnnnnnnnnnnacacccnccnncnnnnncccnnnnccnnnncacnnnncctttaaacagtgtgtgcntcccagtcnatctttgttttttaatcctcccccccgaccccggggggggattgcccataagggtttcagcggggtttcagccggggaggcatctagacgttgcatcggctcataaggattgcctatacatataagggggatttaaccgaagggaacaaagatattaccgggcaatctaatcttggggatttcatgacatcggacctccagccgatggatgctttaaccttcagaatagtgcttaatgctgttatatcaatgctagccgagtgggttatactggactatattggtattttattacatcatcatcaaccgattgcctttatatcattatctacattggatatattggcgattacttaaaccctatcgctatcggctggaactactccatcggcttgtcagccgatcggctgttttatctgctgattacatatcttgtcaggggccggatcaaactgactggcacgtccgcatctcatcaaactttggacctgcactggagctaagcagaacacctaggctggggtgttcgaatttttcgccaacagttacatgggaaacggtaggcagggtacaacgcaaataccactatggatggagtgaaattcacaattcaccacag

SEQ ID NO: 88847 - DNA, 2348 bp, Oryza sativa
cgaaattaaaataccaataaatccaatattaattagcacatggccgttttatatggtttcaaagtccaaataaataccaaagtcgtacataatttacgtatgacggaattaaatgttttcaaatttttactaaatagaaataaacaggatatgcctaagtaaatggtctcaaagtataaataaatagaaataatcatttataattaacataaggccaatttaattatattcagagtgtaaataaatagaaattatcatttataattaagatatgacctacttaattgttttcaaagtggaaataaataccaataatcagttataaataacatattgcctaattaattgtattcaaagtgtaaataaatggaagtaaccatttataaatatcatatggttgaaaaatagtaatacattacaaattaatcagttgtgaataatatattgatccaaattgttcgaccttcaatacaatacaaataatttacatcttccatcaaccaacttaggtcactgttttactcacgtactttctcctcactattgttccttcgctatgatcgttgcgtgagtacggcgtgtcctcctttgatagtaagatgctcggagtcaaccgtcactgcaaacggaggttgcccctcaaacagattgtaattttcgtcagtcttatcctcgactccaacgattttcctcttgcctaggagaacaacatggcgttttggctcatcgggccctttccccttctttggtttgctatccatgtccttcacgtaaaaaacttgcgttacatcattggctagaacgaatggttcatctgagtatcctaccttgtttaggtcaaccgttgtcatcccgctgtcatcaatcgttacgcctccaccagtcagcctaacccattggcaccgaaacagagggacctttaggggtctatactctaattcccaaatgttgtcgatgacaccgtaatacgtgctagttggaccatcgtgtcctatggcatcgatacgaacaccactgttctggtttgtgctctttctgtcttgggctcttgtgtaaaaagtgtatccattgatttcataaccttggaatgtagttaccgagccggagggtcccctagccaagaaggctagttgtcggtcaatcgtctcgttacccaggaggtgttctcgcagccaagcggggaaagtatcaatatgatggcgtgtaatccaggtatcggacttgccactgttttctgagcgaacaatcgcaaggtgcttatcgatgtaaggagcaaccaacgaagattgttgcaaaaccgtgaaatgtgctttacggaataaatcgttgtctacagtcataattgctctccttccaagtgtgccctttccccgtagtctcccctcatggattgattcgggtacctcgattggctcgaggtctttaataaaatctacgcagaactcaatgacctcctctgttccataccccttcgtgatgcttgcttccggacgagaacggttacgaacgtacttctttagaacgcccatgtacctctcgaaaggaaacatgttgtgtaggtacacaggaccgagaataccgatctcttttacaaggtggcacagaagatgcgtcattatattgaagaatgacggtggaaagatcaactcaaagctgacaaggcattgcaccacgtcatgctgaagggcggctaaactttctggatcgatgactttctgtgaaattgcgttcatgaaagaacaaagcttcgttattgttgcctgcacattatcaggaaggataccacgaattataacaggaagcagctgtgtcataagcacgtgacagtcatgagactttaggtttgtgaacttcttatccttcgtgcttattattctctttacattcgaggagtatccggacggtaccttgatgctctctaggcattgaaacatactctccttctcttccttgcttagggtgtagctcgccggacttaagtaatggcttcctttctcgttcggttccggatgaaggccctcgcgttgttccatatgcttgagatcattgcgtgcttcgagtgtatctttggacttgccatatacacctaagaagcccagcaggtttacgcaaaggttcttagtgaggtgcatcacgtcgattgcgtggcgaacgtccaagacctcccaatagggtagctcccaaaaaatagagtttttcttccacatcgccgcgtgaccatcttcgctttctataggttggctgccaggcccctttccaaatactactttcagatccttcaccatttcgaacactgctttcccgttgcgatgtttagggggtacgagtgaatatcaattcaatgcgcg

SEQ ID NO: 88848 - DNA, 779 bp, Oryza sativa
  unsure (1)..(779): unsure at all n locations
acccttattggcaatcaagaagcaggctagagattatggttctaaacacgacttagtagatcaaacttanctgatgcagcnctaagtatgaaaagaaacataatatctaggtaatcaagccgttgactgagttttcagggtggtagatgtctaagctaatctaatctagcaacgcgatttagccgataccggcagaaaccctaaaacgaggagcagccgatagagctaaattgatatgctaagactagattaacagagacatatgataaataggtaggcaaatatatcatccaaactagagcaatccaagaggttgaatgtactgatgcagccttgaacgacgacgacgtaaacgatacaattgcctgggccgacggaacattagacttacctcttagctggagatcgaacaccgatgcagccccgcgtcaggtgccaagtcccgccggacgataaaataaagtagaaaaggtaaaaggtggcgatgcgccgaattgtaatgatcgtgaagatagtttacaatgactctgagtgtacatatttatacccatgggtagatactagtccttgtaggacaagaaagaaactttcctaaagataaaaggaaaacataaagtccttataggacactaaacacactttcctaaagataaaaaggaatctaacaaactattcctaattaatagatacaactaacttcttcggactcgatcagtacgtggcaatcatcatgaagcacgtcaactcaatccgacaatgattacaatatcaccttgcca

SEQ ID NO: 88849 - DNA, 2103 bp, Oryza sativa
atatttttatccttagtacctaagtatctatactaatatttaaatacctttacatagtacctgtgattgagaactgttggatctttacccttttggaatgcaaacaccgtaaaagttctcgaatgataaaggaggaagacaaacccattaggcaatcatgggtacaaacttcagcatatatattttagttttgtaattatttgcaacagagatataaatctgcaatgatatgttctatatattttttctatcctcaagactactaggtacaacctaattaatagaggcattggttcttccttttaattataggtaaaaaatcaggcatagagaagcgatacatccaccttgatgaggagatcatccgtgcccatccagagatcattgacaaacaccagccctcccttgaagctcgtgttgaaatcgccgccgccgaggtcccaaagctcgccgagtctgctgcaaggaaggccattgccaagtggggccgtccagccaccgacattacccacctcatcttcagcacctactctggatgtcgtgcccctagcgctgacctccagctggcatcgctccttggcctccgtccttctgtctcccgcacaatcctcagcctccacggctgctctggcggtggcagggcgctccaactcgccaaggagcttgctgagaacaaccgtggtgcacgcgtccttgtagcactctcagagctaaccctggtatgtttctccaccccagacgaaagcaaaattgtcggacatggactgtttggggatggtgccggtgcaataatcgttggcgcaggcccgttttctgatggcgagtgcccgttgttcgagatggttgctgcctcacagaccatgataccaggaaccgagcacgcacttggcatgcaggccactagcaccggcatagatttccacctctctgtccaggtgccaatgctgatcaaggataacatccagcagagcttgctcgaatccttccaatcggtcggatacacagatcctgactggaacaatctcttctgggcggtgcaccccggcggccgtgctatccttgacaacatagagggcaagctacagttgcaaccatggaagcttgcagcaagccggcaagtgctacgcgagtttgggaacatgagtggtgcaactattgcattcgttcttgatgaactatgccaccgtcgggagaaggacgaagatgagtcacagcagcatgaatggggagtgatgctggcctttggaccagggatcacaattgagacaattgttatgcgcaacccattggcacgtggtcttaagcaaaattagttaccactgtcatgaaaataatgcaatcggaatcatctgatgcttcgatatttcactacactatggaaattaattaatgggtgacactgaatcaattgtttatgcatgcttaagtattctcaactctactacatgttgtaaataaacttttatcacttccatgtgtcctctgattcataagctttattgatttgtaacaaaatttggaataccctgtgtcatgtgtatgtataattaaaatactacctctgccaatgccctggtaataaaaagaacaataattacaacacaggttacaacatcggaatttataaaatatttatgctgaagtttgtacccatgattgcctaatgggtttgtcttcctcctttatcattcgagaacttttacggtgtttgcattccaaaagggtaaagatccaacagttctcaatcacaggtactatgtaaaggtatttaaatattagtatagatacttaggtactaaggataaaaatataattttgttaatagagaaaaagggtaaaattgttcctacctccaaattatatagataccacggatgttcaatatggcgaggtaagctctagctgttaccgacatgacttatttgcctttaatattgtgagatttcctgagatttacaatgtggctgaggtatggcaaaaaaaagacactagtgacacatgtgcttaaatcactttctctagaggtaccttcttggaatctttgatgttctcttttgcgggatatttttagaactacatattgtggtcttataacatggttct

SEQ ID NO: 88850 - DNA, 1915 bp, Oryza sativa
aggatatgaaaaaagttacagatatgttactgttgacgaaaaaattgaacacaccggcctgggagatttgctaagctcatgtgcaggtccaaatcttagtgagatgagggcgtgccaatcagtttgatcctacaactgacaagatatgcaaatagtagatcaaaacagccgatcggctgacaagccgatggaatagttccagtcgatagccgataatagccgatgccgatgccgataccagccgatagtgatagggtttaaacaatcggttgtatgtctaatgtagataatgatatgaagacaatcggttgatgatgatgtaataaaataacaatataatccagtataaaccaatcggcaaataatgatatgataaataagcatcgatctgaaggttaaagcacacatcggctggagttccgatgtcatgaaatccacaagattagattaaacagtgaaacctttgttgtcatcggataaatccaacttatatgtatatgcaattcttatgagccgatgcaacatccagataactcaccggctgaaaccccgatgaaacccttattggcaatcaagaagcaggctagagattatggttctaagcacgacttagtagatcaaacttaactgatgcagcgctgagtgtgaaaagaaacataatatctagacaatcaagccgttgactgattttcaaggtggtagatgcctaggctaatctaatctagcaaggcgatttagccgataccgacataaaccctaaagcgagagacagctgatagagctaaattgagatgctaggactagattaacatagacatatgataaatagccaggcaaatatattatccaaaccagagtaatccaagaggtcgaatgtcctgatgcagccttgaacgacgccgacgtagacgatacaattgcctggaccggcggaacattggacttatcccttcgctggagatcgaagacgatgcagccccgcgtcgggtgccaagttccgtcggaacgtaaaaacaaaagtagaagtaaaaaagggtggcgatgcgccgaattgtattaatcgtagcgatagattacatagaccccgggtgtacatatttatacccatgggttgatacaagtccttgtcggacaagaaagaaaccttcctaaagataaaaggaaaagataaagtccttataggacactaaacacactttcctaagttaaaaggaaactaacaaactattcctaattaatagataacttgccataccgtattctctttgaactcagtctcttctgcataagcctccttaagtagatcaatttccttaaccgaatatagtaagaatccgataactgacgacttgacaactctcatcggctaatctcaggacttcgaagccgatgctgactctaagccgatgactactccgggcttaccaaatttcactattaacagtcaccctttttattcagctatctagtatgtgttttgcgtcgtttgtgacagatcgagatgaagagtccagtacactgctgcacaaacccttttagtcccagtttgcaaccccctatagtcccagatagcaaatcggggatacgaatccgggactaaatatcgctatctttagtcccggttcaaatattcgggactaaagatcaatctttagtatctttagtcctaccaaccgggagtaaaagattttttttctttttatttccattgtttttatgctgtttgcacctcgactatcaccgtcacacccaaatccccacaaatcatacataatcatccacaaaaccatcaacaaatcatacacaatcatccacaacacatgcccatccacaatccacaaatcaatcacaaatcaataaaaaataactacaaatcattcattacaaatgggtaccgagctcgagtaactaccat

SEQ ID NO: 88851 - DNA, 673 bp, Oryza sativa
  unsure (1)..(673): unsure at all n locations
ataaggtgnacactgatgacacaagcagcatcgacttcctcaagttcttgagccaaataacgcgctagataattatgtgcaggcaaaggactaccaggagggccagagagagatgttccatgtcttcgacaaggactagaaaacaacttcatctttgccaccgagcctcgccacgttatgtccaatgcatcaagaaaggctcactgataaaaagggcgtccgaatgatccgcgaggctgatggtgacaggcggatcactacaaggagtttgtacttaaattcagaaaaaaataaaagaagcaatttgattaaaacacatacaaaaattataaaatcattaaaactataaaaagaaccaagattccatgtagaatataaaatatcaagagtccatataaaagtataagttataaatatatggaatttggaataataaaagaagtattaaaagaagaggggcggcggggagatctccgcctccgcggcggcagcgggaggcatcgccggagctagggtttgcttaggtttttgctgttctgattcgcaaattcgcaaagggtagaaaactgaattccaatctttcagtatccaagcgcctgttaaatttgatgctaaaaaaaacctggtaaggatttcttatatagttaacaaaatttggcagcaaattaaatgt

SEQ ID NO: 88852 - DNA, 1371 bp, Oryza sativa
cgcgccttgaaattccactctgtacccccctgcccagagcaactctaccgcaccagcgccaaccatgttactgctgcagaagctcaaggtgctccagatgtgattttgggtacgttccttgttaactcagttcctgcaacagtgcttttcgattctggtgctacacattcatttttatctatgagttttgcgggaaatcataggatggaagtagaagatcttagacgtcctttgatggttagtaccccaagtaatcaagcactctctttgcaacgtagcccctctatcagaatagaaattcaagaagtaccatttctggccaatcttaccctgttagaatccaaagatcttgatgtcatcctagggatggactggttagccagatataaaggtgtgatagactgtgccaacagaaaagtaactctcaccagcaatgatggtcgagttgtaactgttcatgcattgtcttctgagtctttaaggtcaagtctgaaccaaatgactttggaagagattcctatagtccgggagtatcccgatgtgttcccagacgatttacctggtatgccgcctaaaagggatatagagttcagaatagatttggtaccaggaacaactccgatccataagagaccttatagaatggcggccaatgaattagcagaagtcaagagacaagtagatgatttgcttcagaaaggatacatcagaccaagttcatctccatggggagctccagttatttttgtggaaaagaaagatcatacccagaggatgtgtgtggactatcgtgcactaaataatgtgactatcaagaataagtacctgctgcccagaattgatgatttgtttgatcagcttaaaggtgccactgttttctccaagatagatcttcgatcagggtatcaccagttgagaatcaaagaggaagatatacctaagacagcttttaccactaggtatgggttgtttaaatgtactgttatgtcttttggacttaccaatgcccccgctttcttcatgaacttgatgaataaggtgtttacggaataccaagacaagttcgtggtggtctttattaatgacattcgtatctactcccgaaccaaagaagagcatgaagaacatcttcgccttgcactagagaagctacgagaacatcaactgtatgccaagtttagcaagtgtgaattttggttgtctgaagtgaagttccttggtcacgtcatctcagccggaggagttgccgttgatcctagtaatgtggaatccgtaaccaactggaaacaaccaaagacagtttcagagattcgcagtttcctaggcctcgcaggatattatcggaggtttatagagaatttttccaagatt

SEQ ID NO: 88853 - DNA, 4498 bp, Oryza sativa
  unsure (1)..(4498): unsure at all n locations
agtcgcagtcccccggtctttgtctccttttaacagggactttgtggttcaaaatgcgggtggcaggagccagcccaaaaaacaagtagtcaattaggaagagaccgcgtaccaatcgttttatctggcgcgaagcgtttcggtttcaattcagggttaatgggtttttttcgattttttttcaataaaaaagtgggcgggtcgcttttttttttgtgtggtcccccggggccccccccacagtttggtaaccttagccggtttgttaccccattgcacagaggtgtattaggccaaacgcagggggttcccaagggctatgagcggatggcagcctagaaatccctaggggggggggacatagtggatcctgcccgctaacaggataagatagcatttgatctactcaccaatgtggtagtagcacagcatatagggcttagaccatcatgggtgttggccaggttctctggtttgtgtccctcngggttggttgtgaggggagcgttttagttattacgcaccttgggtgcggtttagcgctgccatatatatatatatatatatatatatatatatatatatatgtatgtatatacaaatatgtgtgcacttaagtaattagaggtcatatgcatatatatattaacaaaatatgagtttgcaagtaagtaaatatacacatatattaccataccaagtacacaaaagtaaatgcatgtgtgcatatatgaatatatagatatatattccaattcgttcggacgttgtaatctttgtttctgctactacgacttggtggcatcggaagaagaaggaccggctttatgaatagtcgatccatcgtaatagaattctcctgtgggatcaagaatatgcttgttgatgaatcccattatcttttcttgaacagcccttatgaaatcatcgtgggtggtgttatctatcaggtaaatcatctgttatttggaaaaaaaggggattatatatatgaaaccagtaagcaataattgacgaaagaataaatttacgtacttcaaggtcctggccagtcctgatttggtgtgctaagcagtgcatgtaatggcatacgtaatagccgcacaagttagtccccttttcctactttgcacactgaaagagaaacaacgagagatttagtatgcatatctgatttagaacaaagaagtgattcaatacaaaattggagctagcatgtactaaccggaaaattgaacctccgggtgagtttttcattccagatcccgcggaccaatgtacggaaccgaatccatgctctatttagagttgttaggaaggattaatttattatccgagacctagtagttatacaatgattcataatgacagtgcaatatctgacaatacctatctatcacttcgaaaatctttgcgaaagttttctctggtttatccattgaatcgtagacatgaactttggatttctcaagatcgaaaagaagaaggacccaatgaaatctgcaatttgcattacatgatacatagtatgattgtaggaactttgtaggaacaaaattgaagaaacaaaattgaagttaattatgattgtaggaactcacgatgtgttgtagggaagtagtatgaacctcttataatgctgttgcaccaggaaatggacgatattgtcctcggtttgtttctcatattgttgtatcatcagcgtgttcactttgcgtgggtccatgaatccagtattgaatttgttgtgttgacggcacaactgaatctccattctacaacggggaaaaggaatgtgtgtgagcaacactcaaaggaggaacaaaattgaactataaatagtacttacaaaatccacgcgttgagaatagagacgtcgagggccttcaggtggtataagtcgaagacttccttgtgccggatccaaataacatcttctccttggtaataatttgagtttcgcaccctagctctgaacatctctctacccatcgctgatttgtccatgtaccattgatggaaccggtacatctgtgtaggtagctctctgatcttatcaggcgtgactagcggttcaccgagtttaaacgtgtacatgaccggagccgtttcaataggtccgtcctctagcaactgctccatactcagtcccgtatctttcaagaagttgcatatctctagttgtgccggttctacgactaacggttcaacctcttgtcgtggctgttgccccaactgagggacttcctttccgcacttcactgctgaaggcttggctttaagagccttcctcaatgttcgatcatagtcagaaacttcgaccggtttgcccggttcggccatcttaataaagtgatcctgaacatccggggctatagggatcttcttttccggactacatggcttcaactgctccctaacttctgctctaacggcttcatcgagctcctccggagtcaagtcgtacgcccttttcttgagagcggggagccgtggctcgtcagatctagctttcttcttcggccttgatggtgcgggttcatatgggcgggaccttgacggtgtagacttggcagcaggtgcacgcggaggagtagttgcccgcgggcccgacggtgcagacttggcagctggtgcacgcgtaggaggtggtggtgcaggggaaggagccggaggagtctgatgaggcggtgatgtcgaaggagactgtgcttgcggcggggaacgaagagcgggcggccgttcttgcccggaaaacacgatgtacttcttacgccagagtatgatggcgtgggctgtgtctccaagtttcttctccccgtctcctccggggatgtcaagctcgagatcctcgtaggttcattccaccagctctatctcgaccttcgcatatccatgtggaatgggccagaaatggtatgtactcgaagggtccgtgggtatggccatgcccgacacgaccttcacaagaaatatagttcattaattactaatcaacatatatatgtaacaaatttcgcatttcgcataccttgatagacaagttcctgaagggagtatgcatatcgcagggtgttcgctgcgtgatatcatcaacggggaagtgggttgcttcgtgagctgccactgcctcaatgccctctgatccaacttggcccgttgatgcatagctgctgcggttgcccgaggggctcaccatgacgggtgcttgtatttccattccgcgctactcggccaggcattggtccacctgtcttgtcacctcctcttgcatccttgcctcgtaggtggacaccctatactcaagatcgatgaccttagcctctgtatccctcttgctcctcatctgactcctatacgtgtggatgtcctctttgaatccatatttccaaggaaggacgccttttcctcgcgttcgtcctggatgctcaagattctgtagtgcgagggtgagctcgtccttctctctgtcgggccggaaagtcccctgcgtagaggcttcaattgcatccgcaagtcagcgtgctgcatctcgaatctcatcgccgaatatgagggagccatcacctggattgagcgatccaccgtgtgcatagaaccagttcctcgatcgcgcaggccaattagccgtggccggcttgataccccttgctatcaagtcagcttccaaacttgtcccacttggggattgcctttccatatccgcctgacccaagccggtgatggtatttcttcttagctgcattggctttgttcttttctatctgtgcttgcccttgcgctccaatcttgtatgccacaaacgcatcccagtgatccctaagcttgttatgcacgttgaaatcagttgtcaagcccttgaggatttatctcttgtacatatctgatttgtacctctggaatagttctgccattttcttcagggtccattctttgcatctgggacgatctacctcagggatcgtgaatgtctccagcatggtggtccacaacatgtccttctctgtgtcagggagaaagctatcttcatccccgcgtgacctagttcgacgccagtacactatgctgatagggacgttgtctctcacgacccaaccacaatgatccacaaactttcgtcctatacccgccggggctactggttcgccgtctggggcaatctcagtaacgatgtgccttccctcaagcttcttcgcgggacctcttttcctgcgtggcctcttctgtccggccgacggttgactatcagtcccctcctcggtcccctcctggttagcctcctggttaccctcatcgttgccctccttgttcaggtattggttgggatcctcgttcccctcatcatccacccagtactgactactgccctctgcgatcgtgtctaataggatttgttcgtcatcgcggtctgccatctgtgcgtgcaaagaaaaaaagacagtgaggtcatggacatcaacatgtacagggtaccgagctagaatgtacaacaacctcg

SEQ ID NO: 88854 - DNA, 681 bp, Oryza sativa
cgcctgatggtattggtcctgtcagattattgtaggacaaatctaaaatgcttaaatatgttaaatttgataagctgggaggaatctctcctgaaagattgttgtttgagaggtctattgattccaaagcatgcatactcccaatcttgtgagggatattcccattcaattgattccaagataagttcagatttaccagcccttcaagacttgaaatgtccattgggatctcaccagataaattgttaggtgagaagtcaatggtcgttatatccaaaacactaaaaccttagtatttaagctgtagtctcttggttattacagacagttcaccaagcctaagtcgataaaaacgaattgaggcaggaggatatggatttgctgcactatattcatataccatagcacttagattcgataggcatggaggtatcataccagataaccgatttttcgcaagattcaaatggcgaagatctcttagtccagtgatagagcctggaatatgcccatggaacatgttgttgttcagtcgtagaaaccgcagcgatgtgcaattccctatccacattggcaacgttccagagaattcattccatgctagatccaaaaaggacagaaaaaagcatctttgcaaaaatgatgggaacttgccagagaagctgttgttacttaacataa

SEQ ID NO: 88855 - DNA, 1359 bp, Oryza sativa
tttgccaaaccgcgcacagcggcaaacttttcaataagctaaattaggtaaccgtataaatatacttttctgagtgtaggaccctcaaagttgcacagggtggtcagatttgttgttttcatggtcatttcatttgatgataatactagaacctggagtgaaaccatgtctccgagcacatttggaaataggccatgcaagccaatagcatcaaggttgagtttcttgaggctcgttaggttccaaaatcaacaagactcgattgagtccaagtagttgtaggagaggtcaagctcctcaagattcgtaaggttaaggtgtgggagggattggttggcactagtgagtgagcaaccacctagaccaaggaccctcaaaatggaatcatgttcaccacttgaggccaattgaccactgtactgagatcgatttcccccaggttaaggtgctctagcaaaggtagacgtgtcaaccaagagagatccgtggaatacggtttgattgcatctaagcttaatgaagattcactgaaatgtgacatgccagagatgtcgagataccgtagtttcgaaagattaccaaactgaggaggcaccttgtccgaaaacggtattccagagaggttaaggtatcttaggctcctcacagagcctaggaactattggaaatatggtcatatatcggcatattttaatccaattatttaagacaataatcataatcatggcatgaacaatgtggggtgatctaatgacaacatgtagcataaccagtaacatgcttaaggtatcatgagcatcatgcacatacccataccaaggacgcaattgacttgcgactagcatgactaacagcggtatgaacaaatgaattaacaacaggagaaggacataccccgagaatggccctccgctgaattgtgaggcagaattgcctctgttggtgttgacgttcgcaacggctccggctcctggcgcgccatctccagaggcagcagcggcgccggcggcagctccggctccaggcgcagacatggtggatgaactgagcagtcgtgcgggaagcactccccaaaaacctgatcacccgcctacccggtgcatatctcaggcgaaggtgtggttctagaggcctgctccttccgatctctcgtgcgcgcaagtgatcagaagcgaggaagcgagacagcacaggcgcgcgcggaggaggaagaacaccagggagaaaagcaagcgaatcgttctgatcggactagcggcctccttagatagcaggagagattccgctagttgcaacacacgcgtcgtgggatcgtgggccgttacggaggcagtcgtgggaatgtggttgcaaaagaat

SEQ ID NO: 88856 - DNA, 1091 bp, Oryza sativa
  unsure (1)..(1091): unsure at all n locations
accacttttaagaagaaaggcaagggaaaggcaaagggcgactgctttgtgtgtggcaagtctgggcattgggccaaggactgtcctgagcgcaaagacaggaagtgtgccaacatggtcattagcgagggcggaggaacatcggggtacggtaaaatattacctatagttctctttgtttttcactcacctgattggtgggtggatactggtgctaatattcatgtgtgtgctgacatttctctgttttcttcttatcaggtcaggagaggttcctccttgttgatgggaaacgggtcgcttacggctgtttatggtgttggtacggtcgatctgaagtttacttcgggaaagaccgtgcagctgaagaacgtgcaacatgtcccttcaataaagaagaatcttgttagcggctctctattgtgtagagaaggttttagacttgtgtttgaatccaataaatgtgtcgtatctaaatatggaacttttgttggaaaaggttatgacagcggatgcttgttccgcttttctttgaatgacatgtgtaataattataatgttgtgaaccatattagcgagaatgatgagtctaatgtatggcattcgcgattgtcatgtgaatttcggttgtatgacgcgcttagctaacatgagtttaattccaaaattcactttggtcaaaggttctaagtgccatacttgtgtttaatcgaaacaacctcgcaagcctcacaaggcatctgaggcgaggaatttggcacctctagaacttgttcattccgatttgtgcgaaataaacggcgtgttgactaaagggggaaagaaatatttcatgacactaatagatgattgcactatattttgttatgtgtatctattgaaaacaaaggacgaagcattgcatttctttaagacctataaagctgaggtagaaaaccaacttgaaaggaaaatcaaacggttgacgtctgatagaggtggggagtatttttctaatgagtttgcatccttttgcgaagagtttggaattggggatcttctagagtcgtcagacgggcacctcgggcagctgtacagatntacatnaacgc

SEQ ID NO: 88857 - DNA, 677 bp, Oryza sativa
tttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgtttcacgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggatcgcacttaatctgttgtcccgtctgcaaggcagattggcggacttacctaatttgttgcatttgatccttcctttgttaattgttatatcatgtccccttgtaaccatctagttgcgtctcggtattcgtgcaccctgtgcgagtatcgacggacgccttcaaacttaaaatctgaataacaacttaggtaaaacttaggttttacaaaagacttggaaaacccgacacctgggtcggggcttgcgaactaaatgaatttccaaaaccgcggaccggggaacgtacccggtgtacggtttcccgctctcgcacttaaggaccgattccttggaattcatccaacataagtcaa

SEQ ID NO: 88858 - DNA, 789 bp, Oryza sativa
  unsure (1)..(789): unsure at all n locations
tcaaccctttccctatctttgaaaactttagcaagagctcgcaatcttgattgaacaaaatcttccttttcgtcggccatgagattataatattcatcggctgtcaattcattatgtaaatttgtcctcctggagccgattctaacttcccatggtaaaactacttcctgcccataaacaagcttataaggaggaacttgaatcgatccatgacaagccatccgataagaccacaatgcttcggctaacctagtatgccattgccgaggataatcagaaatctttctcttaaccaacttgatcaaattcttgttagatgcctcggcttatccgttggcttgtacatagtatggggaagaatttaataacttgatgcccatgctatcggcaaactgaacaaactcatcggacacaaagatcgagccttgatcggttgtaatggtctggagaataccaaagcggtagataatatgctcctgaacaaattgtatagcatctcctgaatcaaccttcttcaaaggaatagcttctacccacttggtgaaataatcagtcgcaaccaatatgaatttatgcctcttgctggaagatggattaatttggccgatcatatccatgccccatcctctaaatggccatggcttgataataggattcatagccgatgctggtgctctctgaattgctccgaacttctgacaatcttgacatcccttgtagtatctggggtaccgagctcgaattcgccctatagtaatcggaaacagcacntcaaannnngatccatca

SEQ ID NO: 88859 - DNA, 1865 bp, Oryza sativa
  unsure (1)..(1865): unsure at all n locations
ttttttagtctctttccatcaggcatcagcattgaaaatggacattgaatcagttaggtgtgcgtgctgtggcntgnaagaggattgcaccaaggaatacatagagaatgtcaaggcaaacttcgaagggaaatggctttgtggcttatgctcagaggcggtaggggatgagctcagtaaagacagaagagaacaggatggcatcgaagatgctatcaaagctcatatggcattctgcaggatggcactatcaagccctgcagtcaaggtggcggatggcatgaaggagatgctcagaaagaggtcaaaggataaggtaaagcctgaaataccatcaaaagcacacccattcttacttggtgacaattgacaaggttccaaagcgaagaacatcagaattatgcttttagataagggtgtgactgatgtaagatttctctcaacctactcaacagttaatttactagtattaccttttatattccctggcaacatgtcaagtgtaaatacaatttggtcatatgaataagtttcaagatcacaacatttcagcatgaagatctacaaacttcgttgacaagagatactatgcttttgtgtgaacatgcaggttatcctgtgttcttcttcgccactcgagaatatttactcagaggtttgtttctcacctaattgattttgatgatctatgatgaaaattaataatgacaagtgatcacttttattccaccaactagagactagttatggttcagtgtcttacattcttaaaatcattgaacaaattggcctaagattgtcactgtgcaactattcatgtacaaataccccagggagaatctatcagcaacatgtacaaatagagtgaagaaatataaatagaattaggtactctaccattccaggtttgtaatatttgattcgcaagatccgtgaatctatgacatttcttataatttgtaatcacccttatgtaacaagctgaagttgtaacaacatatttcattaagatgaagacgcgatacaagtaaaataccacgctatgagaaacttatgaagaaatgagcctggtaaaggcatcaaaatatcactttctactgaaagatagcacgaggcaccaatcaatgacagataagtattggcagggaaatgcttgattgaaagctgaaggtgttctacagataattcacaatatgcacatttcaagttcaaattaataaaaaacacatgacccacagctaacagggtgcatggacacttcttagaagtcaaaatcctaatactgttaaaacaatcaacaaaagagttgaaacatgcctgtactcctggcctgcttgtgctgagatctttcaaactagaacaatccttctcctgcatacaaaggttgtcatgattaaatggtaaatactaaaatctaaaacactggacatctgcatgcagataattgtggagaccaatcatagttgcataatcacaacaaatacaagtaatgcaagattctcataaatcagaatattaaggttttcagtgaacttacttagctcatctaatgaaatgctagcagcactctcgccagatttaatcagccgaatcttacctgtacatataaatatttttccaaggataagcttttacaacaacaaagacaatcaaaataaataagtacaaaagaatagctatcaacattactcaaatgcagtataattaaacaaagcagcaggcttctgtgtccagtttggtaacagagttatggagttaccccgagaaaattgntcacacttcacacgttatttattcttgctataaaatattactaccacacagtttctagtggaatggcagatcaacataccattngcgtcgaa

SEQ ID NO: 88860 - DNA, 981 bp, Oryza sativa
  unsure (1)..(981): unsure at all n locations
ccatcagggacacacttttgtagcctctatgaccaanccatcatctgtatgacggcaatgatggtctttgtgggccacctctccaaaaaagttgttataagtatatgcctcaaagcaaggttccagatcagaagcaaacaaggttttcacatagggtcattttccattggagttacagtgggatttatggcaggcctatgggtggttttctatattcttttgttcaagaaatcctggaggattgcttacttttgcttcttggacaatatgtatgatgaggtttatgtgaaggtgattgttgtctgggcaaagttgacaggaagaacagatgaaagattgcgaatgtcgcaggtcgcatggtcatccatcgactctgacgaatactatgaatagacgaagacaaagaagctggagcaggtctacaacactcttagttgggttgtatattttgtcatagatggaacttattagaacaagtatcctaaatgcatatgatgcattgatccacattgatgtatatattattgtatctgtttgtactagaagagttgtgtagtgtctcagaaatgacccttcatactgaactcagtttagctctgttctgaattttgtcaaacagctacagtaacctgacgagggatgaaaacaaaataggtatattcatcagcttttctgcgctaaagctacaggttttgcggtgcaaacttcatcagcttttttgggcttatattctcccttaattaatgtgcaaaataagcaaactaagtacatgcaagaagtaactagtatgttggtttatcgcaacttcgtcaggcctatgagttttagcaactaagtacatgcgaacatgctactaaatcggagcgaaataaatttagtacatacaagatcaccaccccagttgtcatagtgcagccgttcactttccccagtagtactgacaaactttgacctcaataagaacaatagaatacctacatt

SEQ ID NO: 88861 - DNA, 818 bp, Oryza sativa
atcggctgcttctcgttttagggattctgccagtatcggctaaatcgcgttgctagattagatttgcttagacatctaccaccctaaaaactcagtcaacggcttgattgtctagatattatatttcttttcatacttagtgctgcatccattgagtttgatctactaagtcgtgcttagaaccataatctctagcctgcttcttgattgccaataagggtttcatcggggtttcaaccggtgagttatctggacgttgcatcggctcataaggattgcatatacatataagttggatttagccgatggcaacaaaggtttcactatttaatttaatcttgtggatttcatgatatcggacctccagccaatgtgtgctttaaccttcggattaatgcttgtttatcatatcattatttgctgattggtttatactggattatattgttatgtcgttacatcatcttcagccgattgcctttatatcattatttacattggacatatagccgatagctctaaaccctatcgctatcggctggcatcggctattggctggtatcagcatcggctggaatctctacattggattatgagccgatcggctattttatctcctatttacataacttgtcagttgcaggatcaaacttactggcacgcctgcatctcatcaagatttggacctgcacaggagctaagcagatctcccacgccggtgtgttcgattttttcgtcaacacaaattggcacgcccggtgggaccatgaattttatatccacatgtctgaagaagaagccaatgccaagatcatggt

SEQ ID NO: 88862 - DNA, 1308 bp, Oryza sativa
  unsure (1)..(1308): unsure at all n locations
aaaaaggttttcgctagatcatccgggattagggcttgaatctctgccaatcntgtccggaatgaaccgcagtcaacccaccnagttgtctaatgatgtctctagccgatgaaaaatgtctccaagagttcttttcacatcatcggtcagaggggctaaagcttatggggtgtttcttcctctgcttcttcgtcaaagtatcccttatatcgaaagagacaagatcggctaagacttgcaagagagaaaattgaagacagttaaatatcgaaccaaattatatagccaatctaagatttatgccaatgaaatgcttactggaatgacaggagctgctggttgttcttcttcttcgatgttatggctgcctgcggccgatggagtacaatcacttggtgttggttgcacaggaggtgaaagatgaggaggaggctaaaaaagataagtgttaattaacaccggttacgatcagatttaaaggattttgcagagggaactttaccggtggagctggcttagatggtgtcggtgccgatttcttcttcacgatagttttctttttctgcaaatacaaggctaataagtaatcggctatgcaagttgtttcgagaaatgatcaagatgagttgtttacccttgaaaaatgagctggggcagcaggagttggaggagtctgtttgggcgaagccgatggtgttttttctcctaagtcactaagttcggctgccgcttggtcgtcatcttcctcaatttcctcttcatcgaaggcttgttcgatggatggatctaaggcaggcaagtcgtcggttggcttggatttcttcttttcggccttcttcttcagagccagaaccgatggatcaacagccgatgccttagtcttcctcttcctgccagcatcggctagttctcctatttgcccttggagcagacttgaggtcctgggggcatgatagccgatgactgggggagctagaccacctccgtttggtaaaaggcctggagcatattttatgtctttgcgaggaggagaggattctgttgtctgcaaaatagaagaagagattagtcaagatacaagtcagctaacagttgttttagcagaattgacaaagtaaaatttacctgagggatgacatccaggaatagatctgtcatatacatggaagccgatcgatggaacaagtgtagcttccattcaccccaccacctatcaaaggccctgctcctgaaccttgccagctctatgttctcaatactgcccaagggaggtcttgggatgttgagcagccgatccatcatcaaggt

SEQ ID NO: 88863 - DNA, 735 bp, Oryza sativa
cgggccgttattgattgcgatcggctcgtacccgttatgaattatttccatggaaccctgtatcaccatcttcatggtgagggtccaaggtcgctatcatggagcaataggttgaggatcgcagccgaaattgcaaaggctctttcctatcttcactcatcagttacaatcccaataatccatagagatataaagtccagtaacatacttcttgatgataatctgacatcaaaggtatcggactttggagcttcaaggtatatcccaatcgagaaaacagcactaacaacagcagttcaaggtactgtaggatatttggatcctatgtacttttacacgggtcgtctcaatgataaaagtgatgtctatagctttggtgttatgctagtggaattgctcacctagagaaaactatttccatatttgtcctctgaaggtgatggccttgttgcagattttgtcaacttacacagtgtaggtaatttggtccaaatgctagattctcaagttatagaagaagggggcactgaaatccaagaggtttcccaactagccatatcatgtatagaattaagaggtgaggatcgacctaccatgagacaagtgaactgttcactcgaaggcatcctctcacaaatcaaccaaaaatgaattatgtcatctgagaaggatgcggaggatagttcactggttggtggagaaatttgatcttcgagaaataaggttgatggttat

SEQ ID NO: 88864 - DNA, 818 bp, Oryza sativa
ccttgcccaccccaagagccaacggccaaggggagcgcgccaatgcggaaatcctcagaggccttaaaaccaagacctccaacatcctcaagaagcacgccgatttgtggatcgagaagttgccagcggtgctctgggcgaaccgaaccacgccaagccgagcaaccggggaaacgcctttcttcctcgtctacggcgcggaagcggttctcccatccgagctcaccctgaggtcccctcgggccaccatgtactgcgaggctgatcaagatcagcttcgcagagatgacctcgactacttggaagagcgaaggcggcgcgtggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccatatcgagtgatcggcgtcccccggccgggctccgttcggctggccacgggcgacggcacagagctgcttaacccgtggaacatcgaacaccttcgtcgcttctacccctaagggggatcgggtgtcaggtttcgggctcgggccaaccccgcacccccttcaggcgtgcagggttggccgggggctaccacatttgcatatcttttcttctatctgtatttcaataaaagcattttcgatttcctaaaggctgtatctgtactgttgtttccttttgaagaatcttaacttgaaataggtcactcgtgctcaatcctgccctcgggggctcgggtcggctaaaat

SEQ ID NO: 88865 - DNA, 732 bp, Oryza sativa
aaatgtggcctggaattcttccattaagctgattccatgataaattcaaatttttaatgccatcgagaagagttagctcctccggaatttcaccagttaagtagttcaaagacaaatcaatggtcacgatatctaatactatgggtagtttgtagtaaagtttttggcccttggtgtccacagacatatttgcaatgccaacattgcgaccataacgaccagaaattgagtaacgatcgaagaccattacgatatcacaatgaccacttttcttcatacatattaaattggacaaatgcaaaggtaaaacacccgaaatagaattatttgatagatctagttgaacaagccttgtaaggttggtaatgcttgttggaatatttccagagaaattgttattgcttagtcgtactattgctagattcgacagctctccaatccagatgggcaatcctccatagaagtcatttgatgccaaatccagcatctctagattatgtctactacgcaaaaatggcgggaactttccggacaaaatattgttgctgacaaatagcttactcaaaaacactggctggaaacatcgaggaaattccccctccaaaagattgtccgctaaatctaagtaaacaaggtgatgcaaatcacacatagagtttggaatatggccagtgatacgattggagaagagatgcagataagataagacaaggtcatttccaaagttcgatg

SEQ ID NO: 88866 - DNA, 739 bp, Oryza sativa
cgggttggaattcattgcaattccagctcgtacccacaaatattccgtatggtgacacttttgtttggttgtactcttgtttaatatgtgttaataattcgcttatgaacatttattacttatgttgaactaattatttatatgttggggatcaatctatttgatgcaggtgtggcgtacgacacaccggcgctgttcaaccgtgggattgacaggaaccaccgctcgttcctgtcaacagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttacgtgcggcaggccttctaccactttgtaggcttgttgaggcggcggcggacgaccgtgacccagcgaagtggtggaatgcagaccggtcactccttgccgctctggtagaccgctggagacctgagacgcacacgttccaccttccctgtggggagatggctccgacactacaggacgtgtcgtacctgctcgggctaccgctggcgggagcaccagttggtcccgtggacggtgtttttgggtggaaggtggatatcactgcgcgcttcgagcaggtgatgcgcccttccacacctaggaccggccaacaccctttcttcgtactttacagtcgggcctaga

SEQ ID NO: 88867 - DNA, 1628 bp, Oryza sativa
ccgtaggtcgaggtcctgctccgacggtaggcgcgcgaggccgtggttgtaccggaccagctggaggtacgacgtccacggcgctgtgacaggagaagacgcgcatgaccgcatgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtaattgtcctatattatgcaagataaatgaaataattgtaagaactaatacaaattcgacgtacccccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcaccagtggtcggcagggaggacggtcggctgcacgttgcccggaaacacctgcctaagtccgaactgtcttatcacacgctgcgggcagtgaggctcaacgaaaatgtcgaacaccatcggcaggatggtgagccagtaagcctggtcgcgtgtgcacaaagacgaaagtcctagcggtgctctcgcagcgacggcctcttctgtgtacggctcccagatgacgtcgctcggctggagacggtcaaactcgaacacgaagtccgggtaacctcgtctcacctggacgtgagcgtaacgacgctgcaataaacatgatcggaattagacatgttatgtgaagaaaaaaaagaagacgactgataaacttgtaacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagcccgaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacgaaggaagggtgttggccggtcctaggtgtggaag

SEQ ID NO: 88868 - DNA, 743 bp, Oryza sativa
  unsure (1)..(743): unsure at all n locations
cgaggattaataacccatnctagcattcctgcaggtcgactctagataattgcactactgcccctgacatggggccgcgggtatcatgactagaggcttgggtagccaccaacacttatttggcctgaccccctcgggggggggcgggcccgaagatgatgtagccacccctccctctgtctccccgaggggganaannntntnnncccttgctcgaatgaaaaaactttcacaaaaatgtaaaaataaacaatccaaactcacaattggtcgcaaggaagaacggccggttgaacataccccggaaacacctgcctaaagtccgacctgtttaataaaaccctgcgggcaggaaggctaaacgaaaatgtcgaacaccatcgctaggatggagagccagaaagcctggtccctgcccacaaagacaaaagtcctatcgggaactctcgcaacgaacggcgtcttttgtgtaccggttccagattaaccccccccgaaaagagacgggcaaaaatcaacacgaaagcccggttaaccccgtcctcacctggacgggagcgtaacgaccctgcaataaacatgatcggaattaaacatgttatgtgaagaaaaaaaaaaagacgactgataaacttgtaaccaaccaaagttgccctaacccaaattcgacaccagtaaagtcccatctggggaaccttccttggcaatggaccctttgaacaaaccctaaggggccctttccc

SEQ ID NO: 88869 - DNA, 679 bp, Oryza sativa
gcggacgaaagatgctgaacaagagggcgcacagcggcgggcggccggcgggcaaaagcaatttacccgcccgtcctagaagctgcaaaaacacaccatcgcggatctgcaggggcgctatactctcgtcccccggaggaggtagagcccctcctctttgacagaagagataggccccgacatttttgggaacgctgtctcctgtatatatcgccccgcccgacaggcgggcctctggggcgggcggactgtgaagtacgccggcaatcaggggggcctcgcccagcgcctttcggagatgcccgggacctctccaacggctccccgaggagctcaaggggacgattaagtcatcctcaagggacttcgcccgagaacgcgtggagctcgtactggcgagctaccaggccagggaccccgacttctctccctggacggtgctggatgagttccctcccgggacaaagaacgggggccgccccaaggtcgggaatgccccggaccatatgtccccaagtttgaggggttcggcccttaagctggggttcgccttcaactccgacgaggaggcgattgacgccggtgtgggcgacagtgcccaccaggctgtcgacccgggtgcatcggagtgagcccccaggcccccgccaatcttcagttttttcttcttttctttctt

SEQ ID NO: 88870 - DNA, 1098 bp, Oryza sativa
gcggcttgatattgactatcactatatgcctgcacgtcgactctagaggatccccatgcaaatgggttttcaagaaaaagcttagccctgatggtacaatcgaaaagtacaaggcaagacttgtggccaagggttatacccaaaaggaaagcaaggattttgtcgacacatactcaccagttgctcacttgacaatgattcgagtactacttgctctggcagcctctcatggtgttctcgtccatcagatgaacgttaagacagctttcctaaacggagagctggaggaggagatctatatggatcaaccagacgggtatgtactagaaggtcaggagggaatagtgtgtaaactgttgaaatccttgtatggccttaagcaagcacctaagcaatgacatgagaagtttgacaccacgcttacatctgcaggctttgttgtgaacggagctgacaaatgtgtgtactatcgctatggtgggggagaaggagtgatcttgtgcttatatgtcgatgacatattgatctttgggaccaacctcaatgtgattgagggggtcaaggactatctgtccaagagttttgaaatgaaggatttgggagaggctgatgttattcttaacattaaactacaaagaggagatgagggtgagattacacttgtgcaatcccactatgtggacaagattttgagtcactttggatatagtggctgcaagccagcttctactccttatgatcccagcgtgctattaaggaaaaaccgaagaatagcaagggatcaactgagatactcccaaataattggttcattgatgtacttggctagtgcaacgaggcctgacatctcatttgctgtaagcaagctgagccggtttgtcttaaatccgggagatgatcattggcaggctctggaaagagtaatgcgctatctaaagggcattatgagttatggaattcactataccaggtatccaaaagtactagaagggtatagtgactcaaactggatatctgatgctgataagataaaagccacaagtggatatgtgttcgcacttgaaggtggcactgtttcctggaagccttgcaagcaga

SEQ ID NO: 88871 - DNA, 710 bp, Oryza sativa
tagaacttacagcactagatactgcgacagttgaggccgagtggcttcttgaactcctgatggatttgccggtggttggaaaaccagtgccagctatcctaatgaactgtgacaatcaaacaatgattattaaagtgaacagttcaaaggacaacatgaagtcatctaggcatatcaagagaagactgaaatctgtcagaaagcagaaaaactccggagtgatagcattggactatgtccaaacggctagaaatctggcagatcagtttaccaaggggctaccacgtaatgtgatagacagtgcatcgatggaaatgggcttgatacccacctaaggttgcacaatagtggaaacctgtccattgtgatcggagatcccgtgaatttggatggcgaaacaaactattgtgtgactgagagaagagacccttgaaaaaggctcattttcatgatgtacttctcttcttttctgcatggtaggatggctcaaaccttaatgtgatccgagtggcttttccaagcagagatgttgacctgcagaacatctcagaaggaacacacctatatgagttcgactgctagtcacaatctatgaggtttgggcgatctctagatacttatgaaaggcctggagtttgacttatatgctccaaacagaggggatgcgaacggcagcccaataccagttaagggtttgagtgaaacctgat

SEQ ID NO: 88872 - DNA, 995 bp, Oryza sativa
  unsure (1)..(995): unsure at all n locations
agcgcgttagacacnctgctcncnaccccaaaaggccatgaaagtggtatgatctgcagggcctgggccggctgatggatttgctttgcgtggaattgacacgctctgcatcgccggaccaggtcgaccgcatcattgggagccgtcggccaatagaaaccctggcgaaaggccttgccaaccaaggtgcgcgaggcggagtgggctccgcattcgccttcatggatatcggcgagaagttcgacgccttgttcccgaggaatgcacttcaggaggactccattagccgtgcgccgatagagggtcccttctatcagcacgtagcgtttggagatgcgctagacgcgttcactcccttcgcggtcctcgggtagagtcttatctgtgaggtatgcttggatctcagcgatccaagcaatcaatctaagggagctgggagcgctcccctcgggtcccgaggcctggactccgatgggcctcgggggccggtcaggcgcgtccgtcttccctaaagggtcgggtcgcgccgacggctgggtaagcctttcttcaaaggcgcccggtggggtctgggctcgcgaagaagcgagccgtgagagttcgtcggcaatcgtgttatcccgtctgggcacgtgccgaagctctatcccgtcaaaatggcgcttcatacgccgtaccttgcgcacgtaagtgtccatctgggggtcagagcaccggtactccttacagacctggttaacgaccagctgtgagtcgcctaataccaggaggcggcggatccccaatccagctgccaccctgagtcccgccaggagtccctcgtactctgccatattattggtcgcccgaaagtcaaggcgaaccaggtatctgaggacgtctccgcttcgcgaggtcaacgtgaccccagcaccggcgccctgaagaacagggagccgtcaaactgcatcacccantangcggtgtgaagcattttcgaggggtcgagcttcccc

SEQ ID NO: 88873 - DNA, 1243 bp, Oryza sativa
gaagttctggtattatgctcacggtgaacgctcaacccagctgatggctcactggtctttttcgatcagatacgagaggctgcgcgacgactaacaaatgcagtggaagcctcctctcagggcacgttccgaccagacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaaaattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgccccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccctgcaagctcctcttccggcaccttcaaagtcaagggcccccccagctccaccgcctgcccacacaagggcaacgaagaaggcgaaagttgacgccgccaagaacaaggacccggggtacgattgcacgcaagaggagcttgacgcttacctcctgctggccgagactgacgagccggcgagccgccctgcccccggccg

SEQ ID NO: 88874 - DNA, 678 bp, Oryza sativa
gctccacgacacgagccccaagttcggctggtcgccacgccacccatctccatcttcgcccacgcacccgcacggtcgcacgcacgcacgcgccaatgtcgtggctcgcgcgctccatcgcggcgacgctctcctcgccgcgcggcgagccggaccccgacgccgacgagcccgaccacgccggcgacagggcgtcctccccgcagggttcctccccgcgtgaccccgactccgacgaggccgagcagcccgacaccccgagccgccgcggcgtcaaggacgacatctccgagctcaccgagaccctcacccgccggctctggggcgtggcctctttcctcgcgcccccgcccccgcgggagtcctccaccccgcacggggaggaggagtagtagggtagggatggggaagaggagtcagcgcagtcgccgcggatcgcggggatccggagcgatctgacggagattggggggagggtgaggagcggcatctcgatgctgcagagcaacaaggcggtggcggagatatccaagatcgcgtcctccctcctgccatttgggcagggggatgcggacgagggggagcccgtggctggcgtcactgaggaggttgtggtgttcgtgcggcacatctcgaccaggcccgagacttggctcgatttcccactgttcatcagtg

SEQ ID NO: 88875 - DNA, 2293 bp, Oryza sativa
  unsure (1)..(2293): unsure at all n locations
cccctcaccgcgccatgtgctcggtggactcggtagatcgtgcaccgacccccaagtgccactgacagtgggccctacgaggaatattcttccagaatattcctttccattaaaaagaaactctttttcctttcgttctgaaattaacttgaacttcataaatagatatcttgcaaacggtaactccgtttgactccgttcaactctcaaaatctctataaaaatgagatctatctattggcaatattatcgcctactattttaggtactttagtggcttttgtgttgatttactcctttttgcgtgtagttgccaagcctgaggacgatccgtaagccattcttgatgaggaagaaccacgcaggaccaaggcaaaccacctttggccatattgcttcctatatgtacaaaattatgttgtttggaaatatgcatgcttagattacacgttaaactgtttggtctcggtttgcgaatgcaaccgacggactcacctattagtcgcacttgaatctagtaggatattgaagtaacatgtcctggacagctccacagataatgcgtcggtaacttaccatacaagtatgatcactgaggtagttttgcttagctatgctgcgattgcattgtcgtatggggaaacatgggtttccaaccaaatattcaaaacccgagattttattttggtgtgtttgataaatgaaactggattatgaacctggatgatatgtaggctgaacctgtgtgattggctatgtattgttgttaaggaccgattcatttgggaattccatccaagcatcttgtagtacttagtttgtttgtgcctaccttgtgtgtcagtggttggggacaacggggatgaggagacggagttttgtgttgtgagattttgaccattcatggcaatcgtctctattgtgctgcttacggtacaaataggtgtaggagcatccttgactccttgttgtaccccgagtagacgatggctagccagcctgatgcttgacgtgcgattcaactaactatgtggcatggggttttcatgaactagatttagaaaggccttgccacaaacttgtggtgtcgacgggtgaccggtggtagtttcgtgccatgtgggtaaagcgtacaacctatgtggagtgtaaactgttcgaacagctgtgcttacggtcaagggcgaatgtgaggtgattttcttagcgtagcactgattttgaaagctttttgaaattggtttgtgggatgggccggaatcgttccagagccggtctgtgtggcagacggagaacctgagtggtttcaaacaggtggggtgtcttgtggcaccatagtggagctggaatagttggttaagatgtgttgcgagatgagatggctccgcggttcctagctataagcagtactccctccgtcccattttaagtgcaacaatagttttccgtacctaattttgaccttccgtcttatttaaaaattttttgaaaaaagttaaaaacataagttatgagtaaagtactattcatattttattatcttataacaacaaaaatactaattataaaaattttttaaaaaagacggacgatcaaagttagacgcggaaacttatggttgcacttaaaatgggacggagagagtaagaacttggcagctgatcgagctacgcgtggtggcagagtgagccggactgacaaatccatatattaattgtttataaacacactagctagatgccagagtttgctgtggaaaaaataaactactagaaacaaaatgtatagatatctgaattgactcgcccgttcactgccagaaaattgcctaccgtgaaaggtgggcacagacacatgccctgtttaaatcccacctaaaatttttcactctgtcaaatcgaacgtttaaatagctgcatgaagtattaaatataggcttaaaaaattacacagattgtgactaattatttgcgagatgaaccttttaaaccaaaatgctccttgatttgataatgtggtgctacacaaaacatttgctaataacggattaattaggcttattttcacgtgcggtccacttaagaggcccgcacgtgaaaatcgatttttccgtacggtcctcttaaggagccgcagatgaaaatggagaatgatttccgcagaccgcaatctaaagagctccttgtacagaaaaaaatcgttttatagtagtgcaaccgcccacccaagcttcaactcaagactcacttctaanngcagcnacatagagatacaaaggagatggttgagaatt

SEQ ID NO: 88876 - DNA, 836 bp, Oryza sativa
  unsure (1)..(836): unsure at all n locations
ctatcagctcaagaggccaccacaatgacatgntgcagacggcagacctggtatttgttaccacctgttactatactatatatgttaataccagtataccagtcagtgagtaaaacggcacatgaccactacatgacaacccaaaatgtacaattgcaattatttacattttagtgtcttggagatgctgtcccacctcctaaatctccacccctatattcatctttactatacattgaaacaagaaactcaatctcctactccctccgtcccaaaaaaaggcaaactctgggtttccgtgtctaacgttgactgtccgtcttatatgaaatttttttataattcgtattttcattgttgttagatgataaaacatgattaatattttatgcgtgacttgtctttttaatttttttcataattttttcaaataagatggacggtcaaacgtttggcacggaaattaggatttgtctttttttgggacggagggagtatgtacatttcagacataccatggctcattgtcagtgacccctcgattccggtgcaggtacatcagtcatcgatggacgcagcctcgtcgctcctggtgactgccctcaacgaagggagggatgtgatcatggacggcaccatgtcgtgggagccgtttgtccagcagacgatcaccatggccagggctgtgcaccggcaacggtaccgcatgggtgttggctacaaggtcacggaggacgggtcaatcacttgaggagtacctgggacccagtttganggacttccccagtttccccaccgaaatattttgtgttaaaaagggggaaaaaaaaggaggg

SEQ ID NO: 88877 - DNA, 618 bp, Oryza sativa
gagctcggtacccttctagcttgaattattatagtttttccctggaaagatacatctaatagacattactatcctgtaacaatgtttccattgcgcagattcatcaggatgatctcaaaaaaaatgttatactccagttgcttgctcttgttgctaagcaaccagcttttcaccaattacgttcagttgagcaacttggctacataacactgcttagacaaaagtacgtacaaccttcacgtaattgataggatgtacagtggtctttttgccttggttggcaagaatggtgttctatatgtagactatgcaattcctgtaaaatcattgacactgatcctgtttacccagaaatgattcaagtgtccgtggtttgcaatttataatccagtcaaccgtgaaggtagatatatttctcaatgcagtttcaaacccgctgaaacaatcattctcctattctaatatattgatttgacaggatccagccaacttggatgctagagttgaagctttccttaccatgtttgaaggaactctataccaaatgcctgatacagaattcaaggttggacagatgatgtcactgactcactgttaatcattggcttctattacagc

SEQ ID NO: 88878 - DNA, 694 bp, Oryza sativa
tttggttggtgtttgcttcttcttctcctgaagagcacaaaattaaatgtgttatgagaaactttaactgatgatgagtagttcaagatgaagaggccgaccacatgattggcatttggcaacatggtaaagataaaaaaaaaagtagaggaaatcaagtactgaactcattttataagccataatcagagagaaatcagaaaacatgtatgcagatccttactacctagatagcactctattaacttgaaataacatccaccacagaaattaaacacctagagttattaagaatgttgatctatatcattaatgataacagaagaacaaaaaggaaatctcaatcttcatttcggaaaatgaaagcaccttagaaccagaaggtatgagaccaaccatgccaggcaacggtatcaggctcattctgtgatcctcaattaccttcaagtagggaacaaaaccacaaatcagaatgctttaaaattacggtaatgtaagatagccaatgaaggactgcagtacttcacctgcacttttctagttttgatcatggacttttgtgtcctttcacggcataactttccatagttcaccaaattatcactgtgaggcttcatgtcaaatttatgctcgacttttccttcacatgaaagtttccctacaacacacaaggtcatctttgggtgatagtcaa

SEQ ID NO: 88879 - DNA, 564 bp, Oryza sativa
tagtatcttgttgagcggcgtgctcgagacatctggccatgttttatggtcgtaattatccaactaaaatgcgactgaatggtgggctgtggatgcatggttttgcgagtgcacccatagcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttaacttggtgtggatggttaggggagggttatgcaaagggtttcgtcacaatcactcaacatggtgacgtgtgcatcatgggcacatgatgacaccgtgacatgtccgtgggttgtgtcttgtgggtacagttgtgcacctctggccagagtaaaactattcaatagccgtgcccgcggttttgggccatcgaccagattcaccgtgattagtc

SEQ ID NO: 88880 - DNA, 4362 bp, Oryza sativa
  unsure (1)..(4362): unsure at all n locations
atgataggacaaccatatgaaggagctgatcagactcctgcagcatcaggagtaaactatacttctcctgtggccacaaaagggcaagagcgccaatataatgaggaaaatgtggaagtggtgaacattgacttgtcttccaatttcttgaccggcggaattcctgaagacatagtctctcttggtggattagtaaatctaaatctatcaaggaatcacttgagtggacaaattccatataagattggggccatgagaatgttggcatcgcttgacctatcagagaacaagctctatggcgaaatcccagcaagcctatccagtttgacatttctaagttatttgaacttgtcatataatagtctcacaggaaggataccatcagggtcacaacttgagaccatctacaatcaacaccctgacatatacaatggcaacagtggtctctgcgggccgccacttcaaaagaattgttcgagtaataatgtaccaaagcaaggtcatatggaaagaactggacaaggtttccacatagaaccgttcttctttggacttgtaatgggactcatagttggtttatggttggttttctgtacactattgttcaagaaatcatggagggttgcctacttccgcttcttcgataagatgtatgataaagcatacgtgcttgtggtcgttggttgggcaaggcttaccagaaagactgcaacaatttgaggttactaccaagaagctgatgtggttataacatcttgcacggcgcatggcatttcttttctgaatgagatactataagtattattccagtttgtatctctacgagaggggagaaaaccaagaattttaagatgccgatgtctttattatgttttgcaaaaagatgtcaaccattggtcttcttcgaacacatgagcctttgtagcatttgtaaactgctttcctaatttttcccactgtaacatgttccccaagcatggttaaaatcttgagtacttgcctacataagacttatatagttaacttatatatgttgtcatcttttgggggaaattatcaagttggacagccaatgattaatagtagctttagctgctgatggagaaagggatttcaaagattcaggcactttttgctaatttcaaatacttcagcatttcacatgtatgcccatagatttattaattagcttccttttgggagatattaattagcttcctcagctcggtagcctttcaaatctcaaacaccttgacctcggtttcatatcgaatatgtgcacaacagatatctcatggttaacccgtctgcataagctggagtacattgacatgagctttataaatctcagcacaataactgattggcctcttgtggtaaacatgattccatcccttaaggttctcagcctgtacaattgctcacacacacacacataaacctcacaaaacttgagcaccttggtctatcaaggaactactttggccatccaattgcttcaagttggttttggaaagtaagaaccataaaggaacttggtcttagtgaaacctatcttcatggtccatttcctgatgcactagggggaatcacatccctccaacagctagattttaccaataatggtaatgcagccacaatgacaataaacttgaaaaacctttgtgaattggcagcactatggcttgatgggagtctatcgtctgggaacataacagagtttgtggaaaagttaccgcgatgttctagtccattgaatatattgagtttgcaaggcaataacatgaccggaatgctgccggatgtgatggggcacataaacaacttatccatccttgatctttctaacaacagcattagtggatctataccaagggggatacaaaatctgactcagttgatttcacttactcttagttctaaccaactcactggacacataccagtgctaccaacaagcctcacaaatttcgacgtcgccatgaacttcttgtcaggaaatttgccgtcacaatttggcgctccatttcttagagtaattatcctatcgtacaatcgcattacgggtcaaattccgggatctatttgcatgttgcaaaacatttttatgttggatttatcaaataattttcttgagggagaacttccccgctgttttacaatgccaaacttatttttcttactcctaagtaacaacagattttctggagagtttccattatgcatccaatacacatggtcattggctttcatagatctttcacggaacaagttctatggagcattacctgtgtggattggagacttggagaatttgcgatttcttcagctaagtcacaacatgttccatggaaatattccagtaaatatagcaaatcttggcagtcttcaatacttgaatttagcagcaaataacatgtcaggatcaattccctcgactttggtaaacttaaaagcaatgacactacatccgacgagaattgatgttggttggtacgaatctttaacgtattatgtcctactcacagatattctgtcgctagtgatgaaacatcaagaacttaactatcatgcagaaggaagttttgatctggtgggcattgacttgtcacaaaaccaattaactggtggaattccagatcaagtaacttgtctcgatggattggtgaatttaaatttatcatcgaatcacttgaaagggaaaattccagacaatgtcggggacatgaaatcagtagaatcacttgatttctcaagaaacaatctttctggtgaaatcccactgagcttatccgacttgacatatttaagctccttggatttgtcacataacaaatttgttggaagaataccacggggaagtcaacttgacaccctatatgcaaacaacccatccatgtatgatggcaacagtggtctatgtggacctcctcttaaaggaattgttcaagcgttaatgcaccaaagcatgggaaacaaaacataagtgtggaggatactgaggctgtgatgttcttttattttgggcttgtgtcagggtttgtgattggtctctgggtggtgttctgcgccatatagttcaaaagatcatgaaaagttgcttattttccaccaaggcggcaacttatacgacaaagcgtattgttttgcacctgttacttgggccagggtaaataggcaggcaactgcaaattaagcacttcaaatcatatgcttgttctgcttcctacaactgacaggtttactggtatgaatgaataaatgaaggtggaaaagcactcaaaagaaaaaggcattctggaaacctttggttcctgtggtagtggtgtgacagtcaatgttgtctgatagttgattaattttctgcccaccactaaccatatgtaatgtagtccaccatggtataatttgtatcatcagttgtggatgagcttggttagttctttgtcagattcantgtgtttgtgttaatcggtcttactttcagagattccctaaactgtaaggggattctcagccatagtagtatatacccgggatcaatattttcagagaaagcacccccactcaccaaaatttatctgaatcatgatttgggtccggttcattcacccattcttcaatttagctgtctagtatcatctcattgctttactgcacgcatatgcatataatagattaatcttaccggaaactaattttgtttccttgaactgaccattctcaccacaaaagcagagcaaaacagaggacaaaacaggggataagaggaaaggaggggaggtatcaccagtttgctccaagaggacaaggcttcttcaagttcttcgccgtcgccgcctgcatgcaggagcggatttgatcccgctccgcatccggggtagggtggccgcgccatgcgctccacgattctcctcgccgaatcgaaggcaaccacgcgggaagagatgagttcctcctaagtcaacaccgcgagcgcggccgccaccgctgccgttggccaaaacgcggccacngcngttgccctctccttcccttttctccgtaccggtaataggagtatgagataacccaagggcctatataaaaaaatctcaatctttgcgcggtttcacacctgtttttaccttgcatctttttattaagtgacgatttcagagctgtttttagcgctcgattaagcttcctgtcttgtaaagtcaaactgtatagaatgtttaaattggtgggagcaataatgtaacagcaaaattgaatggagtagttattatgttagtgctcgttgttgctgtactgctgatgtataggggatcctctagagtcgacgtgcaggcatgaaagagtagatctatataagcacgc

SEQ ID NO: 88881 - DNA, 1646 bp, Oryza sativa
aacaacctaagtggttcagatggccacattccagggttcataggatcttttaggaacttgagatatctgaacctctctggcatgccgttcatcggcgtggtgccgcctcagcttggtaacctctcaaagctgcaatttcttgacctctcatcttgcatagggctagaaatgcagtcaagatcaggcatgacatggttaaggaacatacctttgctacagtatctcaaccttaattcggtagacctcagcgcagttgataattggcttcatgtgatgaaccagcttccttccttaagggttcttaatctctctaattgctcacttcaaagagcagaccaaaagctgactcaccttcacaataacttcacccggctcgagagacttgatctctccgggaaccagtttaatcatcctgctgcttcttgttggttttggaacattacaagcctcaaggacctcatactttctgggaacagattatatggccaactccctgatgcactggcagatatgacatccctccaggtcctcgatttttcgattaatcgtcctgtacctatctcaccaataggtctgcttccatccagccaagcacccccttcctccggtgacgatgatgccgccatcgaaggcatcactatcatggctgagaacttgagaaatctatgcagtttagaaatcctggacctcacacagagtctctcatctggaaacataactgagttaattgataatttggcgaaatgcccggccagcaaactgcagcaattgattttgaaatacaacaatatcacaggcatcctgccaatatcaatgggagtgttttccagtttagtataccttgacctctcacaaaactatctcacaggacaactgccttctgagataggcatgcttagaaatctgacatggatggacttaagctacaatggcctggttcatttgcctcctgagataggtatgctcacaaatttggcctatatcgacctaggccacaacaacttttctcatctgccttctgagataggtatgctctcaaatctaggatatttggacctaagcttcaacaacctagatggagtcatcacagagaaacactttgcgcatctagcaagcttggagtcgatatatttgccttataattccttggagattgtggttgatcctgaatggttacctcccttcagactaaagtatgcatatttttattgttgtcaaatgggccccatgtttcctaaatggctccaaacacaagttgatattattgaacttgacatagcaaacacaagtataaaagatacctttccagaatggttctggacaacagtttcaaaggccacatatttggacatctccaacaatcaaatccgtggtggattgccaacaaatatggaaaccatgttgtggagacattttatctggattcaaacctaataactggtgaaatacctgaattgccaataaacctcgaaacactggacatctccaacaattacctatcaggacctttgccattcaacattggagctccaaatcttgctcacctgaatctctactccaaccaaatcagtggacatattccaggatatttatgcaacttgggagctttggaggccttggacctaggtaacaatcgtttcgaggga

SEQ ID NO: 88882 - DNA, 741 bp, Oryza sativa
atgaacggtggtgtgaccaaccaaccgtataggcgaggacaccagtcggcggcgacggaggcaggccggcggtgaagtcgtagacgcccaacagcggcggcataataggccagccgtgcaggcggaagcaccagtcggcggcgacggaggcaggccggcggtgaagtcgtagacgcccatgaacggtggtgtgaccaacctaccgtataggcgaggacaccagtcggcggcgacggaggcaggccggcggtgaagtcgtagacgcccaacagcggtggcataataggccagccgtgtaggcagaaacaccagtcggcggcgacggaggcaggccggcagtgaagtcgtagacgcccatgaacggtggtgtgaccaaccaaccgtataggcgaggacaccagtcggcggcgacggaggcaggccggcggtgaagtcgtagacgcccatgaacggtggtgtgaccaaccaaccgtataggcgaggacaccagtcggcggcgacggaggcaggccggcggtgaagtcgtagacgcccaacagcggtggcataataggccagccgtgtaggctgaggcaccactcggcggcgacagaggcaggcccgcggtgaagtcgtagacgcccatgaacggtggtgtgaccaacctaccgtataggcggagacaccaatcggcggggaccgaagcaagcccggcgtgaagtcgtagacgcccaacagcggtgggataataagccagccgtg

SEQ ID NO: 88883 - DNA, 580 bp, Oryza sativa
acaatcgtgccgccgctaggaaaaatacattcttgtacagtatatagattgttcccaacacgtgcatgaaaaaccctatcatgtcgcgccatgataggatgttgtcttccaagaagtagcaggtgatgttgtccgaacctccagcatggaacatcagcaatgcggcccaaatggtcaccagctgcacggactgggacgacggtgcgctgccgcggatggaggacagcttgccaagcgcgaacgtcggggcccaattagccaagtggtacgcaagccacaggaccaacgtctccatgcctgtggctttgcgccggcgaacatcgccgagaaagacgaggaggagttgtgccacgaagctggagagtattgccaaccggatcatccacgcattccagaagagctgcaagccaatcatccatccaggcatcgcggaccctgctatagtgaatgggtacatgttagtccgcaaggacaaaagattaacgcaaattacatgttaagagatcaaggacaacaactgatccaggatatataaaactgaatgaatatccgttacacctcccagtataatcactgatca

SEQ ID NO: 88884 - DNA, 727 bp, Oryza sativa
aatttggggtgaaggttgcttcttgcagacactgaaaagtaaaactaacatcaattctagttgcttctattatgatagaagttatggcattattacttagcactaaattctaattaatggtgaggttgcattcttccatattaccttattggggtttgatccttcctaaatctgttgcctaaccatgaattagtcatctacaattttacttaaccagaaacatgcttaaatgcagttgttccggacagaagcttgttcacattggagacaatgcagatgcttacaaagttgagaccatttgtccgtagatttttaaaagaagcaagtgatatgtttgagatgtatatatacactatgggtgacaaggcttatgcaattgaaatagcaaaacttcttgaccctgataatgtatattttggctcaaaggtgatttcgaactctgattgcactcagcgacaccagaaaggtcttgatgtggttcttggagatgaaagtgttgcagtgattcttgatgacactgagtatgtaagtgcaaataatccagtgaacatggttgataaacattttatatgataatactgccagtaattaccgtctgtagtttgttagaactagataatgtttactttggccactgaaagttagaaatggtctctgactgtgatatgattgcttctacacagcagtagaaacattcatcctgtattgattaaatgttgaagggctg

SEQ ID NO: 88885 - DNA, 567 bp, Oryza sativa
agaagatagcatcagttggcgttataacaggccagccgtgctagcggtgacatcagtcagtggcggatgcggcggccggccggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcagcggcgaaggcaagccagtcggtgaagacgtagacgcccaacaacggcggcataaaggccagccgtgcaggcggaaacaccagtcggcggcggcgaaggcaagccggtcggtgaagacgtagacgcccaacaacggcggcataataggccagccgtgcaggcggaagcaccagtcggcggcggacgaggcggccggtcggtgaagacgtggacgcccaacaacagcggcataaaggcca

SEQ ID NO: 88886 - DNA, 1154 bp, Oryza sativa
tttctcaaatcggcaaggggacaagcccctttctccccctccttttcccctttttcctcctcgccggcgtcatcccccctgtcgccgctttggccgcgaccgccgagcgccagctcgcgcccttgaccgcgcaagtcggtttccaaaccgacattgccgccccctataaacccaggcgcccttccttccccttttcccctcccatctcgctcgccgcccccgcgccattgccaccccctctgtttcgccgtcaccgttcgtcgcgtgtgtgccggaggagccggtgcgcactaggacgcggaagggagcttcggccgcgtcctctccttcctcttccccggcccgaggccggagagattactcccgcgccgtcggcctctcatcacagcgcccctcctcttctcggtgatgtctctctccgttcttcctcctcgctccatctcctccccctagctttcggtagtagctcgagtagcctccccgtagttagccggcgccgccccgaccgttgccgtcgctcgccgtgtgctcgctgccgtcgccgcccgagctccgtagcacccgcacgtcgccagcctcgctcggcgtagctccgcccaatccgacgctagcgtcgagttcccgtggcggcgaggatgctctcaccgccgggaatcgacctctcgtgacctcgtcgtcgtttccctcttctcccgccgccggttgccgccgccgcattccgccgccgtcgagcaacctccggcgaatccgagccgttggctcgccttcccttgtcacgtgcaaccgcccggtgtgctcgtcgttgcccgtatcgccgtggttcgctccgccgctcgccgctgtcgcccgccgtccattcgcggccgggtcgtcgtctacctcccgccagcccacgtggcagccacgtaggcgccacgtcggcgccagcccagccgaggtcgggacgggccgaccccggtcagtccctccccgtgcgcgcgttccaccgcgagccgtgaggctgcgcgtgggcccgccgcacccacgtccaccacgaaccacgcgcgtgcaccgcgtccttcccccgcccgggcgcatgagccgcgtactccctccgcacggtgagccgagccgctgacaagcgggtctcagggtaacagtcgaatccaaacacg

SEQ ID NO: 88887 - DNA, 1834 bp, Oryza sativa
  unsure (1)..(1834): unsure at all n locations
ccgccgtgtgattgacanacgagctcggtacccttgtgattttgtggtttgtttcttcgattggatgttgaatttcctggttctttgaaaaaaattcgaagtgataatggtggtgaatttgaaaatgcttcatttgaacaattttgcaatgaaagaggtcttgaacatgaattttcttctcctcgtgttccacaacaaaatggtgttattgaaagaaaaaatcgtgttttggttgagatggctagaacgatgttggatgagtatcacactcctagaaaattttgagctgaagcggttaacactacatgctatatttcaaaacttggaaaaacttcttatgagcttcgatttggacgtcaacccaaagtttcatatttgcgtgtttttggttgcaaatgctttgtcttgaaacctggaaatttggataagtttgaggcacgctccaccgatggaatgtttcttagttaccccgcacaccctcgtggctatcgtgtacttattttggaaactaacaaaattgttgagactagtcctggtactagaccagaaattgcaagtacattgtcacaggtgcaggagtaggatggtcatatatttgaagacgagagtgacgacgacgacgaggtcgactcggccggttagaccgggcgccaggccgatcagaccgccggcacacctccggtcagacagcctcaggatgagcggtcagactggccagggtcgttggcttcccgttctgttcatgctgatcgtgatggtcctccagaggctacaacttcgaccaatactggtacagaacgtgaaacaacttcagaagtcgctgctcctttgcatattcaacgacgacatccgccggaacaaatcactggtaatctaggtgagcggactataagatctaaggtaacgactcatgatgtttctgcaaattctgcatttgttgcttcttttgaacccagagatgttactcatgcattaactgatgaatcgtggattaacgccatgcatgaagaacttgaaaattttgagagaaacaaagtttggactttagttgaaccaccttctggacataatattattggaaccaagtgggttttcaaaaataaacaaaatgaggatggtttgattgtgacaaataaagctagacttggttctcaaggttttacccaagtggagggtttggattttggtgaaacttttgctcctgttgctagaattgaggcaattagacttttgttagcttttgctatttcaaaaggttttaaattgtatcaaatggatgtgaaaagtgcttttctaaatggttttatataggaggaagtttatgtcaaacaaccaccatgttttgaaaatcctgattttcccaaccatgtttttaaattgtctaaagctttgtatggcttgaaacaagcaactagagcatggtatgataggcttaaaaattttttgcttgcgaaatgttttacaattggaaaggttgacaaaacacttttagttcttaagcatggtgataatcaactgttcgttcagatttatgtggatgatatcatctttggttgttcaacttacgctttggttgtggagtttgctgagactatgcgcagggagtttaagataagcatgatgagtgagttatcatactttttgggattgcaaattaagcaaacacctcaaggtacatttgtgcatcaaacgaagtacaatgttaacatcaattggttctacagctgtgttggatcctgatgaagatggtgaagctgtaactaacaacatgattgaatctttatcgcatctgattgcttctaggccagacatacagatttgctgtgtgtttgtg

SEQ ID NO: 88888 - DNA, 2590 bp, Oryza sativa
ccagccttggaggcgtactgtgaggcccgtcatcgcggggctgcgatcgaggcggggagagtatgaatcggcattgattcacttgtgcataagtatcggtagcgtgtatttgacattatattaactaattgatttacaattgctaatgcaggtacttcaaccgctccgagtcagagctcatgcccccccagtgttcgacgataggtacatcccgtacctaagggcggccgggttgcttggggtggccttggtcgtgagcagaggaatgccagtgttcaacgctcctgcgttgacagcacttgtggacagatggaggcctgagacacacagcttccacctccccagtggtgagatgaccatcactctacaggatgtggctatgatcttggccctcccattacaggggcatgtcgtgacgggcaggacagagactcctggatggcgtgcacaagtggagcagctgtttggcattccactgaacattgagcaggggcaaggggggaagaagaagcagaatggaatacccctgtcttggctgagtcagaacttctcacatcttgacgacgacgctgagccatggcgtgttgagtgttatgcccgtgcatacatcttgcacttgttgggaggggttctgtttcctaatgctgggggtgacattgcttcggcgatatggattcctttggtcgccaaccttggtgatctgggccgtttcagttggggctcagcagtgttggcgtggacatatagacagctctgtgaggcctgttgtcgtcaggcactatcatccaacatgagtggttgtgtgctattgattcagctgtggatggggttaagactaccggttggaaggcctaagtggaggcaaagcttcactccttggccctacaatgagccagacatggagaagacagtggcctacctttttgagagtactgccactgcacatgctcaccgggatgtggcatacaagcattatgtcaatgagatggactgcttacagcctcaacatgtaagtactttcaatatcacttctagttagatatttacttctttaattgagatactaaccaacgacatctcttcaacttttgcagattgagtggttaccataccacacaaatgaggcttcaagcctgtccttgaactcgatgtgcaatcgagactctgactatttcatgtaccagtgcccattggtttgtttctgggcagttgagtaccaccttccgcaccgtgtcatgcgacagttcgggaagaaacaagattggccgcttgaggacatctcaactggagttaaattacacaagtaaatatttcttatctttgtttgctttcattgtcaatgttcaattttgtaccatttaacccttgtcgatgctcactattgtttcatcaccttctacttgtctagatatgacagggtgagaacaaagaaggtgaaagactgggggctagagcataatagatacattgatgaatggaggacagccggaaggaacgataggtacatcgagactatacaccaaaatcatcttttctcagagtatcttcgttggctgcataggacatatagactgttcctccgccctacttggacggaagccgacatagaggatgaccacgactccgatgaggggcggaatccctatgatgtccggactagagttggatatcaaatggagcacgccccacttagagacagagtcgtaagttttcttgcatttgtcaaagttatttccatttgcaccctagaccctaacatatatcttctcacgctttcagtcgagagagctcctcaggaatgtgaatgaaatggggcatgccctccaagctccgaggggtggtgaggacacggagaacacactccacaatgttttagaggtaaaatttatttagcactttgcattacttgagttatgcctaacaaacttctttttttttgaaatgcagaaagttcgtcaaaggtgccgaaaacttgcagcaagattaggttgcaggtcggttggattggacgacgtgtaccaaccgcggagactaccaccaccactacctcaatccgtgcgtccaagtaccgctcgatactccatcaggatagaagagcgtgaaggagttggtggctcgtcgtcgtcacgcattaagcaaggcgccggcaccacctagcgatgacgatgacgacgaggacgaggaggatgaggactacgtcgcaccagacgccgaggagatagatatgtcgcagcttcccgacgcgcctcaggggacgcaacccacgcaataaaacttgcgatccactcaggcagcaaaaaagaggtaaaatgagcttaccattctcaaatgttatttgatttcccttattttgtttttaaaatgttttaaacattggattttcaaatgtaggtacactccgggctcgcaagcaattcggcgccaacggaagaagtgatttgtatgaagttaatctattggttggtagtatgacatatgtggtgcactttgtgatataaaatgtgatggactatgtgaggactatgtgatggacttttgacattgtttcatgtgtggaatataggatggacttttggcattgtttgatgtg

SEQ ID NO: 88889 - DNA, 531 bp, Oryza sativa
ctttgaagaaaagactttgtttcttcgatttatgcaagaatttcaccatattttgaacataaaggaaattgtcgtgaatagcccttttgcgaatgaaagcactttggtttggggaaacaagctcatgaagctctggggctagtctgtttgccaatagcttggaaattatcttcgataagctatgaattagacttatagggcggtaatgctctgctccattagcgtcatcttttttggggaggagacagatgaaagccgagtttaagtcacgaagttgcaatgtatttagattgaagaaagaaattactgcctttagcagatcctctttgattatctcccaggcaaccttatagaaagccttatgaaacgtctggacctggtgccttttcggccggcattgagaaaatagtcgctttcagctcttcttccgtaatgtcctcttctaaatcctcaaggtctaaagaaggtaggttcaacatgctccaattaattccagatcctctttggaaagaagttcccaatctctctttg

SEQ ID NO: 88890 - DNA, 731 bp, Oryza sativa
ccgctcttgattgtcgagctcggtacccgttgctgatgtgataaaaaatgcagatgttgtactgtcgactttgactggtgcatcttccaaaaagctagatggtattacatttgatttggtcattattgatgaagctgctcaggcacttgagatggcatgttggatagccttattgaaggttaatactaacttatgactagttttttttttcatgttgctgcacgttttgagaatgatgattgctgtaaacagtcatcaaaggttctcgtattatttatgcttttttgaatagcacaataaagatagcatgtactgtttcacaaactcccacccacgcgcgcctgtgatggcggcggcggcgaggagcccacgatctgcggcgttggcgaggggaacacgcccacgcgcttgctgtggcggcgaggaagaagagcccgcgaccaccggtggcggcaaggggcacgtgagattagcgtgcacgcgctgctgccgccattgcagcggcaggcgatctccggtgttcggtgcggcgggcttccgcaagtcacacgtgtcccggggtttacccatgtgctgctgcgggccgaacgcggccgagtggccggcgttcatggcgttagcggcgtgtttgcgtaacacaaggtggctgccgttccgggcgccggccgtgtgctgttgcttgagcacagggcaactagggaacggggtgactgcgctggaccactaccggt

SEQ ID NO: 88891 - DNA, 1236 bp, Oryza sativa
gcccatgattacactcgcacccaagctgaaattttattgtctctaataggtttctatggagaaatttcttaagcggaaagcaccagattgtacaagcaatgtggggagttcatatcccttcgactagatgatgccagttgggaaaagacgatcgaatatgatccaggctcaaggaaaggaattgatgattatcatcccaaccaaagagccaaggtgagaagaaagtactcagagaatgggccttgccaacctggtgatcatgcttttcccatatcagttatttctaacaaagatagaaaattcaatccggcatggtttgatgagtttggtggatggcttgagtacaacaagtccaaagatagagcatattatttcttttgcttcttggttagggaccggaataaaaagatagagcatattatttcttttgcttcttgtttagggaccggaataaaaaggaggaaggatacaaagcatttgttaacgttggttggaatggctattatagaaaggataggcttaaagagcatgtacgtggagttggtagcttgcacaataaccagcattgttaggaacttatgatggttgcttggtgggctcttacgacaaaaaaaaatatttcgcacactacatcgttggactaggttatgactatttgtatttggtctagtgacaagcaccttattttcattagtaataacacccacccctattggacaatataaacccgaatggcatattgacgaatagttttaatgtattaagaaattcgtcacaaaaatccgagcctttcagattccgaccctgatttattattcacggttttttttgtggtttcccagagtcatggaactaaccactatgggggtttgggtgaagcctccttgaagattgggaaaaaaggggaagggtgctttttatttattttcccaacaacaaagcaggggtgcttggaaaatttttgttttttgaggcagccacacaacttcttgtcacaaaggttcaggggcaaatttcgggggtccccttttcctccttggaactcaaaaattttgaccgggctgttcctctcccctaaaaattcggaaaaacccccccctttgtggggcttttgcaggttaccaatatgcccctgttctttataactcgttaaaaaaaaatagtctggtttggcagccccacaagccatatatttttgccggcccaaaatgggctttatccacaatatgtgtgtgg

SEQ ID NO: 88892 - DNA, 525 bp, Oryza sativa
  unsure (1)..(525): unsure at all n locations
attganacctgtacatcngtgctcggtaccctattattgattttgttgagattggcaggagttgatacatgaaaagctcatgcatgtttcttaatttaccggacactgattcaaagaaatttgtattttacttcaccattgctaatgcccacttatgtttttcttctctagtttggaacacacgatgtggttgctctgaagccaaataaggcagatgctggatctgctgctcttgggcaaggtgtagtttatcgcttgaaggtacctaactatcatctaagggctgttgactatttaaagtctttgcttctgaattaggagaaatgactgtaatttgaacaaacaggattcttccattactgttgcctttgatgacattcctgaagatggattaaatagccctctccgccttgaaaagcttgcaaatgaggtatattttccatgctgttttcattactatttgcaaatgacattccattactgttttcttctctactatattttccatgctctctcttacaactt

SEQ ID NO: 88893 - DNA, 612 bp, Oryza sativa
  unsure (1)..(612): unsure at all n locations
tgtgtggntcantatacgagctcggtaccccggggcccggcatcttcatctggaggtaggcgtagtggaccgccgccatgaacttcaccaacgcgggcctccccaggaccgcgttgtagggcagactgaggtccgccacatcgaagttcacccgctctgtgcggaaattggcgggtccaccgaaggtgaccgggaggtcgatatgacctagcggccaagtgtgccccggcgtcacgccgatgattggctgggacggccggagcatcatccccggggccttgatggcatcaaaggctgcgggggaaaggatgttgagggctgctcctccatcaatgaggacacgccccaacttcacgttgcaaacggtgggagaaaccaccatcgcaatctgccctcccctggcaacgcacggcgggtggtcggtctggtcaaaagtgagggcaacttccgaccaccgcgcccggcgcgtcgcctcatgagtaggggccgcggccagaagctctcgcttcatagccttgaggctccggcgagaaacgtgagcacacgctcctccatcgacggtggcaatggtggccccaggctcttgggaaacccagtcatcatcgccatcac

SEQ ID NO: 88894 - DNA, 665 bp, Oryza sativa
cgagctcggtacccattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagcacaaagtacgtacgcgagcgacgtgtacgcgcctggacagtgcacggctgtcaccctcgtgtgccatatttaatttcgcttttctttcgatttttgatcttatcgacgttgattggtacggaatacctcccaaaaccgaaaattatacagggagatttttttttttcttg

SEQ ID NO: 88895 - DNA, 537 bp, Oryza sativa
cgttgcaaagagctcttccgcttctgctatcatgccagataatttgcagtcgacctatccagtgattgttccagcttatttctcgccctttttgcaattctcggttcctttctggcaaaatcagaaagatgaagatggtcctgtgcaagaaacacatgagattgtcaagcctgttccagttcattcaaagagcccaatcaacgttgatgagcttgttggcatgtcgaagctcagcataggagagtccaatcaagagacagtgtctacttctctttcattaaatctggtaggaggtcaaaatagacaatcagctttccatgcaaatccaccaacaagggcacaggcatgatctccttctgcacacaactgcatttagatgaatcccaggcaaaataagctttgcctccttgtttttttgtttttattttaagattaaccgttctccgtagtctgtatcatgtgctgtaagttatgctatgtatgaatgtatctgttgtttgtctggcacacatgataaatcactctatgttaacaaaa

SEQ ID NO: 88896 - DNA, 671 bp, Oryza sativa
cttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagc

SEQ ID NO: 88897 - DNA, 696 bp, Oryza sativa
  unsure (1)..(696): unsure at all n locations
agtgcatgagatgcaatcgacngccnnnngnnnatntagaggatcccctggcnnnnnnnnnnnnnnnnnnnnnnnnnnnnnnnnnnnnnnnnnnnnnnnnnnnnnnnnnnnnnnnnncttgctgccgactgatggtgacgccgaaaactttatgaaatcgcatgttgagccgacgattcgcgatattccgtcacttctggcgctggccccctggtatggaaaaaagcaccgggacaatacgctcagtatgaaacgcttctccaacggtcgcgggttctggtgtctgggtggtaaagcggcgaaaaactatcgtgagaaatcggtcgatgtccccggttacgatgaactggcggcattcgatgaagatattgagaaagagggatccccgacgttcctgggtgataaacgtattgaggggtctgtctggcccaaatctattccggctcaacgccaaaaacaaaggggaccctgcagattgagcgtgcttccagcgagttcgggcatttcatgcgttttcatgttgcctgtccccactgtggtgaagagcagtaccttaaattccgcgacaaagagaccccgttcgggctgaaatggacaccgggcgaacccttcagcgtcttttacctgtgtgaacataatgcctgcgtcattaagcagcaggaagctgatttcacttgagctcgttacattctgcga

SEQ ID NO: 88898 - DNA, 509 bp, Oryza sativa
attcctgcaccccaaattcgggagtgatcggtgaagtgtttaatatggttgacttcagtttcaactgatttgttcatcgagcttgctgtaactatggccgcatattgctgcaggaggaggacttgaagcaattcaggcaatggggaagcaagactccaggccatcccgagaacttcgagacgcccggagttgaagttaccactggtctgtcatctcaactgaagctcatagcacctttaagttctatgcttgaatacatacagaactgaatgtttcggtttcttgtttggtttcgttctgtaggacctcttggtcagggtattgcaaatgcagttgggctggcccttgctgagaagcacctggctgctcgtttcaacaagcccgacagcgagattgttgatcactacacgtaattttttttttatcatgaatacctttagttttcactttagttatggtggtgcaaccttggtaacatgattcatggattttgtgcagctactgtattt

SEQ ID NO: 88899 - DNA, 602 bp, Oryza sativa
agcctgtcggtattgtactatgttgcagaagttgactttcacctgtatagcagaagtaaaactataagaatgacggaaatacgatattgttgtagaaaggtaggactacgagaacactgaaaataaggcaataaagaaacgtgaaataccttgttgccttcaatgtctgggtcctcagcaggatcactaccaatatcatgagaacactggggtgaaacactggctgaatcatcccgagggatgtcacagcggacacgctcagaactacattgagaggcggtattgattgaatcatctagaggggttcctgagctaaaatgctcagaactacactgataaacttgaatgttatttgatggcaagctagtatcttcaattaaatcaggggtaccagagtcttcaattgtgggactgggcaaagacccattaagtacttgttgcttaggtgtaaccttaggtgctctgaacttccgttttgcctcaagcgatgctaagccttctaaaagtcaaggattcatccaatggacagttgaagtattgtttacaaaacaagcaaaataccatgctaagaatcgcacatcaccttagacttcgtaaataag

SEQ ID NO: 88900 - DNA, 3454 bp, Oryza sativa
atgcattatttatcccaaaaaaatatttttagataatgaaataaaaaaaatacgtatttattttttaaaaaaaaggtcataaaaatgaggagcattcatataaagataggtataccaatgttcacaacatttttttttatgaatgctcctgataaaaaaatccattgtcctattaaaatttcaaataaaaattttaattttttacatttattttattttcaaaatttatgtcaaaattttctgcactaattatttagtctcattagttttataaaatgcacacgatgtgcactcaaacaaaattttcaattatttttgaagcttatatttaaacctaaagcatcaagggcaaaaaagacatttgcaaccaaacgtaacagtaaaatgatggaaaatgtaacggtaggggcatggaagggatcaaattgaaatttcaggggtacagaagggatcgggtaaattttaggggtatgaaagggattgagtgagttttcaggggtacacagggaatttactctactttgtttccttcgaattgtaaggattccagtaatacttgtctatcagagttacagttcatatccaaactaaatcagtcgttcaaaaaataatgccatatgccagtaacttagtaaagatgtagatcaaattgtgtttacactgcaacaaattctgttgcagataagtacctagcataatggatatccaagagctgatacaaaacatgactgccatcagtaaactagaacggtaaacgacaccaatggagtagcattgttcaaatggcatattgtattcgactctattaaaacatttacagttgtgttcctctaaaccgaggaagatcatgcaccttgaatgaagttgagctgctttattctttgaaacaaagttattcatcttatcatacaacctctcactagcctgccatttcaattagtgttagaaagcagagaccaaattgtacttaaaacaatcttaaacaacagtacaacacataactcacatcagctatgtgaatgtggcgaagctcaacccagagaggatcatgatcctccaataaagcctcctttctctcaggttctgatcccgctttcgacaccttccaacagaaattaaacataagaatagggcaagtgaacagatcatgttcattattataatacgatatcacatttacctcatatatgtatttttggccatccatttcaagtagatcatggcacattgcatcataggtccattcatgaataacaggtgctatctttgcagacatacggaaattattgtaagcagtaggaaagatactgaatttcttcaatatacttctacactgacaagttattgaaacataagttatccttcagcacctgatctataggcctgtcgacaatgagcagttcacatgtctccttctggggaaattcaggtattgttgatttatattttgacacaatatcccaaacagcagtcgctaaccattttggaaccatgtcaaattttggtgttgtcattggatctgtgccctttggggcacgataccgcacacaaggaaattcctgttataacttgaatcagattgtgtttgacaaaaaagaggaataatgatgctatatatatttcattgatagatttaaagactggaagaatacataagaacgatatgagatactcaaaactgctggtgtccagtagatcattgtatatgtataccttttaaaatatttagttcagaaatattcacaaggggaaggtatagtctgccacaacaacacacagccacaagagattgctaagacaatatcacccacttaagtcagttaccaggctattaatgaagttctgtgaagtgcattaacatgacatattctttgcatttttcaaggaatttaatatgtactttttacggcctggtgattcaaggaaggagatcttcagggttggcacttttggctggagaaatgggaatgaaaaactgacaagcaagaacatatgtcatcaaacattttggaaccatgtcgatcaggaaaaaatacatgctacacatgctgaattggaaagacagttaagaaatatttcggtaatgtgatgaaattagtactagtggacaggaaatagataataataataacaaatgaagtatgttaacatgccttcaacgaagcaaatgtggtagcaatgcgagtagccatagtgcttatagtgtcattgaactttttcgagttgtgctgagcactatataaatcagtgaatgccatgtcatggtcagttgtgaatccctgcagatatgccacatagagaaatcattacattaatcttgagaattcggatttctattttttttaaaaaaaaaagaacagaccaccctaatatcaaatgaaagaaccagccaacagcatgcgaatacatccacagtccatccaacatgtgtagcatggtagcaggcatcatttgctatgttttcaccttcggtaatatcacgaatatttcaaaactggaaatgaattcatttgattgatgcaaatgaaccgttttaattttccttcacggtgcaaatgcagttctaaattgtccaaacttcttatcaatcaatgctagttttatgtttgcgtccagttgcttcttataattgccatatgtttatcatacttgacagtaacaaactaaaatcagaactaaatagattcttagccagcaatgaagaaaaaatatgcataactagtagatcatatagatcgaaggctatgaatacctgcatgtcaattgcaaagaactccaaattcatctggaattaacaatatcggcattagaaaatccatctgtaaaaatcaaagaaataaaaggtacaaactacaggataattaacctctcttagtgcaccaatacgtggtatcacactgctgtcgttctttatgtaagagaccagctccttaggaatcggtgaactaaagaatatgtatgccctataaaatcaagtgagatattaacatgtgagtcaaaattttgttgcatttgaagcttttgtaattggcattccgggttacaaattgaaaattcggtttgacatacttcctgtacagtggacatctcccagacatgtcagatagaagcattatgacactgcaggttgcgaggctcacatatcagagaagattcaagacaatataacttcaaccgttgattatgcggcgttaattaattaactagcagaaaaatcgtctaaggaaaaaaggttgcaccaaaaggaaatgcagtgttacagctttggcttgagatgcatatatgccttcagtatcatactatagactacacactgactacaacctaaaagaaatatcataatcacaaaatgaatcaaagacgagatcattactccacgcatatggtacttgcgatcaattttgctgctgcagaatcataaaacgaaagcaagtggtcaatggcgatcgaataa

SEQ ID NO: 88901 - DNA, 4244 bp, Oryza sativa
cacaccgccaccgactacggcgtgctggacttctcgccggcgccggtgttcggcacggtgccgatgagggcggtggacatggcggagaaggtggcggcgggggaggccatggccaaggcgtccgtccacacgctcgagatcggcggcgagctctacatggcgtacatcttcttccacggcgacgacggcagccgcgtcgtcgaagtcggcgtctaccggatggacttccggaggcgcagggcggtgagggtgcgcagcgtcggcgaccgcgccatcatcgccggctccaacatcggcgggtggtgccccgccggcggcgagacggggctgcgacccaactgcgtctactggacgagcccgtacgataaatgcttgcacgtgtgtgatattggcgccaacgccaggaaattgcgagagccttttaaaggactcgcgaagctgccgcatagatcgttttggatcatccctgtgcataagtgaactattccctccgtctaaaaatataaagaattttagacagatgagacattttctaatactatgatacgaatctgaacagatgtctcatcagttcaaaatctcttatattttagaacggaaaaagtatatatgtataattagttttccttttatttcttttattaagataatataatctattccggcctacttgaaataaaccatagcaaattattacaatgatttgtggctcaaatgattgtgaattattaaatttcatagctcggttaaaaaaaaaactatacaaactcgacagatacgatacacattgaacttacatctataactagcctataaagtcgcacattcgcacctctataaccattttccacatcgccataaataactcgatttcacgacgaattatcggaatcgattgatccatgagtgtaatcgtcaccatgtcattgttgtagtgttcataaatatacaaatttgggcaaaacaactgtcgcaactgttctacgttttacatctgaaagaagaataaataatgtgggcaaaatatgttgtctacatacatgttttaagtacatttgacacttcttctcacttggtatatatactagactatgaaaaaatcgtgtaattattgtgagtagtccagtcattgatgacatccaacgtttctaactgttcgtagcaatgggtttctgcaatatgaagcagcatacatgtttgtgttaaaaggcactcgaattattattattattttgaaacaaagatactccaaattgaaccaacagagtggagaaaggaaattataagagtagacatgcagtacgagcaggtaccttaccaaaaggtgacaagtttgtttcatcggttgatttgcaaactaagtgcgaagtttagacgtcattggcaccacctgcagttagcatcttcagcttctgcatttttgaattcaaacaatgagtacaattggtcaaatatcgcctggcaattccacatttaaaactaatgtaacagtataatccaagaaacttctatttgccgcaacaggattgcatgataatggtaaaagaaagaaattcgaatacattattgtgttgtacaggatgggtttaccgaaataaattgtggagggtcatctatgctagaagatcccaggacaatttcgcgcttcagtttcatagtaagcttgtgcaccgtccgcagctgatccatttaagtgtaagaattgatgaccacataaacagaatgggatttgagttattaaatagtttgcagtaaatggcttacttccgatctagtggctccaccaatcatgaagacaaaaattcggttgcctagcctcttgaagtcattagatccatgtctcaagaccgaggagtcactgccaatccagtttgtgatgataagaaagcaggtaaaaggtatgaagctgatataacacttttactagaaaaacttttatatggataagtggttcaaatagaaaattatatttgttgaataccttgattgactatcatcagagtttcgagacttagcccaggttggtgtccgccgcgatctcctggacatgggttgtgcttgtgctggtttagtcgcggctgcactttgtgtagatccttgttcagtggaactgggttcactcatggatgggtattcattcaaaggtaatgcacctttgctcagtttctcaatcaactcctgttagagaatgaatgcaagtccttaatttaaacaacgaataagaaccattattttaagtacgatttgtatataaccactcaacaaaagtattatccaacaggcatcaccaaaaatcattgccactatgtttgttattatccagttcagtttattacgaaccggattttattaacagaatgtgaaccacattcttgaagttcccatatttagaaatttgctatatgttggtttcagaaaaggtgaataatagaatttcataagaaaatattcttaattgtactaagcacacagaaataaattagccaaggagatatttgatgcaggaagtttagaagtaaactagtagtaatagttataccacatgcctctataagtgggaaaaaacgtgataatgcccaggtttcatcgccatcctgccgttctgtcctcgcagcattttttttctggtatataagtcaagcacacatgttagttcaagggaagaaggtagaaataatttagctcaaatcatgacctcaccttttgtgcatcaaatttgagagagaagccgccaggccgtgatgccttttttgtatctgaaccaaccaagtatcttaaactatttatggcatccatctcatcatgtggcagttttgctagctgcataaatgaaagtttgttcaaaatgtcatatgtttatataatcaactgcatgcaattgtaccccccaaaaccaactaatagaaccctctgtgtcacattttctttagtaaacactccgaatagcactatagaagcactcaaggaaaccattgaacaatgataatagtcaacctggtaatctatacttccacgcttataacaagcaaaatccgaaactgtgtttatgtatgattatgtcatgggtaattgggctgagaggctgaggccagtggtcatcccaacaccctctgggtagcacgctactgtagtagttcgttaggtaagattagattgagtccattcttaggggttaagtcgtcccatctatataaggatggattgtatcctatgcaattatgaattaagtgataaatcagattaatccaatctaatccctctcaatgtcctaccaacctaaatctacctctcacccctagcagcagcagccgcttccacgcatctatccacccgacggtgtttatcccgtcatgtcctcgggttgtgacagattaatgtaataattgcactaataagtaatgtaaaacttgataggaaatacctgcatcaacttttcccctttgtcaccttcaaacttctctggatatacaattgcatatataataagcaaccacaatttgttttctgggctcatatcctgaacaatagaaagttcagtaagcattgaataaaaactgacaaataattagcagtaagactgctttcattctctctttcttaacaaacctgctttgacctgaggatactgatcacctccttggctgctgcatctccaaaaactagatcctgctccacctgcccaatgtcacggagaccatactctctgataaacttgttgatttttccagcaatctgaataaaagttcaatagtgagtattacattttttattattttgatgataagatagaagttgtaaaaaaaatcataaatcaaggatgaacatataagtatgtattaaggtgacaacagtcaacatgtttttctaaacaatagctgcttcttttcacatttacttgatagttcctagaaatcccgaacttatttgtaagggtaaacaaaataacataaagcacgcacaggaaatactatggaaataatcatctacctctatatggagggtcaatttctcaacttgttcaccgtattgtggcaaagcttgaacgatcttctgcagatcctttgtagaaatttcaccaccatctctaattgagaaagggaatcataagcatgcaatatgaaagaacttagaacaatgcactttctgtactttggctagcaaacaactgatcgatcaacatttgatgtaaccttgacatcaaactacaaaccacagcttactttgttgagaaaatcccttatata

SEQ ID NO: 88902 - DNA, 5416 bp, Oryza sativa
atgagtatagagatattgtgaaccaaccccataaaagttaactgaatacaagggaacaattaccattgtcatcagatttaagtgcacagcaacaagtgacaatataatccttttgtcctaccaaacacatcaattcagcaaagaacagatgaatttgataatccaattcattatctcctttggtcaatgccgtgaaatttaaatggtcaaaccacgtacagctctccataattggttgaaagtgaatgacatctttgagctcgtatgcaagaccctgaaaatagaattaagaatcagaatacaataagaatgatgggatagtaacgctagagatcgggagaacagacccctaaaagactgtgatcgtcattatacatgtctaatatcacccgagccaattggcgcatatcattatgcacatcctgcgttacttgtgatttggagtacctcctcctagttccatcaggaaaataaaggattttgcgtaccatcatgtccacaatagactccccatcccgctcctcaaacctagctcaaatcagaacaacccattattagtataaggtgaagtgaactataggtaaaaaaaataatagggggttgcagatatattgttaggtaatttttagatagcaaaatgtaccaacagtttagcgagttgaggcttaggagtttgtgtaaagagtgtttaatagaagttttaatatacatatgaaacaacaaaacactagcatagtttctggtagtcgacaacagaaaagaggcacacccatttaaaattacgcataactaacttaactagtttcgaggtagataaggtgtgcatggctattggatttagatttatcaatctttaaagcatttccctatttaaattcctaacacagactggtgtttttgccctgttgttaccagtgaattgactaattcttgtggcaaactgacaatcagtcttgttcagcatctaaggcactaggtgcgatataagctatacttaactgtacacactggaatgctgcaagcgaaattaaaatattcttggatgaaaacttgtgcaatcaggtcttactttgcaaattttcttctattccaagtattctcaggtgaaaacaagtgcaatcaagttgcctaaaattgtttcttggcaaattttatccaccttagcatggcattgttctatttgtagatataaaatcgcataccaagcacatggaaataaaaagaggatatgcaggtatcttactttaatggaggatataggatgttaagatggctagtgaaagcgtcttgagcttcatttaagctgagaaatggaccacccatatcaggatacgtgtggaacagcccactacgatccattcgaatgtggtatgacccgcggcggccttcaggaggtttgtgaacccaaatgactgacccaggggatgaggaaaggcagcaccctgatggtacagcgtcaatgttgtcttctggtactgcctgtggggaggaagagggactggaaataattggttctttcaatgctatagcgccaagaagctcccccacggacaaaacatctggttcctgcagtgcctgtgcagattcaggctcagatgcacctctcaaaaggccctcacacctgcagtgaacaagatcaattagtacaacaaagtatcttgcaaagccaatattcgatcaattagtacaataaaagtatcttacaaagtcgatattccagaatgaccattgcacaaatgccaggttaacatactaggaaatattgatctgttttctaaaatgactcgaaaagatatagccttttaccgaattgcggcatcagtttagtagaagtgaacctatgtaatacaccaatttatagtgccgttagttctatttttaactatatataagccgacaaaaggaattcaagtatcctgcctctcccctcccctcccctctaaaccgacaaaaggaatgactttcatcgagtatcctacattcccacccctcccctcccctccccaaatataagaagggtgtgcaatttgtctcgtgattgatcatcacctcattatagaaagtgtctggggaaccatcaatcctcagaaacataaatgataaataataggattgaatccaaatgcaagccctttcatcaaccttgttcatcgacagagaaagatagggaggagggaggagggttgaggtggtgttcgtactgtgtcggcagcggggctggatcacagggcttcgaccggaggtgatagtggtggtcgagtgcggcgtagagttcatcggaggttgggaacggcccgacatcaacatcgcgccccccggaggcgaaatacccacgagaatcgctgtacactcgtacctcctcatcctcacacgggtcccgctcccgccctgctgtcctggacgccatggatggggatggcgccggccgccggccggcggcgggggcgttgccggcggacggtggcgtggcggggactagggcttggtggaatcgaaatggcgcaaggcgaagtggccaacacaagtgactattgggccggaattgggctcggcccatactaaaatttgcatgactggatcgagtcctcttgcatatgatgaggacgatctggtgtcttgctgttccatgagaaatatgcctatcgatcgatttctatttggtttcttaattatgtcgctcgatggagccgcttgattgctacagtgtatttgctaaattaacctaactagcaggagcatggaggagacgaaaaaaataagcagtgtatgcgcttggtttcacggattggggtcgatttatatgaaggtttaacaataatttgagagaaatcaagctagccaccacatgcaaaaactcctacaatgcacttatataaagataggcagatcataattaaatgcagtttgaagatggacttacttaggatgaagatccgggctctggtgatccatgattatactcaatgtacagttttttttttttttgagggatactcaatgtacagttaagacggtatttggctaacaaaattagtttaagcgagcacgggattgggggcgatttatatgcatcttcttcactggacaattaacgtgagggaatcggaatcgttaccgtgttctgaacaaattactgtatgcgtagtactccctccatccttaaaaaggcccaaccgaacctaaaggagcaatccctattttcatatctaattgtgattttacctctgctatttaggtttttttggcccctgcttttttttttgatcgaatgaatcgattacacctgtttttgacggaagcaagtggacccggaatttgttaagggaaagaaatagggattttgcaaatcttgtgttacccttctattccggcaaggtcactccgtgcttactggaatagcattatactcgtatgtcttgctcttggagccatggtgctcaacgcctcaacggcagcgctgggctccggctagatagtactagctcagtgcagtgaagcaactatacgatcgagctagtacactcaagtctgaagccttaaaaggacgtggtgattaattcgtttcaaaattttgttgattattctttcaaatttgttatcttcatcaatgttcgtcaaaattttacaatagtcaaatctctgaaaattgcatatctggtctgtatatctgaagctgaaacaacgaagagaaaaaacaggaagaaagaaggaaatggacggctgagatgagctgataccgtttcgctaatgtagatcgaacgtccttgttttctttcagtaattactgtttaccgtaagatacgtcttaagcgagctaatgaactgagctgggtttgtccctattcgtggcggcagaatctatataagccgatccgatccccctttgcatctatcgaagaatataaaccctagttctacacttgttctttgtcttgcagcgcactttaaattcccctaattctgttatttttcatgcaatttcttcctgtaggatcccaagtaggtagcctctaagccaaaagtcaagttaaggttccaggtgcatttggtccctggttcctggcaacaatccagataaaaaatagtaacattgtataacattatgttaattataaaacagtctagttatattgcaccctccatgttgcaactgacatgacctcaaccaaaaagctcttcccacacacctgggtcatcaagatcctaagaaaaacattagagagcaatcatcaattttgagaagaaaaaaaaagacactatactgtatgcatataataacgctatgtctgaaataaggtcgcgtacctgatacatttttcttagcctttgctcctctgcatcctcgtcctgtcaatcaaggggcagaaaactgtgtcactaacatggttgcatggcataaaatatgttaattataaatccgttccagttgcaactgacatgatctcaatcaaagagctcttcccatacacctggatcatcaagatcctaagaaaaacacgagagagcaatcaacattaattgagaaaaagaacacatactcagccagaaacatgacatatacggatatacctgatacatttttcttaacctctgttcctctgcatcctcatcctgtcaatccagtggcagaaaacatgtcattcacaatgaagcgcagtatatgcattaatgaaaataaggaggaaaagatggatcctctgacctcttcagagtcactcgacacttcagtgtcatatatcccagtgatataacagtggccgccaacatatgaattgacatcatttgggtgcttcatacttctgttcccaaacttgcaggtatagcagttaccttagaaagaaatagatcgtttcgtcaaatgacagacacaccatcagttattcagttaggcagcaattatatatatgaaaatatcttaaattcaagttgagctaatgaaggtaaaaggaaaaaaaatgcaagaagctatgaaaaaacagattattaaacatgaaaaaccaaatgtttctcccaggtttatgagtatatacaaattatgaagtatgaacccaagtccacaaaagttaagacgggtacagcttaccattgtcattagaacttatcaaagagcagcaagtgaccacataatccttttgtccttctagagacattgcttcagcaaagaatagatggtcacgatctagccctttagatcctttagtgtttgcagtgaaatttatatgatcaaaccacctatgactctcaaatattggttcgaagctaacgacctctttaagctcataggaaagatcctacaatgagaaatagaataagatcggcaagtgtgacatcaattagacaccaccaaagcgagaatgatagacataaagcgagagcaagaacaaacctccaaaaaattttgatcatcatgggctgc

SEQ ID NO: 88903 - DNA, 2411 bp, Oryza sativa
aaaacaaaattggttcaaaggacaagaaagctaagactttttaaagcaaaagcccaccttagaagcaagtaatttgtcgcctccaggtatttgagctacttatcagtactcactacaagttctgtaggtgatggcacatatttcattcagttcacaatctgttattggtcatcaccatctggcaaccccaaccaaagtgctttctatgttgcgtgtttgaagggtgtttctggttttccgagatatgctctcgctttcaacatcaaatgcttactgtcttgccagttagacaaacacaatgatatcattacttaggcctaatgctatttataattgttaccatgttattattagccctagcagtaaacctaagctgttctgatgaactaggaatgtggtcctcgcttcaccctcaagctgctcaccttacaacatgggacctttgacacaaaaaatggggagtatgaatgggttcacaaggtactattattcatttaccgtcccatgcccacactacactctacatgaaagttttctgacatgctgcaaatcttgcatcattgcatcatttacagccggacatggacacgagcagaagaagatttttcttgtaatttagcatgggatcctcatgccacaccagatgaaatattagtgttgttcggaaattactgcatattcgttttgtgcacttagaatcgtatcacaaatgtaacagacctctatgcacatttgaagcaattttgatgatctatcaaatgagttgagctatacgaatcttggcctctttactatatggttgttgttcccgtatccagtatcttgcacaaaagctgccctttgttttgttccagccctaatatgtcttgctatccacaagatgtatcatcaaatctgctgccatacaaaggtcgttatcatccaactgccatgggattacacctcattgttcctgcccttctctccatccaagaacttatcattgctggccccatgttcttcaaggctgctatagccaccagcggcgccatgacagccccaggatcatcgtatccccgaggtatacctcttctcggcctgttacctactctggttataaatatttgatgtttaggttagataacacttattttaaaagtgaaatatttatacctgattagcctatatagtactctaacttacaagtagtaatgagatactggttggccattgcccatcaaggccgctgatcttttaaccctttttattactgcaaagtactagatgccactcatttaaccctttttattactgcaaagtactagtggatgagctgatggtataccctatacctctttctctatctttaagactgtaattacaacttgtgatatctgtggccattgcccattgctagcgctgttaaacttttgacaaatttcatgctgttactactgctaggtagtggctgagctctgatgagcaggctggctggcagatagctgcctgctgctgggtactgctgctacacatggcctgggggtcccatcctatccaagtaaggccatatgtttctgcgcgtacgtccgtgcaggccagggcgtacaacacagaggtgcgttctctctctccttctcttggtcgtcttctcttttagatgagatgagaggatcgcattgcaccgctagcttgaaagagaggctcctctccatagagtaattgccatctgaaattgccgccctgttgtgtttgcttgctaggtgggttggtcacgagtgcagcagtgcagcggcacatggcttgctccctcccctggccctgccatgttatctgctccagtttggtccaatgggtgagtgaagttatactgccacttcatctctgtttctgcagcatctgcatgctagctactaggtaaatgtttgttcatccctcttcttgaacactgtcagttagctgcatatacatgctcagttgctggccctggccatggtagatctcgagttacagctaaaaatcaccccttttatcttcagttttgaactgagttccaggtcactagaagtcttaaccatgcagtcaaatttgggtgagcagcttttatgcagccatttgggtattaaagtggatactggaatattagtatcgcgcacaaaagctaagcctggacataatttgggtgagcagccattgcgtacatgcacctacgtgcaactaggcgttaattactctcgtttttagatgggaaatacgttaatttatggcgtgttactgcatgatcgcgaagatgatcactctgaataatctgcactgtacgtggcaagtgtgcatgcatgggttgtggtgcaaactatttacatgagtggatcagatctgtgcactggtggatcttccgtgttcgatctgtgtgtgttctcatgcaactcaaaact

SEQ ID NO: 88904 - DNA, 1207 bp, Oryza sativa
taccatgaggagtgcatgactacgagaagactcagtattcaacttcgtgtttgcagcaacacgatgagcctccccaatccttagaagatctacaaaactcttctgatctcgaacctcaactactgtagccccaggtaacgaaacatcccctgtcctcggatcttctacaatggctatattgtcatttacaggatcaaggaggtcttgtatcatttccatatacaactgcaataatacacgtaatatacatttactacaacgcaagaacatgaaagccatacgttgaaattggagaaagtatatacaatgccatgggaactcctagaatcacaaacctgtaggtaagatactgatactgtatcagtttcaggtgttatatctgccaaaatatcctccattgcacggaccatgattccccgtgcagcagtatcttcttcaccaagtcttccaagtgtaaacgttttcccagtaccagtctgcccatatgccataacggtaccattgtatccctccaaaacactctgcaaaatacaaaaaacactacattggtacagccattggtcagaagagaacaaacatgagtccactaatagcttgcgtggaagaaagtttgcagaaccactagctacaagaggactcaaggtttcttttacctcacagaattgggtcaaactttaataacattgcacaacctctagcaagattcattaaaagaaggatttctctgattatttcatcaaaaattaagaaaccttcaattgtaccaatattccatgctccagctgggttgtgttacacccagcatagtcgtatattccaatccaacattcaaaccatacttgtgttacaatttgccaaaagatttcattcacgaacaattgaaattatgaataacaaaaacaaggaaatgcgaaaaagggttcgactgtgtcacatacctctacaactgggtttgcaacaacctcgtacactctcttctgtgaagcaaactctgtaagcacttcatcaaattcatatgtttctgactcccagttgtttttacgaagctttaaccttttgagctttataaagaaatcatcaagtaagactgtgagcaaacacatgttctttttttgcattgcatgctaataaatcggagggaggggaggggagtgcaaacctttggctggggctcaacacaatcaccaaagtcagaatttgcagccaa

SEQ ID NO: 88905 - DNA, 5132 bp, Oryza sativa
cagtagttcatcagagggttcactccgaccacctatggttaggaaaagcaagcttgtggttgtagacttggcggggtctgagcgagtagacacgtcaggtgagtgcattctcgtcgataaatgccatgtcttgctgcacttctatacctttgacaggataataaggctaacatacgcattgggcattaatctctcaggaagtgagggtcatacattagaagaggcaaagtctatcaacttgtccctaagtgcacttggaaaatgcatcaacgcgctagctgaaaacagcccacatgtaccagttcgtgattcaaagcttacaagattgcttaaagattcatttggaggtaaatacatgctaacctgtcatttggtctatgtaaaaatgaaattgtgccatagcttaggaggcacgctcatctttatctaaaagctaataaggagccaagagcatatccctgtacaactcattgcttgtaacacttattgttttttgttctaattgaggtgcttttcttgaaattcataggcactgcaaggacatcattggttgtgacaattggtccatctccaagacatcggggtgagactaccagtacaataatgtttgggcaaagagtaagtttttatgctaagataggtttaatgattttagattctcttgccttcaagttgcaaaaatattcattgacagaccatctcacgatttcatcgtgtatgctactgctgcgtgctggaacaaaattccaagttttttatgaagtgattaatgttttcttcattgtttcatgtataggcaatgaaagttgaaaacatggtgaaactgaaggaagaatttgactacaaaagcttatgtagaagacttgatattgaattagataagttaattgcagaaaacgaaagacagaggaaatattttgatgatgaaattgaaagaataacagcagaagctcaattgcgtgttacggaggctgaaagagaatacaaaatttctctagaggtttgctttccactataatgttttatatattttgttaggcttggtgcaagtgtttattcttggggatatcttgatcttcatgagcatgctatttataggaatcaatagtgcagtgactaaatatttgactttgttttctcatatacttttatcttttagtcagaatactggtcgtcagaagttttctttgacaaaaacccacagtgaaattgggccttacattgacaccataaaggagtatccaattttgatcttataatgaataagttaactattagtcaataccttaatcatgtcttgattcctcaaatataccgcccctatcatcaataattcatcatctatatctcaaagccttgagcatctttaggtgctcggctgctcgtgaattctcttaaagggccatctacaaacatacagcgatgtcagtgttgtaagctgtgagtagaaacatcataggtgattctagaaacatcatcttgtgggacctttctctagaaaaaaaaactacagaacaaaaaaatttatgtaaatttcacaaatagtctaaatcgcttcatctctaagcttcctaaatcctaaataatcattctagttctaccatgcttgattgaggatgtcttttttatattaattttttatatgcattttcttaatgcagaatgagaaagcgaagtaccatcaggaataccttgactctataaagatactggaggagaaatggaaaatacaccaacaatcacctaagaaactggtacatctttattttaggcactgactagttcatcagtcctcttattattttctcattgttggcctggattaatgtctgacttaaaaaaatcacttacattaactttaataatttagtttctcatttgggagagaaggggaaagatccacagggttgctgtatattctaacttaaagcgattgatgtgcaccaataatggggaaacatgtaagcttgacgctgattggcatgagagtctcgtgtttacattgtactttgttttagaggtttttaagccataacaacttatgttctgacgatttgccatttttccatcaacctatggcatttattttacatttttactgtaaattaaagaaactgaacctacatccagtgaggtaggaaaagtgcagaacttactgagaatgagaaagtgttgcgccaatctgctgaagatgaggctaatgaccttaagaatcaagtattacactggaaaaagatggaggtactgtcagtatataattgttttccgcctgtaataatacactaaccttgttttcatcttgtaggctgcagctactgctgaggttgtcaaactacggaaaatgctggatactgaagctagccaaaaagaaaaacttgatgaaaaaattgctgttctgaaaagccagttattgcagctaagtcttgatgctgatgaggtaagaattactggcggttccattttttttttcttactgatcattctgaatttctagatttttttagggccaattgcatatttgccactagtttgaacagatattgtgaatctgccattacaaaaaatgcaattgcatatttgccaccaaaaaacattggaacccatcatttctgccattggattgacagtttcgactaacaccgttgaaaggtggttttttttaaaaaaatgggacaaggatacccttgcaatgaaattgcaaaattaacatcattttagcatgaatgttactgcaccggagggagagaaaaataccaataatttgaatgaatatatgctggtgcctcttatctgtcgcctgtcgcctgtcgcccaagcctccgccacatgctgctgccgccccagccgtcggctgtttctgcctcttgcatttgttgccgccgccgccccgaccgccgcagcgcctgccgccgtcgctggccgcttgttgctgactcgtcgaaagccatctccactgattttcggttcgtttgctattgatttggaaaggatgagagaacttggtgatctaggggggagatcaagggagaggagagggagggttctggtccggtcaggactcggggcagcagaaaagatcaacttgacaagggcaaaatagtattatcaagttacattgatttttgtaaattatttctatcatcttagttggatcggtatagacggtagtggcaaacagcaccacagtagactattgtaggtggcagatgagccattcgcgttcttatgagggttattgagagttagggggtgaaagtagtggtaaatttgccattctctcatttttttaatgagatggttcatgtattatctgatcaatttgataagtagtatacctagtgatgcatatattctctcatattattgcctgttggctttgtagtgcataacacagcaaatgttaaagttaattaagtccatccacagtttttttgacttgcacccttcctattattccaattattccatttgtatgaaacacatacgtgctttcttgggggactgtttccaagattttagtgtaaggtctctgatgttctcttcttttgtaccgttcatttttttctttctttttagacaaggaggagcctcgacagaggagatggatctgggaaaatatttcctgggtttgattctttgatgtctcattcaaggaattctcagcctagagagcagagcaatggacctaagccgcccattgctaaactgtttgaacaaggtatgcattacttgagaacatatttcattcatttgcacctgtctttcagattgtatctttttatcctctagtccttgtaagatatctacatgtaataagaccattataaaaaaatgtgataaaagtttacctatgttattcctgtaatcctgtacataaataaacctgagttgtgattttgcttttggttatgatgatgaaagtttctcttcaactatttcagttgggttacagaagatactgtcgttgcttgaatcggaagaacctgatgttcgtgttcatgcagtgaaagttgtcgcgaatctggcagctgaaggtgcggtgttcatattcaccatgttttaattggaaacatggattttgttatattttatttgatgtgtcaagatttgcatttgatgtatagtatggttgtccgccatatatgcaaatttgatttttaagcatttacatctgatactctacaatctgcatgtcatgcatagcctatgttggatactgctgaagtgaagtattcggataatataaacatacatttgtcgcactagcagttgcgtcattttaaatattgatgccttgatattacaattatggaacccgatctcagtttaacttgatacacattgcttcttgatcatgttatatcaacagcatttgatgcgacttgcaaatgattgattctattcacttttcttctctgagctgcaatcatgaattaactgcggttgcatttgcgtatttcagaggcaaatcaggaaaagattgtagaagcaggtggccttacttctctcctaatgctgcttaggagctccgaggatgagaccattcgcagagtagcagcaggagcaattgctaaccttgcaatgaatggttagtaggccagtagtaattcatgaaagagggccttaaatagtgattatatatctgtttgtagaatgtctcttatctcattgtgtcaataatatatgcagaaacaaaccaagatcttatcatggcccaaggtggtgtaagcctgttatctatgacagcatctgatgcggaggacccacaaactctaagaatggttgctggagccatcgccaacctttgtggcaatggtaaactctatatttctgcatgtttgccattcaaggagttagtaccctaacaaattaatatttttgtctggttggctggcattgcacaacaccgaggacattcaatttaatattaactatccctgctatgcatatacgtgtagctttaagttccgtgcaaaggagaaaattgttgaagtctaaattttggttaatggccacataatttttgttgggagcaaagctgataagactagtgtgggagcatacaaatttaaagagaaaattaataattttcttggatttaaaacatattcccatccatatgactatgtcct

SEQ ID NO: 88906 - DNA, 501 bp, Oryza sativa
tactgaagtactgtgacacatatactgcatctggtatgccacactccgctgcggcagcaatgacatgggtgcatggcctgtggagcagcttcggctttgcacaagagcaatgacatgtgtcgtcggctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaatttctgccaaatttgttgtcattattccatatctagcaccacctgtgtcatacgccttggcccatttctctt

SEQ ID NO: 88907 - DNA, 615 bp, Oryza sativa
tggatccccctatttgaattgaacggcaattgtgtttgaggtgatcgattcattcccgtaataatttattcagatttgcaacgtggaatgtgtctcaggtgatcaaattatttccccattaaaatttacatgaatcagaaattgacagtggagaaggtgatgatcgatcaacaatgaacaaaattatatatattacttcatgaaatactgtgtacacgagctgaacgaatacatcaatctatcagcttacattatatatatccaacaacaacagacacaattgcaaaagaaaaaaaaaagagaaaaagaaaaacatttatcaattaatgcatataacctccgcggcgagagcgcaaccggtccagaccgaactgacgcgctcgcgagctcagcagaagaggtacccaacggcggcggcggcgagcgtgccgagggcgacggccggggcggcgttcgtcgcggcggcgccggcggaagctccggacgggccaggagccggggcctcggtcgcggtggccacgccgaccaaggacgacgccacgacggcggcggtggcagccgcggcgaggatcctgagcttgagggtggccgccatttcgatcgctagctatgaat

SEQ ID NO: 88908 - DNA, 660 bp, Oryza sativa
gagatgccttaatagatggtacagtagttcatcacttgagcatgtatgcaaaatattaacaatgccaatgtttctaaagaaaacaactctagaataaatcatcacattgaccattgacattagccgaattactaataagcaaaacttccatggtacaataattataaaatctatatcttatatggtgatccataaaaacacatacaatttgactttaaataaatatcaaagactcataagccaaatcatacttcaaacaaattatatgccaacctaccaatttcactacttagaactggtatttgcaacatgtatgtataatatcaatttgataagcaaacacatgtgctagatagtaagcaatgttctaacatgacataggtaaataatatgatgatgaacacaataaacccataccttgccttagcatccaacaaaatgcggctcaaagatgtgatgttgtatccatcgctgttcatcttctcttggtttcttcacgagcatagtaatgtcttgccccccaagcaaaatcggctttctcgactgcacgattttgaaggcaagacgaacaccgcaccaacatccatagcatcatgtgaaggagacttatctctaatgaccgatgatgctatggattgatgaactacttgcagtcgaact

SEQ ID NO: 88909 - DNA, 1055 bp, Oryza sativa
aagaagcatgcagctccaaaccagagaatctacttaaccaaatgtcaagacaaaacatgccaaaccccttacatgcatcaagcatgtataaaaacacataaattacaaaattatttgacacaaccaaatcgtgcatccaactagatcagagcataagaaagtctccatctactaagaaccccccaggcattcggcattgcaatctatagatgttaatctggcacgcaatgcaatgcacacctgcttaatcaaatccaagctagaatcacaaaggtgacgttaaggagcattcagccaaacccacatagtgtctccactccactatgagctgctgcgaatttgttcttcctattctatatagtaagcccacaatcgctcaatgcctcaatccatctgtcataatatctaacaaattatccgaaagaacacttggaacaaggtaagagtttattcttcctaattctggtttagtaagccctcgatcgctcaatgcctcaacccatggatcacaatatttaacaattttttcaaaaaaaaaactaattctgccgtgtagtattgattgatcctaacagattggaacaaagtaagcaaaaagagtttgggggatcccagattggggggagagagagagagagagagaggcactcacatcgacctggcccttcttggcgacgttggtccagtccctggcggagacgccgctgcgccagtcgaactcgaagccgacggtggcggtggggcggtggtcgggcgcccagaagcaggcgaggtagtccccggcctcggacgccgtgaaggcgaagttgcccgactgcacgttctccgagtagtgcaggctgtggccgtggggtgacgtgacccgcaatgagacgcggtgggactccgggagcagcggctgcgccgacgacgacaacaaggaggaggaggaggtggagccgcccccctcgggcaccacgacgtggtacttgcccaccgccatggcgcccaccttgatgtcgtcggagatgcacttggtgtggcccgactgcaggtcgaaccgcagtgcggcggcg

SEQ ID NO: 88910 - DNA, 2699 bp, Oryza sativa
agtaagacatgatggcaggctgatcaataatgctctcacagcccccaaatgatggggcatgatagggtatcttaacagaatcaataaatctcctagtagcatcaaagtctccagcaacctgcacagacaaggtattttagaaatttaaatgggtggtgttatatccacaggtgagatgagaattaaagagaagaaagtacctcaaaactaatgacaccaccaaagccggtcatctgactcttggcaatgtgatgttctgggtgacttggcagaccaggatagtagacacgtgcaatctaaggataggaaataagagactcagaaaaaacaacacaacaaaaagaactactcgtagcttcatagcttgtacaacaaatgaaaagtgcagagtttgcaaacctttggatgttcctctaaaaattgggccatccgcattgcagtattattctgacattgtacacggagatgcagtgtcttcatgcctcgaagaatcaagtaggcagcattctggtatcataatggcatgaaaagttaagagacaagagaccagaatattcatcaacagtataacatacagaaatagaatgcaaagacattcacaacttcaattcaaatcgctttcagacattcacagctgcagatcatctattatagtgtgttatctatttctgtacaattgacgattttaattacagaattacctaacaagggctatcactacctctagtcaatgcaaacgagagagatattttaccagcccaaactcaccggatttagaacaccaccaactacatggtgatagatgcggactttggaaactagctcatctctgccactgatgcagcctccaataacctaaaaaacaaaatattcttgtcaaggcaatctatatgtgtaatgagtacaggaagtttggtccaaacacttacatcattgtgcccagcaatgtactttgttgctgaatggataactaagtcagcacctagagttagtgccttctgattgattggggatgcaaaggtactatcaatacaaagcaatgctcccttgctatggcacatttttgagacaagatcaatgtcgatgcatctcagaaatggattagtaggagtctcggtgaagaatagggatacctgagtagaggtcacggataaatttttggttaataaataggcatatgatagcattagaggaaaaggaaatagtacaaagatcacactcacattattattatccagtgcattttggagagcatccatgtcagcaggtctaataacggtcatctggacacaaaattgtgtcataagataagcaacaaattgtaaacatttatgtataaacaaatggaacaaagatcataggcatattccaaacaccgtattctgcagaacataaatatttaatatgcacttccaagatactggaaatttgaaagcaactatgaaatcattatacatttttggcttctacaaattgatggaaagccaatctcaaatagtaactgcagaatcaagtgtgtgcacacgcacgcacgcaaaaagtaccggtataattataaatgcctctatctggctctcacaggaatctgtacagattactaaagtagcaatgattgagtggtggtggacaaaagaatgcgagttatgttggattagtttattatacaacataaaattgaacttagaaagatgacaggtaattgctgtgccaattaacacaggaaatagtagcctccatgtccaaatataatattttaagtagatcataaaatttaaaatttgtaagccttctgctactatagaacaatgacaagtcacatcaactacaagaaaaactccattgaaagttacatatgcattactgcaaacaagaataataagatcagattaccgtaattcccctcttaggtagttcagtctccatgtaaattctcgtcttgcggtaacaatcagtggtggtcacaacgtgcccacctgctggaacaagcgcgctgagcatagccacacttgcatacatcccggatgccacaaagacagtggactcggctttctccagtgcactgaaacatcgaagtagagcaatcaaaatcccatccactaaaaccaacacagcatcaagcattcccacttccaattagcagaaccattcatttcaagaagaaaatattacaccagcaacaaaggggaaacatcacctcatcttcttctccaatgcctcagtggtcgggttaccatacctcccatactcgaagctagcatgcctcccctcctgagagaagaggaaatttttaacatttgcaaaaagggcatctaccaaatcgatttgtaggagtaattgcaaccccccaactatttacgaaagatcgccaatcatttctaaccttgaagtcaatgagctcctgcgagttgttgaaccagtaggccgaggtgttcactactggcgtggtgatcgcgtctgtggcgatccttctgcccagcctctcgccttcgataggtatatcaaaagcacgaaatggatcagaaaaaaaccgaagcagcggggggaaggcgatagatctgagaggggattgatcgtgattacccgcgtggacggcgaggctggcgtctgaaccgagcagggcctgctcggccaatgcggcggcggacggctggccgagcttggcgttggggatggcgccaacctcggccgtggcctccgcc

SEQ ID NO: 88911 - DNA, 812 bp, Oryza sativa
cgcggggcaggagcggcgcgggcgtgctcgggcgccggccgacgggaggagaggagcggcgcttttgcgcagtcagcgtgccgaaagaaaagggggggacgccagtgttcattacggggatcagagaattctgctacgttaagatgccttgcggactgataaccaccgggaatactttccagcgtacggtccagggcgcacttagcaaccagcttggcaacaatgtcgaggcttacgtcgacgacatcgttgtcaaaaccaagacaagtgactcattgattgacgacctgcgggaaacgttcgacaacctcggacgatatcgcctcatgctcaatctagagaagtgcacgttcgaagtaccgtcgggcaagctactcggattccttgtttctggcagaggaatataggcgaatcccgagatgatcaaagcaatcgagaacatgaagccgcccacatgtctcaaggaggtgcagaagctacccggatgcatcgcagcattaagcaaattcgtccctaggatggcagaacgaggtacagcctttcttcgccttattgaaagaacaagacaaatttgtatggacacaggaagccgaagaggcatttattgcactcaagcgctacctatcaaacccccctgtactcgttgccccccaacttaatgaacaattattcctttatattaccgccacgccatattcagtgagcaccgtcattgtggtcgaggcacagataattcagctcccagttgattacgccagcgaagctctccatgaggcaaagtctagatatccgcagatccaatatctgctata

SEQ ID NO: 88912 - DNA, 525 bp, Oryza sativa
gacggcgccatcgccaggtaccccaacgccggcaagttcatgagggtgaaggacaggttcgatcccgacggcgtcttctccagcgagtggagcgaccaggtgctcggcgtcggcggggcgagcccggtcatcgtcggcgacggctgcgccatggaggggctctgcgtgtgctccgacgactcgcactgcgcgccggagaagggctacttctgccggccggggaaggtgttcacggcggcgagggtgtgctcgccgtcgccgcgaggcgctgcgaatggcggcgacgacgacgacgaaatatcggacgttggcgatgagtagtggcatgcgtcatgtgcgtggcaacgtcgatgtgtcagtcagtgtaagcagtgtggacgtaaagcattctcgtgttgcatgctgatcataagatcgttgcgctgaggtttgactgttgcgacaaatggatgtggggtccacttttttatggcatcttataactaagtggttattaaaaatctaaaaaaatatatattacttgaa

SEQ ID NO: 88913 - DNA, 774 bp, Oryza sativa
tggcttccggtagacgaagcaaaagcaaagcgtttgcaactcagagccacgaagtataagatggtctcgggtcagctttaccgctccggggtacttcaacccttacttcgttgcatctctttttccgaaggtgaagaaatggcaaaggagacacaccaggggctatgtggcgcgcaccaggctgcaagaacagtggcctccaaagtatttagacaaggagtttattggcccactgtgttgaaagtctgtgttgagcaaatcaagaagtgcgaaagttgccagcgtcatggccgaagccaagccgcgccccagtatgatctgcagcccattgcgccaatatggcccttcgccagatggggactggacatcattaggcccttcccgatggggcgaaacgggtataaattcgcaattgtagctgtggaatatttctctcgatggattgaagtcgaaccccttggggcaatcacttcggcagcagtacagaagtttgtatggaaaaacattgtttgctatttcagagtgccaaaagagttcattactgacaacggtaagcagtttgactctgataagttcagagaaatgtgcgaagggcttaacctgtaaatcaggttcgcgtcagtcacgcacccgcagtggtatggggctgtcgaacgtacaaatggcaagatcctagaagcactaaagaaaagactcgagggggcagtgaaaggcaaatggccagaggaattgctatcggttctctgggcccttcggacgacccccacaagacca

SEQ ID NO: 88914 - DNA, 667 bp, Oryza sativa
ttcggcaaaccgtcaacctcttcgccttgatcaactctgacttgccatgactgggagaggggaaagatgcgaagcatacagaattcctccaataagtcacggcagctaaggcgggagcaaaccttccgcagcagaacgaaccgcgcctccatgaaaaaggcaagcgagtacgcgtggtcgagaaagatgcggaggcgactgctccagaatcggattcagcatatccagactctgaccttcgtgtctcacacattttcggaagttctacaacgtaatcctcaaagcgagaatacaagaaagtggaacgagaagtctgttcgacatggcagggggctgcacccaagatgaagtggtctgaacagaagatagaattttcggaagaagaccatcccatgactgccgttatcccaggacgttattcgatcgtggtcgaacccactattcggaacatcaaggtcgcgcaggttctcatcgacggtggcagctcaatcaaccttttcttcgccagcaccttggacgtgatgggaatccaacgaagcgagttgacacccaccgatcaaccctttcatggaatcactccccagtcctcgtccaaaccattgggcaaaattacgttgcatgtgattttgccccaagcaaaccaacttccgacggagccagatcacct

SEQ ID NO: 88915 - DNA, 569 bp, Oryza sativa
aacatatatacacgtataaaaagatatacaaactttgtatatgtacattatcgacgggtgatacccgtagactggatatagagaatattggggtacgttggtacaaggatctacgtaatacgacatcaagcaaacaaaaagacgagcattatactggttcaggccccttgataggtaatagccctaatccagttgatatgggattatatgatggaaaatcataggttacaaagggaacgatggaactcgatgacaccggcgagattgtaatcgagttggttcgactagatctcccggcgatttggctcctgcaggcttcgacttcgtaggctgtggtcgttgtgttggctatgagattcgatgccttaagtcctcccagggggtcccttttatatcgcaggtcaagcggtttccaagtagaactcggagacatcagaccctatacgatacattgacgacccagtcttgtccgagtaggactcttattttctgcaaactccgtgaagaatttccttagtatatgcagagaatgttcatatatgcgcgggcatgccatatcgatatgtaac

SEQ ID NO: 88916 - DNA, 525 bp, Oryza sativa
ggaggtggggatgtgcccgtctttctccatggcgcccgtgcacaagctcgacgcctggatgcggtgctggtagcccaccaccgggtaccccgtgaaggcctcgccgtcgttggtgagcccgtagttgaggtgctcgagcgtcgccggcatcacgcgcgacgccgcgcaccgggcggggtcgctccctgatctctactccagccactcctccgcgagcctgctggcgacgaggggtagcgtcggcgtctgccggaacgccgggtagtcgctgcggtcgtcgccgggcgtcgcgacgtcgacgcggtcgtcctcgcggtacacgggcacgcgccgtcgtggcagccacgccacgtcgccgaactcgtggaggcggccccacgcggcgaccgtgtcggcgacgtccgagtcgttgcgggtcacgaacgccaccgaccgcttgaacagcggctgcagctcgagggtgacctgggagatggcgccgaggactccgagggagaccttgggcgcgtctaggtacgggtcgcc

SEQ ID NO: 88917 - DNA, 3076 bp, Oryza sativa
cgttgagaaaatatgcatcgggtagcgaaaaaaggaaacagaaaaagcgtttgagatgttcaagcatattagagatgtggattgttatcctaatctctccattgcttatcagaatagttctatttgaagttttaaaatgttatatatagataaatttatcacatcgaatattaaatgttgtgtttttatgagactataaatatatatattagtttatgtgtatatatatataaatgggcctcccctggtccgcatagttctgaaaggactgcagtttttaccacgactccatcaatcctatagctgtggaaaacaaaacgttctggctgaagatacactcccacaatgcagtgacattagggaaaagaggaaattcctagtgcttcccattctaacgatgcacaactgtttgagaccggcagtacagatacggatgcagcatttgtaattccaaagaacttcacaggaaaaatatcatgtggcctttttgccttgaatatttcttacacaaaaaccggtgcctactatttatgccaatatacactagccataaactgcgcagcaagaacccataaaacttcttatgcatagtttagtactacctccatccccgaatatttgcatttcactattaaaattttgtaaaaaaatgttatttctattgagatgggacctaataaattaattagattgatatactaattccctcacccttgttattagtcaagtttgcaagtatgtaatgtgtgcgtgcagtgtggtcatttatatgtggtgctaatctgtatgtaatatcctagaaatgcaattattcttggacatagatagtataatctttcaatttcacacctataaactataattcaaaccacatctttcaaacagaattaatagcataaaaattttgttccaccaaaaataaagaaacaattaataccaacatatttattttctcaatcttacgcgtcatatttttttccacgataaaataagattcaactttcacatctccacgatgaccttacccgggcatggccgccatgctcttctcccacgcctgcgccgccttctcgaacggacaccgcgagtcgaccaccgtcctgagcttcccttctccgacgagctccatcagaaacctcatctcctccttccccagcgacatgagggccatcatggttatcttcttcctggcaaacatggtcagcatcgccgcgacgtagttcccggggtttggtgttatgtccaccaccctaccacggctgctcagggtcggcttcatcgccgaccagttgacgttcatggcggtgttgatgatgtagtcgtacttctcgtcggaggccgagctcgtcagggcggcgccttggggggtattgtagtcgaggacctcgtcggcgccgagggagcggacgaggtccatgttgcgggcgccgcatgtggcggtgacgcggtggttgccgagcttggcgagctggacggcgtacgtgccgacgccgccggaggcagcggtgatcagcacgttggcgccggtgccgccggtgccgtcgaatttggtcccgatggacatgagggccttgagagctgtgaggcctgcgaccggcagcccggccgcgtcgacggcggaaactccggcggggcggacgacggtgaggctctccggtgcagcgacatactcagcgaggcctcctcctttctgtattgcaattattattctggtgagaattgatcattttcttgatgagaaggttaagcaataaaattgttacaaactctatttttttaatgtacgacggcgttaacttttttataaaaattagattatttggcttattaaaaaattttgatgataaattaagtcataataaaataaatgattttataaacattagattatttggcttattaaaaaattttgatgataaattaagtcataataaaataaatgataattaaattttttagatataacggatggtcaaacatatctaaaaagttaacgacgtcatgtattaaaaaacggagggagtattaaagaagaaatgcatcagaaaattcaggtgctatacatgagatgaatcatgaacaaactggatgtttgaaattacccagaagttcagtttggacaaaactttgtcaccaactttgagctcatgtactgcagaaccagcctccacaatctccccggcaacatcagtcactgtttcatggagtaaattgagagatgaactaaataatattagattatccattggtgttatatacttcatcaccggtcaaaaactgaattatcttcataactaagagtgtgcattactgaaatagacccgttcatttgcaatcaattgcacataaatatatgtgttgtacgaagagtaccttttgaattagtacttctgtctagtttcataaacaaatggtccttactaatgggtaaacacctggaataaatggaaacttgggaagaaatgggcgtagcatccctttctgaatactccaatcaatcgggttaacgcttgcagcttcgactttaataagaacttcatgtttcttcaccgaaggaacagggatttccacgtgctgaagtgaaactaaactgtatttaaatcaataatagaataaacaaattttacatacacatatggtgtgttcaatattttcttcaaaaaatcattgctagctatatattctcactttgatgaaaatgttcagataagtcatgtcctggaagtgtcgtctatttcttggaagcaactagactcatgaattacagatgaatcggaaaattgtactagaaataaacaaagttcaatataatcgacaaatgcaatttttccaggacaaaacgaaaaagaacatgatcaaattttatgtcagagcagtagtgcagaatatcctacgaactcgatcactcgtagagcattaaatcaggaggaagaagaagatagcaaaccttgagggcaccggcgccgccgccgtagccggtgtactgcaccgcgcgcatggtggccggaatcccgccgccggcggccataatcccgagcaattcctgaatttctcctgttgtctgaacaagtcaatc

SEQ ID NO: 88918 - DNA, 1193 bp, Oryza sativa
ctcacaacggcgacgaacaacttttctcttgacagaaagattggtcaaggcgccttcgctacggtgtacatgggtaggcttcccgacggacgcgaggtggccatcgaacgcacgctcgaaacatccggcatagggaaaatagacatcatgagagagctcagtatcctccgctccattagccaccagcacatcgtccgcgtctttggcagctgtgtgaaggagaagcgccagctcctgccaccgtttcggaaaaaggaggaagagatcctactcgtcctcgagtatattgagaacgacacccttgacaaacacctgcacggcccacggtcgtcgtcgccggtgatgacgtcctggaagacgcgcatcgagatactgctaggtgtgtcgagggccatcgagtacatgcagtcctacggtgagcggccggtgatccaccgtgacgtcaagccgtccaacatcctgctcgatgcgagctgggcgccgcacttgacggacttcctttgggcgctcacatgggaaggcccaggccatcaggagaatattattggcacctatggatacttggccccggagtgcgttatagcaggcactctaaacccgacagtcgatgtctacagtttgggtggtgggatgctggaggtattgacggggaaaaaaccatatttctctaaagaagaatgggaaaaggagaagacagaagaacgtgtggaaggaggagaagagagaaaaatgtgagcaagatggaaagaacacagaagaggacaaggaggagagtgaacgagaagaagaggagaagacaacagaagaacaacatgagtggcaaaagcgggacgggtggtctagtggtcacagcttggcgtctttaacgccactgattgaggcgggggaggtgtggaaggtgctggacaggcggccggcagcggagccaacggcgaggcagctggaggcggcggaactggtggcgcagacggcagctcgctgcctgcggctgcggtgggaggagcgtccagccatttcggaagtcgtggccaatctagagaaggcgctcgagctcgtccgttgcgacgggtaggcggtagcatagcgtgggctcccgagacatcttatgtgaataattgggcaatgtatattctcatcatgtaataattaacgctgttgcttctcttctcttttttttttgtgcgcatacacaa

SEQ ID NO: 88919 - DNA, 616 bp, Oryza sativa
tgggctttgttgcacaaagctgttcttaaggactccttcggcaatataatttccaaatgaagaagcctacacacaaaatctaccgcacaaccaattggcccgcatataaccgagctctcattaatcgtgggaatattgccatttggttcgatccaaaaacacaatggtatgcagaacctcaaggcaaacaaggtcgaagtcaaacctactccgacatagcgattcaatgctgtttgatgatcaaatctctatttagactcactttacgcatggtcactggctttgttcagagcctcattaaactttgtagattagattggacagcaccagattattcgactatttgtagaagacaaaagcatattgatattgcgataagctatcagaaaagtcgtgatggtctccacctactcgtcgactctactggcttgaagtttttaggtgaaggtgaatggaaacgtaagaaacatcagctgaatatcgtcgccaatggcgtaaacttcacattggtatagatgctgaaacgctgcaaatacgggccgttcagctcacgacaaacaatgtcagtgattcacaagtactcgaagatttacttgatcaaattccacttgatgag

SEQ ID NO: 88920 - DNA, 685 bp, Oryza sativa
ggtaaacaaaatatgtccaatgagttcatgaaatggacgtgactaccacgttaccgtatactggattgtcataacagcgacctcactctcaaatcaggtggctactactacacccaacttacaatcattgcatgtcttttttatgtgtgtcagggttatggatactacatacctaatagtagttgactaaatctcgacaggacacaccacataccatgtcctatacggaaacaacctgcggatatatgaggagttctggataagggaagacaaccagagttttacatggaaacgacaaggactactcggattgttggtttccctagttctacttggacagggggacacctatgaatataaatacaaggtcccctaggaggagaggggacaaccccacaatcaacggacacccaccatagaagagacagacaacatacaagccaacatacgacaagacaagacgtcggatatcgacttcggagataggcacggctagtcccctacggtgtctccggatactgataggagagacattgcgctgtctctgatctcgccgggcacgaactcgagaaggaagactaccctgttgtcgactacgagtcagactttcagaccgccatgtcgacaacagttagataggctaccccaaatattatactggtgtgattatggtgaataagagcaa

SEQ ID NO: 88921 - DNA, 513 bp, Oryza sativa
cagacggatcgctcgctcgatcgaatctctgctggacctctccacgatgtcgatcgaggaggcgttaggtcgcctcaaggtcgtcgatggtgatgagccacagcctctctcggggcccatcaccatcggcgggaagctccacctcactcgggagcagtgggaggcctctcagggtgacgggaggaagggggagtcatcttccccgacaggcggccgtaagccgcgcaaggcgcggggaggtgtccagctacggtgggcgcgaagacgtgccgagggtggcgcccgcagaggcgcccagggcgttgccaccggcaaccacaagccggcacgagacgacacctgccgcaactgtggcaagcttggccattgggccaaagactgtcgacagccacgacgcggccaggcccacgtcgcacgggtggaggaggaagagccggctctgctcctagctcacgcaagcatcgagctacctccagcggcaccggccgcagcggctttcctccaccttgatga

SEQ ID NO: 88922 - DNA, 696 bp, Oryza sativa
ctgtctatcatatgcttaattatattttgcaggaaatatacactattagatggagcccaacaggaccaggaacaaataatcccaatcaacagttgcttttggcaaggtaaataatttgtgcaaataattaaatacctatattgcgtcagtggctcgggttcacggtggaccgggtgcacagcggcggtctacggaaacgaacggccgggatcaaccctatccaaaacagacggccgagatctaatcggtctaccgcggctcacgggaaacgacgacgatgacgtcggcgatgacgtcaccaccggcggcggctcgggcgcgcatgctcgccggcgaacaacggcgcggtggcgcaaacggagggcctctatgcgtagtggacgatgcagcgatccttaccgaggcacgaacggcggcggacggcgacgaggaagaagcggcggcgacggtcggcttgacgacgacggcggtcttccggcgatcctcggcgacgacggaggggtggacgaggacggcgacggcttggtgaacccggcgttgtccttcccaagcgacgatgacgaccggagcgacggcgtcgcacggctggacttgcggcagcgacagcggtgcaagagctcacggtgctagagctctaccggccatggaaggcgaggcgagggtggcggcgggtagaggagagctcgggggtccttt

SEQ ID NO: 88923 - DNA, 1378 bp, Oryza sativa
gttggatgtttcatagagtggtagatatcctatataatctaggccaacgttgttacttaacctaatcggctacctttcaatgatagatgtagccgattgaaggttagataacaatattgtcaggtattatatagaatatatgataactcgacaacttacatagacaatattagagtatcataaagatggaagcactaatcccgagaacgcaggccgccataacaagtttttcctctagttgaagatcgaaaccgatgcagctcaacccgaaagcaagaactcgtcgaaacaaaacgaaagtaaaagggtggcgatgcgccgagattgttattgaacatgtgttatcgattacatgggactcggggtctatttatacccgagattacataatatgtccatatcggacacgactcttatttctaacaaactctaagataccataagtctttactgcagacttttgcccgaacatatctctaaggaaattacataaaatatcctaattatagatacaattgccttttcaggactcaatctgtgcatggcaatccatgtgaagcactttaacctaacccgatgtcatgtatcgagtcatattgtcggaaccggcttaatcggctaaccttgtccgatttgaactctgccgattctaatcgtagccgattcggactttagccgattcttgctctgtttccagaacgatctccatcttggatttcgcttcggttttatcttcatctccgatacttgaattaccaaatttggttgttaacagaggtctagctttgcagcgagcattttcatctccttgacggtgtgcattcctcgctaacaggtccggagtcgttcctcgctccagcccaaattggagaccatcttttctataagatcgacggctcctttaaccgtcttagaaaagaaagctcctgcagctgccgcgtccaggtggtcacgggatgtgggagtgagtccattatagaagttctacaggatcagccagttgtccatcccatgatgagaacaggcggccatgtactcctgtagtgattcccacgcctcgggaatagactcatctctcgtctgctgtaaacttgaaattctcccgcgtagggcgttggttttgcccattgggaagaactttgataggattgccattgagcatttgtcctaggtgttgatcatatcatggttggcatagaaccactgcttagctttccctagagagaaaatgggaatagtcggagcctgacggcgtcaggactgacgcccttcattgtgtacgtgctgcagatttccaggaactgctgcagatgtgcattggcatcctcgtttggcttgccacggaacaggctagcctacgccatcatgatgaggctgg

SEQ ID NO: 88924 - DNA, 610 bp, Oryza sativa
aaattcattaacaggatttttagtggaattttcagagctctagaaataattttaaccaattaaaattgagcaagcaatattttaattccagggaaaatcctttttcctttttctttttctttttcctctctttttcctcttttttccgaatgggccgccggcccattctctcctttcttccccctcctccttgttgggccagccgcaggccgaggcccatccaggccgtcccgcctccctcctctctcggggtcgccgacaggtggggcccacctgtcgggcccgtctccctcctccagccgacgccgcgcccgcaaccgccgcgcccgcaaccgccgacgcgtcgcctccgcctcctccgggccacgtcgaccacgcccgcgcgtgcgccgcgttccccgcgcccactcccctttttcttccgctcgcgcccgcgcccgagatggccgggattcgattttcgaatcccgcctctctctcctcccccacttctcccacgttggccggcgaaatcccgcctctcccggccacgtccggccctcccctcccctatttaagcttccccgtcactccctctcgctttttccttttctcgccgaactccctcgtg

SEQ ID NO: 88925 - DNA, 1274 bp, Oryza sativa
acatccaccacaaggtaaagtaatgcaacttttgtttcaaatctttccatcattttaacttgtacctatatgcctcattgtgtgtttgtatatgcagggaagtactatgtggttgatgcggggtacctaaactgcccgggctacctttcaccgtatagatgcactaggtatcatgtggagcaatggaaaaacggcccccgccacaaggtatgaaagaaacctttaaccatgcacattcccggattaggaatgtcatagagcggtcttttggtgtgttgaagatgaagtggaggatgttgttggacatgccatcgttttcggaaaaaaaacaaactagaataattgttgcttgcatggttcttcacaatttcattcgagagagcaaaattagggatagggaatttgctaggtgtgatgcggatgcagattattttccaatgcctacatcacctcactctgactggtcagaagatgaacctcttgttgaggatagcaacatgaatttcttccgcgatgacttggcaaatgctttgtttaatggattgtaatttttttttacggtttgaggactttaatatttatgtgagataattgttgtatggactttaatatttatgtgagacaattgttgtatggactttaatatttatgtgagacaattgttttatgtaattgtatatttatgtgagacgattgttgtatggaattgtatcttttatgtgacatgattgttttacatacttgcttatatatttgagacaaattatgtgtttgggcttgtaaggaattgtgtatgcttgtatgtgcctgtattggattagccatagaagatccggctgctgtatacttttagtggaggcaaatgattgggatggtacaataatagctaaatagcctttggatccaaacagcaagagggctattttggtagggggctattttggtgggataatctttaacccaaaaaatatccctgggatagttctccaaataggccctatatatacagaacaactacagtagctttactaaacgtttttctccagacatacctaaattttacgctaaattttttttatcttgacatacttagtacctaaagatactaaattttatactagaaaatataatacctcttggtatgataaaattaattatcctattcctatgcatgagcgctcaatatgaaggttaactaaaagtaattaactgaacaatataatgaagattcctttgcacgagctagcgatcgatggtcgatcggaaggcacgtt

SEQ ID NO: 88926 - DNA, 1203 bp, Oryza sativa
ggtatgagcgaggggtagtataacctgactgcccataaacccgctggtctttaagcctggaactgcatatgggctggctcgcaaagaagcagcagaataagcatcaacaccaggatcagcccattcagaacgatgctccctcagaaatcgcacaagtagagcaggaggtacattctacattataaaaaaaatgacattttgtaaagcttaattctttgatttggaacaattttggtcaaagtgaaacaaagatagagacaatctataattagctgagcaactaaatagagcctatgtcaacctgaagtagcattgatgcctttgcgcacaagatgccacctccaacagtagaaaacagagggttcgggctgacatgggatccaacaagcttgtttggagacgagtttactgaaattgtaatgtcctcactaccatcactgctcaacaaagaccacccatcatctggaaatccactaacagcatcattgaaacctctgcaaattagagtatggagttcagatgcgtgagcaatgagacatgcatggaactgtgtcatatgacagtatgccaattggttctaatacatgggaaccctcaaatagctacagacctgctgagcctttgactgaaggtcctgaaaacagcaggctggcgaccagcaccgtaggggatttcaccgcttgactcatgcgcaatttgcctaatgtgtcgcaatgcctgaacagaatgaaccatgtcattggtgataagaaaagttatgcactcacaatcaccatgaggtgaccaagtgctcttcaacaacagaataaaacagtgcacatactgcaatggtcatcttctgtgcaaggatctttggagattcatagagcggtcgaagaacctcaggcacactccaagcctgtaaaatacacaggattaataagatatgtatctcaaaactattcaatattacactagttaatgtgaaaacactattgttacttacatccaaatcaacatgatcaacaatgtaaatcatggagccacctccctcacatggtcgaatcagataaccactgggaagtacctcggctctgataaaattcggagtgttaggcccagatgggccaccagtggactgagtcaatgacctttcacagatctacagaacaggaatggtgtcaaacaatatttaatacaacagaaactacacttcagttgaaa

SEQ ID NO: 88927 - DNA, 850 bp, Oryza sativa
tacggctctataccccaacccaacttgctctggcccttggtcctcccgcatctcttcctcggtaagcggaccgtggaagctggggggtatccgcttgggactgatagagaacagcatatcttttttgtccctcctgacccctaaaaaaaatatagttgaagtccggtcgacgttgttatccttatatattctgtcaaagaaagtccctcgcgtaaattgctttgaataggtaaatcaatcatttgtccttgaggatccgccattaatcctcgcatacctactaattggtgtacctgagatgcatttcctctagctcctgaaaaagacattagatagactggattagaaggatctgttatccgaaaattcgaattcatttcttgtttcaaatattcacttgtagcataccagatttcaacggattggcgtaatttttctaccgcgtgtacagccccataataatagtgtttttccaaaataaaactctgttgttccgcatcttggactaaccatcccttagagggtattgttaaaagatcctcgattcctaatgaaatcgatgtagtagtggcttgatggaagcccagcgtttttatttgatccagtatatgggatgtatatcccattccgaaatgatctattaatctgctaataagtccgcctttttcatcttccgtaggggcctttagtcttttgattagagtagaggtcgcgacagagcagagcgtaccgccctgccatagtcgcgaggatcttaatagtcggtcgcgactgttgtcatagtcaacgacggttgaaacttccaggaaaaaacttcgaattgggagggcgatcctcccggtgagctgac

SEQ ID NO: 88928 - DNA, 812 bp, Oryza sativa
gattgcttctactcgaacgccactgttttggcatgcactcattttgtctttcgcttttgtgtaaaacgtgtatccatttagatcatatgcttgccacgaggtatacacacttgatggcccatcagccagcattttgattgttcttttttccatggtatggccatctggtagatcgaggttcttgaaccattcagtaaagtgatgcttgtgtttcttcatgatccatgcattagatcgccccacatttgttgcttgtaattcatgcaggtgttgctctatgtacggctccactattgcgagttgctgcagcacagtgaaatgagcatctttcacttttttgtagtcattgtcgtggattattttcttcccttttgttcctttcccagataatctaccttcatgtcgagataccggtaaaccaattgctttcccatctttttggtaatcaatgcaacactcaacgacctcctcggttgtgtatccctctatcatggatccctctgggtaggcgcggttccgtacgtaaccttttagaatggacatgtatcgttcgaaaggccacatctgatgcaggtacaggggcccaagtgcaattatctgaggcacgatatgaactatgaggtgttgcatcatatccaaaaatgatggagggaaacacatctcaagctcgcacactgtctgtatagtgaaagcctggagaggacataactctttaggatcaattactttctgagatatggaattgaagaaataacacagcttagtgatgaccagctttacgtgaactggttcgactgctctagttgcaatgg

SEQ ID NO: 88929 - DNA, 657 bp, Oryza sativa
ttcaaaatatttaaactaactaaagttgtattatttttccgcaattaattaattaatgcatagatggcggacagggcatggatgaataaagagagatatcgtgcgtcgtacattgaaggagttgacatattcatgaaagcagctaagaagaatgctgcatctaagaagaccaaagatattagatgtccatgcgtgcactgcaaaaatcagaaaagttggaacgatccatctgtaatcgagcaacacttggtgacgcatggatttgttgaacgctacacaaactggtcacatcatggagagatcccaagcaagcaggttacgaaccaggctacagtacgcgacgaagtgttgagctgggacgaggatgtcattgtagtagctgaagaagaagaggaagtgtatgcagtagaacccgttgatgatgatgatgttgttgatggtggcaatggtcagcacaatacagttgatgatgccgatgatggtaatgtcagcgtagataatggtaattttgcagatttggaagagatgttgcgtcatgctaaacctgaggttgttgctgggtccgctcgtgggttggataactttgatgcattgtaaaaggcagcgaatgatcttttgtacgatgaggcacagggctgtgagaaggatttcacattg

SEQ ID NO: 88930 - DNA, 1968 bp, Oryza sativa
aaataaatcatgacattacagatgaaaactagcatgaacgcatcattagatctatacatgtaaactacacagtataacatgaacagatcaaatatgcgcaacatattgaacacgtaccgaggtgacggaaagatcggttgcttggtcgaaacttttcgcaggtgtctacgaagacacgaaacacgcgagcgaagaggaaggcgagccgtcgtgaacaaaacagggagcagtcgcgcgaagcgcttcccaaaaaccttattgccgccttctcccggtgcaggacgtcgaaggcagaggttccggagacatgctctcccgatcgtcggtgcacgccggcgagcgggatggagtagtctacgagcgacggcgcagtacagagtaggaggcaaaccctagattgatttcgccagtgttgcgtgaagacggcgggtcggtttatatagagaagggtcgcttgatcagggcgcccgcacgatctctactgcgcataaccgaaccagataagtcgcgcgtaacttatccggactccacgccgtttgcacgcaccggatttttcggaacgtttccaaaacaaaaacgaatccgatttgcagcaaaacaaaactgcaaaaggaggctgcatctgcgcaagggtgaggagccaatttttcggaccattcgacgcgtacgtcgtgcacgcgcgccgcctgcccggcccggccaggcgaggcgagcgagcgcgcgtgtgtttcccctcttctctccaccacacatgcttcaagtggctaggaggacatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacagttgtacatggttaggagtactggccacgtgctgtgtgagctgctcaagtcaccgaatggattcattccatcggtgctcaatgcaaaccttacgtttcttgggtcctctgcaaacttatgatactttctgtcaaattccttccactgtcttgcatctgcaggatgtcgaatcatcccatccttttttcgcttttcgtgatgccagcgcatcaattcggcatccctcgggtttgagaacaaacgcttcaaacgatctttcaccggaaggtactgtatgacaagctggggaatcttctttttgttactgtctttgcatggatcagactcttctacatcgtcaagggcaacatccagaccctcggactggctacggcttgttttgtatcgactactcttgcatgttgggcatctgtccaaatcctcgtactctttacggaataggatacagtggttaacacacgcgtgtatctttcgcacacccagtgacaaagggcatataagcttcttcgcttcataggtgcttgttggcagggagttgggttgcggaaaaagtttcttcaacagaaccaacaagtcattagaactactatcggaccaaccatttctggccttcaatctcataagctcaagcaccatccacaacaatgtgaaatccttctcacagccctttgcctcattgtacaatagatcattcaatgcctttttcaatgcatcaaagttatccaacccacgggcggacccagcaacaatcttaggttcagcatgacgcaacatctcttccaaatctgcaaaattaccatcatctacgctgacattaccatcatcggcatcatcaactgtactgtgctgaccattgccaccaacaacatcatcatcatcaacaagttctactgcacttcttcttcttcttcttcttcttcttcttcttcttcttcttcttcagctactacaatgacatcctcgtcccagctcaacacttcgtcgtgtactgtagcctggtttggaacttgcttgcttgggatctttccatgatgtggggtaaaattt

SEQ ID NO: 88931 - DNA, 1567 bp, Oryza sativa
cggcggttcgccccgaggcgcgcttcaggcggtaggcgcccttctgcggcatcccccggtaaacccggtgccggagactcccgttcagcgctggctggacgacgtggccaacttagtcaccactgcccagcggcagttggccacgggtggccgatccgccgccacttatacgtcgcgtaccccggttactctctcctcgtcggcaaggaggagggcccgtcggtcggccacgatctcaaggcggtccacagctccaacatcgtcgggggcctcaggaagccggaggcgttatgacggtctctacgggaagcaggacgctcggatcaacatcaagcgacgctggaacgagtgccgagctgcccgcatgggggaaggcgcctcatcatctggagtgccacgctcctgttcacgaggcggccctccccccacgctcacccttggggggacaggttgtagggccttcgtggcgagtctccggaatgtccggtggcccccgaagttttgccccaacctcacggagaagtatgatggtagcatcaatccctccgagttcctccagatctataccacgattatcgtggcagcggggggagacgaccgggtcatggcgaattactttcccatggccctcaagggtcaggcgcgtggctggttgatgacccagccccccgactccattcactcctgggaggatctatgccagcagttcattacgaacttccagggcacatatccccgcccgggggaagaggcggacctacacgctgtacggcggaaggacgacgagtccctccgctcgtacatacagcgcttctgttgggtccgtaacactattctgtgcattccggcccatgcggttgtgtatgcattccggaacggcgtgcgacacaatcgcatgctggagaagatcgcctccaaggagcccaagaccaccgccgagctcttcgagctggcggacaaggtggcccggaaggaggaggcatgggcctggaactctcctggcgccggtgcggcggccgcggctacccccgagtctgccccccgctctaagcggcgagatagtagaggcaaaaggaaaccggcccgctccgatgacgagggccatgtccttgcggtagatgggcccgtacgggccccacgcaaagggaaggccaccggcgacaagccgagctccaccgctccctccggcgagggccggtcagcagacaagtggtgctcggtgcacaacacttaccgccacagtctcgccgactgtcgctcggtcaagaatttagccgagcgattccgaaaggccgatgaggagaagcggcagggtcgacgggagggcaaagctcccatgacctcaaccggtgaccggcgatcggaggccaagaacaagcccccgctgatgatggcgtgacagtgaggatctggatttccagataccttaggggaccgtcgccacgctcgacgggggggcttgcgctcacacctctcgtcgaggcttcaaggccatgaggcgagagcttctggctgccgttcccacgcacgaggcggtccggaaggcgcgctggtcagaggtgaagct

SEQ ID NO: 88932 - DNA, 1648 bp, Oryza sativa
ggccacgtcgagctcctggtaaccttcggcgactccaccaacttccgcaccgagcggatcgacttcgatgtggcggatctcaatctgccctacaacgcggtcttgggcagacccgcgttggtgaagttcatggccgccacccactatgcctacctccagatgaagatgccgggtcctgctggccccatcaccgtctttggtgatgtcaaagtcgccctcgcctgcgcagagcagcgcgccgacaacctggcggtggccacggagccgcaggccccaggggctttcgcgtcccgcgtctccaagaagcaccttacctcggctgacgaggtgcccgtcaaggagatcccccttggcgatgatccgtccaagaccgccaagattggcggaaccttggacgccaaataggaaagcgcgctcgtctccttcttgtgggcgaattctgacgtcttcgcgtggaagccgtcggatatgcctggggtccccagggaggtgatcgagcaccgccttgccgtacgaccggatgcgcgacccgtccggcaaaaagtgcggcgtcaagccccggagcgacatgccttcatcagggaggaagtggcgcggctcctggaggctgatttcatccgcgaggtgatcaatccggagtggctggcgaacccagtggtcgtcccgaaggccaacggaaagctacggatgtgcatcgactacacagacctcaacaaggcatgccctaaagatcccttccctctaccacgcatagataagatagtcgactccactacggggtgtgaccttttgtgttttctagatgcatactctgggtaccatcagattcgcatggctagggaagatgaggaaaaaactgctttcattactcctgtgggcaccttttgttatacaactatgccttttgggttgaaaaatgcaggccctacttttcagcgcatgacttgcattactttgagtaatcagatagggcacaatgtagaggcgtatgtcgatgacctggtggtaaagacacgccaccaggacacgttgcagcaggacttggccgaaactttcgatagtcttaggtccacgcgcgtaaagctgaaccccgataagtgtgtgttcggtgtgccggcgggcaagcttctcggctttctagtctcttcccgaggcatagaaacaaatcccgagaaaatacgcgcgatagagagcttagggatgtgcagtgcgtcactggatgcatggccgccctgagtcggtttatatcaaggctgggcgagagggcgctgcccctattcaagctcctcaagcgctccgggccgtttgtatggatggaggaagcggagcaagctctcaatcagctgaaagcttacctcacttcccccctgtcttggtagccctggggccggagaaaccattgctactctacttggctgcgaccccccatgtggtgtgtgccaccctagtagttgagcgcgaagaaagtgaacgggaggcccctctggctcgcgatggtccctcgtcctccgaaggcctagtgcccaaagcccctagcccccgggagggccccgaggcccccgagggaggaggggaggctttggcaagtggccccgagcccgaggtgacccgggatccccccggggcccccgagcaggggcgccccggg

SEQ ID NO: 88933 - DNA, 1816 bp, Oryza sativa
gcaatcagcgccgcatgctgctcctcctccgtctcccgcatgacggagtccagcgcctggatttcggctagttgggtctggcgcattttgcgccctaacctcaccatatcgtccacggcgcggcacccctcgtcaactcgcgcgtggttcgcagcgagttgtgcccactctgcgtccacagccgttcgctctttcgctagggcttggacttggacgttgagcccctcccgaacagtggagtcggcggcggcgagcacctgcagaagtggctccatactcgccggagtcggagaagaaaaagccacggtccgcccccgggacgacggggtactgctggatcccctgcgagactagggactgtctcggccccccttctgcgagaccagccccgagggcgccccaagcgcaagggggagcggctgtccctctcgccccctgcttcgggtcctcgagtagattcagcctcggccttgggctcgggaccgcccctagcctcggcctcgacctcgggcccggtatgtgtcctgtgggtcccaccgcgaggctgcgaagaccccgcggccttggattggccgggcccggaccactccgatcgttcggatttcgtcccccgcgaagggtccgaccctgagactccatgagaaagaatctcgctacaagagaacccagatcgcgttaacaaagaaaaaaaaaaggagggaacaagaggccgagctgggaaagagcaccgaagtgggtgccagcaatcgtacctgtggggagggcggttgaaagtccacttcgggggctcgatgaagctccctcggcacggctctgtttgccctatcttccggagccgtttcttcttccgtccgacctcgggcccggcaggtcgcttgtggcccgctggcggacgatctatcgcgcgctcggcgccccctccacgcgggggagagggcggccgagattcgggcaccttccgcttcccctttgggtcgccggccgagtcgtctccgggcccgcggctcgggccgggcgcccttgagccgccaccaccgcctagaccacttgtccggcttctgcccggggtcgcgccggcaccacccgcgccgacggtgctaccactggcgctgcctcggctgggctggctcctaccggcaccgacaaccgacatcacagccaagatgctctcccagtcgcggtcgcagcagagggggaggatcccatctgggattagcgtttgctcggcggagtccaggcccagcacccgccggatcaccatcttcgcgtcctcctcccccctgtcccagcgctcgcccacatgcatgcgcatggggtcgttgggaccagtgtattcccacgcgccacgggatcgttcctggagaggtgcgatgcggcggcgaaagtaaacgccaaagaccattgcccccgtgaggcccaggcttcgtaggcccctgaggcgatcccacaccgtgtcgtattcctcgcccagctccgaaaccgccagccatgcggcggatctttcaggaggaccagcaggaactcgaagtcgcgggtggtctggcaatgcggtgtagaaccagtctgtaacataccaaaaattaaccattttctaattctgtatcatgctgagtcttatgttcttaataacttcctaaacctaggaaaatataattagagggaccttttaaaactatcttgcataaaatatctttctggtatttaacttcttttgtgtttttcatttaaaatacatgtggttgaattgaggtatttcttgctttggtttaaaaccttcttttgactaaaatttctttattcaaaattagtttgaaaa

SEQ ID NO: 88934 - DNA, 680 bp, Oryza sativa
aggcggccggtcggtgaagacgtagacgcccaacagcggcggcataaaggccagccgtgcaggcggaaacaccagtcggcggcggcgaaggcggccggtcggtgaagacgtagacgcccaacaacggcggcataaaggccagccgtgcaggcggaaacaccagtcggcggcggcgaaggcggccggtcggtgaagacgtagacgcccaacaacggtagcataataggccagccgtgcaggcggaagcaccagtcggcggcggacgaggcggccggtcggtgaagacgtagacgcccaacaacggcggcataaaggccagccgtgcaggcggaaacaccagtcggcggcggcgaaggcggccggtcggtgaagacgtagacgcccaacaacggcggcataaaggccagccgtgcaggcggaaacaccagtcggcggcggcgaaggcggccggtcggtgaagacgtagacgcccaacaacggtagcataataggccagccgtgcaggcggaagcaccagtcggcggcggacgaggcggccggtcggtgaagacgtagacgcccaacaacggcggcataaaggccagccgtgaaggcggaaacaccagtcggcggcggcgaaggcggccggtcggtgaagacgtagacgcccaacacggcaacataataggccagccggcagg

SEQ ID NO: 88935 - DNA, 546 bp, Oryza sativa
gtcctcgcctatatggttggttggtcacaccaccgttcatgggcgtccacgtcttcaccgccggcctgcctccgtcgccgccgagtggtgccttcgcctacacggctggcctattatgccgccgctgttgggcgtctacgtcttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctctgtcgctgccgactggtgtcctcgcctatatggttggttggtcacaccaccgttcatgggcgtccacgtcttcaccgccggcctgcctccgtcgccgccgagtggtgcctgcgcctacacggctggcctattatgccgccgctgttgggcgtctacgtcttcaccgccggcctgcctccgtcgccgccgagtggtgcctccgcctac

SEQ ID NO: 88936 - DNA, 587 bp, Oryza sativa
agacgtagacgcccaacagcggcggcataataggccagccgtgtaggcgcaggcaccactcggcggcgacggaggcaggccggcggtgaagacgtggacgcccatgaacggtggtgtgaccaaccaaccatataggcgaggacaccagtcggcagcgacagaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagacgtagacgcccaacagcggcggcataataggccagccgtgtaggcgaaggcaccactcggcggcgacggaggcaggccggcggtgaagacgtggacgcccatgaacggtggtgtgaccaaccaaccatataggcgaggacaccagtcggcggcgacggaggcaggccggcggtgaagtcgtagacgcccaacagcgacggcataataggccagccgtgtaggcggagg

SEQ ID NO: 88937 - DNA, 577 bp, Oryza sativa
aagattgatcaggtgactcaaattgccgcgcaccgttcatgtggaagatatcgataattggaatgactgatttagttgatctgtgtagataatttgattacattttgtttctcctccatcttgtagtcagctctcaccggtgaatcccttcctgtcacaaaaagaacaggggacatagtgttcactggctcaacatgcaagcatggtgagattgaagctgttgtcattgcaactgggatacactctttctttggcaaggcagctcatctagtggattccactaaggttgttgggcattttcaaaaggtgattcatcgatcttcagactgtaataagaatctcacaagtggatgtgctgtaagctatttctgactactgaattttcaggttcttacctccataggcaacttctgtatctgttcaatcgccatcggtgcgattgttgaggttataatcatgttcccaatccagcaccggtcataccgggatgggatcaacaatgttcttgttcttctgatcggagggataccgatcgcaatgcctactgttctgtcagtcacacttgcaataggttctc

SEQ ID NO: 88938 - DNA, 1772 bp, Oryza sativa
cacgatccagcggttgtgttccttcttccatgcaatcggctagaagatcattgatcccgagggactagatgaactccaagcagaacttgtgagaaccctatgtcatcttgagatgtactttcctccaactttctttgacataatgaaacatcttcccgtgcaccttgtgaggcaaacaaagtgctgtggtctagcattcatggctcgcagatgtatccttatgaaaggtacctggggatccttaagggttatgtacggaaccgttcacaccccgaggggagtatcatcgagagttacaccaccgaagaggtcatcgatttttgtgtgaactacatgtcagaaacatcttcaattggattaccacgatctcatcacgaagggaggcttgatggtgttggtactgttggaagaaaaactgttaggttggatcagaaggtgtacgataaagctcatttcacggtgctgcagcatatgactgaggtggtgtcgtacattgacgaacaccttgcagttctccgacaggagaacctaggccaatcagagagttgggtcagaaataagcacatgtcttctttcaacgagtggctgaagaacccaattgccaggtttgcagaacttgtctagtgaaacacttcagtggttgtcacagggtcctgaatggagtgccaccacctggcaaggatatgacataaatggatatacctttcacacggtaaagcaagacagcaaatgcacagtgcaaaacagtgggttacgcattgaggctgctagtgacagtggtcgtcgtgatcaatactatggtagagttgagcaaatattggagctagattacttgaagttcaaagtcccgttgtttcgttgtcgatgggtcgatcttcgcaatgtaaaagttgacaatgaaggtttcaccactgtcaacttggctaacaacgcgtacaaggatgaaccgtttgttctcgccaaacaagttgttcaagtgttctacatagttgactcgtgtaacaagaaactacatgttgttcatgaagggaaaaggagaattgttggattggacaatattgcagacgaggatgattacaaccagcacgtccacagcatatgtcaagaaatacctctagaagaggaggaagaagaagatgacgttcaatatgcacgcgtcgaccatgaggaaggattatttttgtaatttatgtacgtagtttatgtctacatgtcttatctatatgactctaataagttcgcaatgatcaatagtatattgctgatgaaatagtcaaataaaataattaagtgaagcacccactagaagtgaaataaaataattaaattagtataaccattggaaataaaataataaaattagtaaaataattattgtgcaattactactgttagtgaaataaaataattaagaataacaaagatattagtgtatgtggaaatatgttaaggaaaataaaagaactaagtgaaataaaataaaataaaattgttgtaggcaaactcacctgtgacgggctcttattgcggggccgtcacaggtgacctcacctgtgatggcccagactgttgggcctgtcacaggtgatgtcacctgtgacggctccacagttggggcccgtcacaggtgacatcacctgtgacggccccatcgttggcgcccgtcacaggtgagtttgactagggttgacctagggttggacctcttctagatctatccagatccggcacccactctcactcactcactctctcgaccaccgccgccctct

SEQ ID NO: 88939 - DNA, 716 bp, Oryza sativa
acgtcaagccttcatccgcgaggaggtggcgcgacttctggaggccggattcatccgagaggttatccatccggagtggttggcgaacccggtcgtcgttcccaaggcgaatggcaaggttcgaatgtgcatcgactacaccgaccttaacaaggcatgtcctaaggacccttaccccctaccacgcatagatcagattgtcgactccaccgcggggtgcgaccttttgtgttttctagatgcatactctggttatcatcagatttgcatggctagggaggatgaggaaaaaactgcattcattacccccataggaacttattgttatacgacaatgcctttcgggttaaagaatgcaggtcctacttttcaacgtactactcgaatttctttgggtagccaaataggacgtaatgttgaggcctatgttgatgacttggttgtgaaaacacgcaaccaagagaccttactctcggatctagcggaaactttcgaaagtctccgcaccgcccgcataaagctgaaccccgacaagtgcgtgttcggtgtgcctgcgggcaagcttctcgggttcttggtctctgcccgaggcattgagccaaccccgagaaggtacgagctatagagcggatgcgcccccccagcaagcttagggatgtgcaatgtgtcactggctgtatggccgccctaagtcgattcatatcgggctgcaggaa

SEQ ID NO: 88940 - DNA, 651 bp, Oryza sativa
  unsure (1)..(651): unsure at all n locations
ctccgacccaagaagatgtgcgtgaggggccggatgcccgcctcaatatcgagcgccggcgcaatgatcgccgtgctgccacgcatcggagggcgcttcctcgtccggagcgccacttcggtccgggcacggaggccagccccccgtgtccccggttggcggtgccggctgtcgagactttgtggcgagccttcagaacgtccgttggcccccaaggttccggcccaccatcaccgaaaaatacgacggaagcgtcaaccccgccgagtttctccagatctacacgactgggatcgaggccgccgggggtgacgacagggtcatggcgaatttcttccccatggccctgagaggacaggcgcggggttggctaatgaacttgccacccgcgtcggtccactcttgggaggatttgtgccagcagttcaccatgaacttccagggcacatatccgcgcccaggtgaagaagcggacttgcacgcggtacagcgaggggacgatgagtctcttcgctcgtatattcagcggttttgtcaagtccgcaacaccataccatgtatccctgcacacgcggtgatctacgcgttcagggggggcgtgcggcacaaccgcatgctcgagaagatcggctncaaggagccccagaccac

SEQ ID NO: 88941 - DNA, 2362 bp, Oryza sativa
taaagtcagcgtgccaacgtacattcagcaccatgctatttggcgctgaggtgtctaagttcagcgccacatgatttggtgttgagcaaaagggtcagatttaaaataagttttggaagcggttcatttgtaaaaatagtttttgcaaagggtcaaattgtcaaaatttgtgagggatttgggtgcctttctattttggaggtttaatagaggccctgtttagattctaattaactttttttcttcaaactttcaacttttccgtcacatcaaacttttctacacacaaactttcaacttttctatcacatcattttaatttcttcaaacttttaattttagagtggaactaaacgcagccagagttttgtaccttgatttttcttcctttacctcaaaatctatttgggagcttagtttagatgttccgttggagataatctaactagaagcaaatctaataaatggaaatggacgcaaaccaatggtttgaatttgcttagtttcataacgacaacaaaatcatgcagctctttatagtcaatatacttctgcggttaaattggtagggctgcagtactaattaactagctcatggcaaaaatagaacaattaatgttctatacacaaaacaacattatgaaatttcatttgtaccttggctgatagctgccgcaacatgcaaagccgtacgtccctccggctccgggccagcgaacgatgccggcgacggcatcccgtcacgtgacggacgtagcagcgccgcaaccaaacacaccgaaccactaccagtcgtcgccgccaagtacaacggcgagacgccatcgccggatgctactgcggccagctcgggagcttccgccatgaatagatccaccacctcagcacggccgtgccggacggcttcgtgcagcgcggtggcgcccagctggttcatcgcccgcagaggcgccgtcccctcggcggcgcgcatcatcggcaagagacagtctgctacatcccggtgcccagccttcgccgcgcagtgcaacggcgtgtcgaggcacttgttcctcgtggcgaccagcgacggcgccgtctcgctgatgagcttcgcgagctcgacgtggccgcggctggcgacgagatgcaatgccgtgttcccgttgctcgtcaccccaaggagggagctcgtacctgtcgcggcgccgctgcacgcagggccgcggcgccgacgttgattgagacctgcagggcgtctgttcgacggtagccaccgtcgtcgctgccgcagccttctctccccatcaacagctcctccatgcggaccgcgtcgccgtcggtgagcacctgtaccaaatccgcatcgagcgtcatcttttggcgtggcccgaattccgcggctgcggcgacagcatccgccatggttgactgaatttgaagctttatctgcggcgcttgctttgcttaaattgctttgtgtgacgcacacctcactgcgccgatccctcttttttttttagatgctgaaacactgctttggtgaggtaattactcctaattaggtaaaggacatttgtgagcactgctcgaggtcaatataatactcctttttttccccctcatgtggcggcttggcctcctttggatcttgaagcaagcccatcgcaatatcgcatcttattgccctgattccttgattccttctgcctccagaccgtgagtcggagcagctgcctgttaatggcggcggcagtgaacaaccctcattttattccgtagcgatcgagcaccatggcttctgcttggccgtttgcgtttcgttgtgttcgcggacgcgcgcggcagtgccggcgggcggtgactccagctgccgtactactgctgcgaggttctctctcggtgaaccatgaacacgagactgtttagtggcctgaaaagttatgtgaggtccgtgcggcccgttacagttgggccagaaagggattcaaagggacatgctaattatggctcgattttgctatatatttgtcgacaaattttctcccaaaaatttgacagatgtaattacagtacaatcgtagtgtaattacactgtaacttgcatgtaattacattgtatctatagtgtaacttgtatgtaactttcaaaaatctctctgtaatatgttatttcggtaaaatggaggttgtgggaacaaatccttacacatatgtgtgtgctgtgatttttttcttcctcactgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtc

SEQ ID NO: 88942 - DNA, 523 bp, Oryza sativa
gcacgacagtagttggctgctgcaagtagtggcttgttacaagcccttccccttgaatttgacttgtcccaagtcagagcatttggaaatctttgcttgaagtgaagttcacggttcccatgtggcatcagttcaagcaggatcagaccaccgaacaagcaattgagaaccaatacgattaccttttcgggtaactctggtatccaggacttcagctgggaactggatattgcaagttgggaaaggcagttgttgctgaactgactgcttgaaccctttagaactcttcagttgggacacatgaaaaacacggtgtatggcactgccagatggaagctgtaacttgtaagccacctgacccactcgagaaatgatcttgtaaggaccaaaatacttgaaggagagtttatggtttgctcttttggcaacaaaagactgtatatagggctgtagcttgagaaaaacccattcaccttcttggaattgcctgaaactcctctttttatctgcttggtgtttcata

SEQ ID NO: 88943 - DNA, 1178 bp, Oryza sativa
taaggaagatcacaggataggtactctgcaatagctctggatttcaacagaaaatggcaacaaaagcaacacagagaatgtttattagtacaaacaaggattttcacttttccatatactggtgaaagactatcagcaattgcttaatcatgagacatgcgtgattaatttaaatatgttcccgcattctttacatgatttcacatacagtattcatccccgttctttaaatatgtttgattaatttaagtatgtgtgattattatgtttgaatcgaagccatatagactgattaatatgccaatttaactgttaacggcagtgaaggatttgatcaaaaagaatttaataagctataagcagttgttgatatttgaatagataaattatactgtttcagaattgacgacagattacgggcctgtttagttcccaaacaaaatttttcacgctgtcacatcgaatgtttggacacatgcatgaagtattaaatgtagacaaaaaaaaataaaaccaattacacggttcgctaggaaattgcgagacgaatcttttaaacctaattgcgcgatgatttgacaaggtggtgctacggtaaacatttgctaacgacagattaattggtcttaataaattcgtctcacaatttcatggcagaatttgtaatttgttttgttattagactacttttaatacctctcaaatgtgtgtcgatgtgacatacaggggcaaaaatttttgccaactaaacaagccctacgataactgaaaagatagggcagattagttctactctgagcgcacagataaatcaaggacgacccaagtacagaaccacctataggggattcagttaaggcaaatccaatcatgagtggacagtgggcaccgaccggcgagcagggaggctggtggcgggggaggagtagccgttgtagtcgccggagcggacggcggcggcgacggcttcctctgcctcgggcgcggtgcggaagcaggcggaggaggaagggtcgccgtggctgagcgggatgacgggccgtggcccgttctcgtccaggcacgcgtgcagctgaaggaggtaccgctggatgctgcgttccccggccgcggccacggccagattcggggtcgcgaagcgccatcgcttccccccgcggccgccctccatcgccgga

SEQ ID NO: 88944 - DNA, 2367 bp, Oryza sativa
  unsure (1)..(2367): unsure at all n locations
caccgccacggtggatggccaccgccgcccgatctggccgcgtaggtgccggttgccgtcgaccctcgccgccatgcccgcttgccgccgtcgcctcaccgcgcccgcccggtcatcgcctcaccgcgcccgccatggtcgccgctgcgcccgcttttcgccgcctcgcaccgtcgccgccgtcccgcgaaagtagggagaggagagccgccgccgctcccgtctcgtcgtcgtcgtcgtcgtcgccctcgagcggggaagggcgagagagggatccccccgccggatccgggcggcggagggcggatccgggcgccggccacctcgctccgcgccacccacgacgatccctgcacccgcctccaccgtgtcccgcgcccggcccctgacgccgacagcgcatctcaccgccgccaatgcgctcagcacggcgccgctgctgccgggggcttccccgacgaagcccgcgcgccggtcgtcgagccgcacccgtgcgcctgccggcgcgcgcgtgagaagagagtaagggggggagagagagagagagttgagaggataaggatgagaggtggtgagaagaggataaggatgatgtggtaggggaggagagagagagttgagaggatgaattttttttgaaattttgggagggacaggtcgcgtgcgggtgagttaacccgcccgcacgggataatgtattttcccatgtgggcgatggcagttccctatttttccatgcggttccacttacggaccgcatggaaacaaaatagtgtggcgtccaggaaaatctattatgtagtagtgagatcattcgtcgaattattatcgcagattatccacttgattacatggttaaattaatgttttgataaataaacataacaactttacaataagtgatctaaacaatgcaataaaactatttttaagaaaacataattttaaagatgcaaaatggtgcagcaaataatccggtgaaataattgaaaagaacatgnccgttcatacattttcatacatttttaagtgttcggacgggatgataaaagttcaatctttaaaaatcactacgccagaaccctacatctgtgacggcatatcattgacaggcctatgaattggtcaaagatgaccgtcacctttgacgggtcgctatgtttgccgtcatcggtggggcatccggccgtggcccgtcacaggtatcccctcacctgtgacgggccggaaggaaaagctgtcacaggtgagaaagtgacgtgttttcctcccaacccgttactgttatcccctcacctgtgacgggccgtggcattatgagccatcacaggtggtggtccgccacctatgatggatttttttttacggcccgtcataggtaggtcaatacctttgacgggcaactcaattgaagcccatcaaaggtatgaccaacatctttgacgggcttttttaatctaacccgtttgaggtgtattgggtctataaataccccccaaaccgccaactgttttccatcccgaccagttcactgttcacaaatcggttgggaaggcaaggggggcgatttttttgctaaaattcaaggtaaaaaacatattattctccattccttctcaatatatcgatcatcatatatttttcttcgtatgttgttgatttcagatggatcgtagatggatgtactatgcgcatcgttcgtctaccgagtatagagaggggtcattgaatttgtcacatttgtggataatgacagaaaaagtaggatgagcatgcacatgttgtgtccatgtagggactgtaagaatgaacagatgatcgaagatagcgatgaagtgcatgctcatttgataatgaatagattcatgaagaaatatacctgctggaccaagcatggagagcaagagacgcctgatgtcgcagctgaagaagtgttggaccaggatgtagagaacaccgccggcgccgcagctcgagaaagcatgttcgtaccttctccttaaggtggagagaccatagatttggacactcaatatctatctacaatgttgcatgacattgaagacgcagaggacaacgacagagattttgagaagtttagtaagttggtggatgattgtcagatgcccttgtatgatggatgcaagtcgaagcacatcaagttgtcatgcgtgttggaactcatggagcttaaggctagtaatggctgccggacaagagttttacagaacttcttgagctgttaaaggacctgttgctagaggggaacaatttaccgcaaacgacatatgaagcgaagcaagtattatgtccgttggggttggaggtaagaagaattcatgcatgtctgaacgattgcattttgta

SEQ ID NO: 88945 - DNA, 599 bp, Oryza sativa
aataacaccgcataccataacatcccacttgtggccagggaggatagtacccctcatctgcagaaccatcctagccaagagccagaacaggcacccaatgctgttcctccccttgttgttggccgggatgccgatatcgacataccgcattggggaatcggtgtcacagaaggcaatggtcgggatgtttcccagagcagactccttgattggctgcagacataattcaggataacacgatcagtaaacaatactgtacccaattcaccaacgcactaccgtgacatggtgatcattttcacctggtgatcggtccttgggtcagtgaggatgagcagacggggctcgctgaaggaggtctggagctgattggtaaatgtaccaggcgtatgccttccagcaatggcgtgcgcgccagtgtactgcgcgaacttgaggacggcgcgctggccgtaggggcgggccgactggacaatgatgtcctgggggttctcaatggcaacaatcaccctcgccgcgagctgcagcttcttccatgtcttgccgaggttgatgatgtagatacctatgaattgcagcaacgatgttcacgtattcat

SEQ ID NO: 88946 - DNA, 548 bp, Oryza sativa
tgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaagaaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttcttgcaatggaaggcaaaaaatggggttagtgacaaggcatttggcgatttattgaaactcgtcaagaacattcttccggggggaaacaaattgcccgagacaacgtacgaggctaagaagataatctgcccgttaggactggaagttca

SEQ ID NO: 88947 - DNA, 559 bp, Oryza sativa
aaaggcttgtcagacctgctggtcttggtgtccccactggctgccttgcagatgacgctgttcgtgtgcttgcagcggcaaccggggcgtctcaggcggtcgtagcctcgctgggccagcttgacgcagcctgtggccggcaggtagcacagcagacagggcagcaccacagagagggcgcccatgaaggaccagcgggcgcagcagttggagccggaacaggagcaggggtggtcggcgcaagagccctcatcatcctcattagtacagtgatagaagataccttgcaccagacacatgcatgtgccatagttgaccagcgtctgagccgagcacaggcactcctggttgcagacccagcaggaaggtaacgtccgaggggacgcacactctttgcacttacactttccacaggcctcacacagcaagaagtgcttgtctagctctggcggagctgtcgggcctttgaggtccagcggcttacagtgaaccaccttgggctggaggcgcacagccctgggtgaggcctgctcagccacgggcggtggagccatgtgat

SEQ ID NO: 88948 - DNA, 542 bp, Oryza sativa
tcaaataaggcgcattttgccctattttgtcgcatcttctttttgaaaccccagccaaacaaaaacaagctatgtgtcatatccaaaatcctaaaccagcgcttcccgagtactcttgtcttcccccaaaatatcaggaaacatggaactcacttccaatgggagatgaaaccgctcaagccctcaccttgttaaatcgtatcatgaagctcaaggagcaaggtctgcaaggggaacagatcactcggcactttatcaaaagctgactggcacccatcaaggagaggtctcgtactgccttcgagtttgatggaaaaaatgatcccaatcgtgaagatcccgaatccctcgaattcaaaattatgaaggagagaatgtacaagattctcatctgccatagaggtcagttattcacatatactaccagtggtgccatattacgcattcaacccttctcctccagtgagtattgaaaactctttaatctccttgcgatatctgctcttctttgtaatgttcttgactaagggtttgaaatgtca

SEQ ID NO: 88949 - DNA, 507 bp, Oryza sativa
agtactaatgcattttttttctttttaaatgctcagtgggcaaggagctgttgcaactcaggtacatcaaacatcaaggatcaaaatttatgtgcaactaagctagtacctcttttactgcaaaagggtgtcctcaggactaactgcatagactgcttggaccgcacaaatgttgcacagtttgcgtatggcttagctgctttagggcgtcaacttcatgtgctccagctcaatgaaacccctacaattgaattgcatgctcctttggccgatgatcttatggatttctatgaacggatgggtgatacgctagctattcaatatggtggctctgctgctcacaacaaggtacttgcttaattctatttactgactcgttggagcataatttgtgcttcctctactgtgtaatacaattctcaaacaaatgcatctttcattaaacccttcttcatattcttattcaattgtcctatttttgtttctttcaaagcgatttttcttctt

SEQ ID NO: 88950 - DNA, 517 bp, Oryza sativa
cgattggcccatagcccgactgggtgtagtgcgaagagaccaaagtactgatggtagctaatcaacccatttgccggcataagggcgcagtcggtcaaaaacccgtgctttgatgccttgaactaccataccattggcgcattcgacctgtctattggtcatagaatgtgctacagaagcataacaaatcttgataccaaagtcttcacagaagtctttaaacacatcactagtgaattgggtaccatctataatgatacgattaggtaccccaaaccggtgcacgatgttgatgaaaaaatctcgagctttgtcggtagtgattgtgacgactggtttagcttcgatccacttggaaaatttgtccacagctacaaaaagatgagtgaaaccaccagtagcccttttgaaaggaccaaccatatcaagcccccacaccgcgaacggccaggaaagagggatagtttacaactcctgagttggtaagtgaatctgtatgggaaagaattgacaatga

SEQ ID NO: 88951 - DNA, 834 bp, Oryza sativa
  unsure (1)..(834): unsure at all n locations
ggtttcttatcgaatgagcctagtgtagtttttcttatctctttttaagtggtatttcgctacttttgtatctccccccccnnccccccagttgccatttagatcacatgctaccccacnnnccgaggaagcgnncgagaacaagcanncacgngccggangngncnacaacgcacaacatgnggnccccgagaaggaacggaagtttgttgtgtcatggaatgtgatgataggtgctttcgcaaagaatgggcatggagagagggcacttgaacttgtggatgcaatgttgcgttgtgggatgcaaccagattcaatgacattcacaactttgctcatggcatgctgccactgtggcttggttgatgaaggtcttgcgctttttgagcggtttgtggaaaattctgcccttatacctactatggagcaatgtgcttgtattggggatttgctttcacgagctgggaggttcaaagaggctgctggatttattgatcagatgccaatcagaccaaatgcagttgtatggggtgctttgttatcttgaagtaggatgcaccatgaatgtggatcatgcacagatcgcttttgagaaactggttcaattggagccaaataaccctggaaaatttgtgactatgtcaaatatatattcaaaggccggaatggttgaggatgcaaagagagttaggatgatgattgacagggaggagttagcgaaaccttttggacaaagttcgggttaaactttggaaagaaggtttttttttgggttattcttgcctggattttaactgatacataaatgataggttattgttggggctgggcaag

SEQ ID NO: 88952 - DNA, 2348 bp, Oryza sativa
aaccggataagtcgcgcgtaacttatccggactccacgccgtttgcacgcaccggatctttcggaacgtttccaaaacaaaaacgaatccgaatttgcaacaaaacaaaactgcaaaaggaggctgcatctgcgcaagggtgaggagccaatttttcggaccattcgacgcgtacgtcgtgcacgcgcgccgcctgcccggcccggcccggcccggcgaggcgagcaagcgcgcgcgtgtgtttcccctcttctctccaccacacatgcttcaagcgactaggagggcatcctctcttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggcactagaccgtctgtagactacccctcgggtggagcgtataagtcatactcctaggtctttagtaagcttcctagaagattcacccaaaatcttcatagactgcgaccaacagtcaagctcacaaagttgagttctttcaagaatgctctgcaggacaacatctttgctaattaaagccaacagaactcattaaggcatagccaacctgccttgcagctcacgagagtatatgcatcttcacttggagagggtatatatattggtactctcctctagtttattaatggtttgttcttcccaggatctaattcacgggatctccgatcacataggctgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcacttggacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccaattagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattctagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattatggtcaatctagcaacaggtgagtaagtgtcaaagaaatcttcgccttctttctgagtatagcccttagcaacaagccgagccttgtacttttca

SEQ ID NO: 88953 - DNA, 3092 bp, Oryza sativa
gcaacgcccccggctgcgtctactactacccctacggcatgggcttcaccgacgggtaccttgccaccgaaaaggttcacgttggcggagcctcgttccccggcgtcggggtcgggtgcagcacggagaacggggtcggcaactcgtcgtcgggcatcgtgggggtcggccgcagcccgctgtccctcgtttcgcaggtcggggtcggccggttttcgtactgcccccgctccgacgccgacgccggggacagcccgatactggtcgggtccctcgccaaggtcaccggcgggaacgtccagtccacgccactcctcgagaaccccgagatgccaagctcctcgtactactacgtcaacctcaccggcatcaccgtcggcgcgacggacctcccggtgacgagcaccacgttcggcttcacgcgcggcgccggcgccggcctcgtcggcggcacgatcgtggactccggcacgacgctcacgtacctcgtcaaggagggctacgcgatggtgaagcgggcgttcctgtcgcagatggcgacggccaacctgacgacgacggtgaacggcacgcgcttcggcttcgacctgtgcttcgacgccaccgccgccggcggcggcagcggcgtgcccgtgccgacgctggtgctgcggttcgcgggtggagctgagtacgccgtgcggcggcggagctacgtcggcgtggtggcggtggactcgcagggccgcgcggcggtggagtgcttgctcgtgctcccggcgagcgagaaactgtcgatctccatcattggcaacgtcatgcagatggacttgcacgtgctctacgacctcgacggcgggatgttctctttcgcgccggcggattgcgccaatgtgtgatggagtaattactaccgttcgttaagtacagtataaacccaataactacggagtagaagtactatattgtacgcatgtggggatcatatacagtttttgtctagcttgctgttcatcataggacaaataaggcttaatttctcttgtgccgtcattctctgtttgagattgtgtcctaactgacaacgttctattttgccgtgtctggtacgtattctggtgtcacctgattgactatgctctgatgattttcagcactaattaaacaagtttgaatataatggaaggagtaggttttggtttttgactctttcgtttggcctacggaagaatcaattaatgaatactctctcacacacattatacttcagtaggattattaaaaaaaacaactgttgtacgttttcaagtgaaaaactttcgaagctaatagtaactatactataactaaaatatattatttgtatataatttcaccataactatactatagctaatataaattcaccgtaactatactataactaaaatatacttgtatataaatattaaaaaaataggaaggaaacccgcacaatctatctatctatctatctatctatctatctatctatctatctatctattatattattaaaacagctttgaaagaaggcaccacgttcactgtaggggctagaaattcccacattaatcggagaaaaagagaaaaaaagaaaaggagagtccaagtagaaatacaatttaaaaatagctgcaattcagaataaaaaataagcaatattgaaagaagttttcatgtaagaacccaatacgagattaatcaaaattcaaaataaaaataaaataaaatccaaaattagaaaagaaaaggagagtccaagtagaaatacaatttaaaaatagctgaaaatcagaattaaaaataagcaatattgaaagaagtttccatatgagaacccaatacgagattaatcaaaattcgaaataaaaataaaataaaatccaaaattagaaaaggaaaggagagtccaagtagaaatacaatttaaaaatagctgaaattcggaattaaaataatcaatattgaaagaagtttctatataagaacccaatacgagattaatcaaaattcaaaataaaaataaatctactactacttagaaaataagaggtgcttccatcgtctgtcaaaaaaaccgggcgaacaaaaaccgggcgaaaaaaccaggtctgtccgtaaaaaaaaccgagcaaaaaaaaagtgcgaaaaaaaggaaagaaaaaccaaaactgtccgatccgaaaaaaaaccgaacgaaaaaaaccaaagttgtccgatccaaaaaaaccgagcgaacaaaaacaaaccgggcgaaaaaaaaagtgcgaaaaaaagaaaaaccaaaaaaaagatgtccgattcctatggcaaggcagaaaaaaaaacacagtagatccgattcccttaaaagttggaaaaaaatcatattcctatattatcctatttcccgtacggttgtttgtttttcttctttttttcgtttctttttcgttttttcttttctctttttttctttttttatttcttaatactatgtatgtatataaactttatatacacgtatacaaactttatatattatatattttttcttttttatacgtatgtatataagctttgtatacttctctatctccactattaaaaaattcaaaatatttccttcgtccgtccctacttaaaaaattcacactaaaaaagatctgtccgattcctaagaaagtggcaaaaaaaaaggttcataaaaaataaaaaagcaaaggagaaaaaaagtacaaagggagaaaaaaagcacggcaaaaaaacgtccgatttctattcgttttttagttcctatatatctcttctctatatctaatataatctaatctaactatttaaaaagagaagttttcatagtacaacttaaaaagaaaaaatgcgcgagaaaataaaaacggttaaaaaacgtggagatagagaaaaaaaagcaaaaaacgcgtgagaaaaaagtcagaacaaaaaagctaaaaaaggtttccgtcttccgtaaaaaataaaaaaacacacgaggaaaaaactgttagaaaaagcacgccatttctaaaaaaatggttcgaaaaacctcacataaaaatcaccgtttataaaaaaacaagggctgcaggaat

SEQ ID NO: 88954 - DNA, 614 bp, Oryza sativa
aggtcttgtattcttcataacccagttatacactccagcaagatttgttgtcatcacaccatacctcgatccatctgtatcgtacaacaacgaccatttctcccttggctcaaattctacccactccgtgaagcacttcgtgacccttccacgcttcctgcgccgagtaatacttggtgcttcattaggaatgggttcaagtccctccggctcctcctgtctggcaactataggttttttcctaacctcttccatgtgtgtagtggtcaaacgatccagttgatcccatatggcatcaaactttctttgttgattctgcttgcataacttcttgaacaggtccatcaatctcttactcctgaattgtctataaaaattagccccaaaatgtcgcatgcatcatctgctatgtaaatctggccatggcacggactgtgtgacatcttcttgaagcttctgtatcgctgatagcaaaccggcgtgtcggtcatgcagaacacacacatttggtctgttttcaacaacacacattttaatgtgccgcaaaaaccatagccagcttgatgtgttctcgctttcaacaaatgcaaaagcaataggaacgacatggctat

SEQ ID NO: 88955 - DNA, 683 bp, Oryza sativa
ccaatgagttcttgattgagaaaaaccatatgcatgtgtggcacgtaagatggatcaattgtaaaaatcagtaacacatactactagaactttctcacaaaaccaatgcttctaatgcaccaacagcatgccattatcccaagattggaagaagctaaaaccatagtgctgtatgtgtacctctcttgtccagcggtatcccatatttcaaatttcactattgttgagtcctccaaagccaatgtttgtgataaaaatgatgcaccgacagttacctgaaattatttgaggaaataagtttaaaacaatcgaacttctgaaagtaagaatcatgcatctaaggtgaagaataacattatcaactgaaactaagagactcaaaacagtaatcaccttggaagtgggatcaaactgaccacgaacaaagcgaagaacaatgcaacttttccctacaccagagtcaccaagcaataccaactacaacatcaaaaggatggacacgttaaagaaagctgctagtaacatgatatagaggcattattgtagtaataaagggcaaaatgtgcagtaaaccttagcacgcaagtcctttgaatcagtagcggagttatcgttgctaatattgttcaaccctccagtgcttcgagctggatgacaaaacagtgctatgtgttaacaaatgg

SEQ ID NO: 88956 - DNA, 967 bp, Oryza sativa
agcttagctattagcgcgcggcgcggcgagcgatgcgtttgccggataactggatatagactgctctctgtgttggcacagctgcaggttaacttgagctgagatggtatcatctgcttgcttgcttgattaatccgcatgcaggaaaggggtgaagtgccgggtgctggagtcgtcgccggagctccgggcgtcggggttagccatcgcgacgtggaggaatgcgttgcaagcgcttgacgcccttggggtgggtgacaagatcaggaagtgtcatcttcatcttcaggagtaagtactagtgtactttcttcgtccactcactaaagtgcggttaaacttggcgcaatttttaaaactaatttgtaactttaaatttctcatatattataatgtttgtcgcaataaaattataattatatgaaagtaaatttaaataacaatccaataatattattttcatcgaataaaatttaatttatagtttattggtcaaatatttaaagagttaaatattaaaaaacgtgcgcatttaaagagttaaatattaaaaaacgtgcgcgccttaatgagtggacgaagtcgcacaagacttaacaaagacctaaacactgcaggagatacacctttgttatttcgtttttgcatgtcactcaaacatgcataatttatttttagatgaaacaaaataaattcatgtgtatactttattaccatgtatgtctaattcgagctctacaagttgcaaaaaaaaaagaatatacggccgtacgtgatatatgaatattatgtacattttaatttgttagtagttaattcttaattgagaaattgtagtagttaatttaattttgtactttttgagtgatatactgtatattaattattttttgaaaaaaatataaatgcaagacacaagtggacatttcctagagcgggtaccgagctcgaattcgccctatagaag

SEQ ID NO: 88957 - DNA, 508 bp, Oryza sativa
aatccctcccccgaaaaccccgcgagtttcttcaatagctcacccggtttcgttcttgcggcttcggtttgatttcccaggtgaagccgcagaagaagagcagcaacaagtgggtgtgcgtggtgtgcaaccagcgccagtccgtgatgcgcgtccacgcccgcgggcaccgcgccgccgacctccgccgcttcgtccaggaagccaacctctcgcgcggccgcgccgcgcatgtgcccgtgcccgaggaagactgggtccctgcggtgccgggggagcagcgggatgagttcccgaaggagaggaagaggcggatggactggtccgactatctggaagatccgggggagtacgatggcggcggccaccacgaggaagctcgagatgaaggtatgcgcgaaacctgtttgatgtgatgtcgcaatgtatgtgtatcacagtatcagtatgatattgggtagcgtgtaaaatgatatgctcattaggaccaatggtaagttgattttgc

SEQ ID NO: 88958 - DNA, 587 bp, Oryza sativa
tgtgtatttgtgtgcacgctttcaagcttctcctcgtgcttcacatcgtcaagcggtcaagcgaataatgaggtatttgaatcatacacttgagtttggaatttggtattctacttcatcttctatatgcttaagtggatattccgatgctgatttcggtggttgtagaattgatagaaaaagtactagtggaacatgtcattttcttggtacatcgttgattgcaaggtcttctaggaaacaatttagtgttgctcaatcaactgctgaatctgaatatgttgctgctgctagttgttgttcacagattctttggcttttatctattttaaaagattatggtcttacttttgagaaagtacctctattttgtgataatactagtgctatcaatattgctaagaatcctgttcaacactcacgcacaaagcacattgatattcgttttcactttttgagggatcatgttgagaagggagatgttgaattgtagtttttggacacaaagttgcaaattgctgatattttcactaaatctttggattctaatcgttttgcttttcttcatggtgaattggggaataatt

SEQ ID NO: 88959 - DNA, 758 bp, Oryza sativa
ctcactttatatctgagagtcaacctatctatgagattcatttactttgtggaaccaaaagaaacaatttgtagattgtggtatgttgtagaaactgaatatccaatgcagtcagcagcatgtcatgttcagtagattccttattttattttgttgctatgcatgctatcggcaactctaatgttcgtgtaatataatacaggattcaattgtggagaagctgccaattttgcgactccccaatggttgaagtttgctaaagaggctgcagttcgaagggctgtgatgaattatcttccaatgctctcccatcaacaactattgtacttgctagcagtttcatttatatccaggtttttttttctttttctttttggagtttggttttgtgctgtccaaagtgtctttttagtttttgcacctcattaataggttgatgaaacaaaatatattacctttgtcctccaacaaaccaaatgctacagctagtgggtaggggttagatgcttgttaggtctgccatacagaaggattacgcataaccgcaaaggtgaagttgtcatggtgctcctgggagacgccgcattacaggatcaccacaatgctaggtgtaagctagacttcaactaaatcacattatattccaagtatatcagatggaaatataaacggcaaatggaaaatgtagcgcataaaacccactcaagccgctacacccacccgctacccagtccatgagcccatttctacaccctctc

SEQ ID NO: 88960 - DNA, 641 bp, Oryza sativa
agacttgcagctgggcggcggccaaaacccaaatcacgtcaacaagcaccggaactcgagagcgtgccgcaatcgtagtcgggcatcatgagcagcgtcttggcgagcaccccggacaacagcttgtcacgcaggaagcccacggcggggtggtcgctctgctgcacgaaccccaccgcgtacgacgcaccggtcagctgcgcactcctccaccgccgggcgtccgcgtaccggcgcagcgcggcctcgacgacccggtgactctcctcggcggcgcagtcgccggtacggagcagcagcgcctcgccgaggcacctcgccaggacgacggcgtcctccagcgccgtgcacgcgccctgcgccaggtccggcgtcgtcgggtggagcgcgtcgccggcgacgcacacgttccccttgctgatgctcgcgaacgggagcgacagcggcgatcggaaccgcagcggcgccgcgagcacgtcgttcatctcgctccgctcgaccgcctcgagcacctgtggtggcacgttcgtgctccggagctttgtcagcacgaactgcttcgtcgcggctgaactcttgtcgacatccttatctgtcaaaagacacggcattaatcagtaatacgattcagtgttcatgtc

SEQ ID NO: 88961 - DNA, 582 bp, Oryza sativa
tccgcctcattcattgtattataaggaatatggaaaactaactgcatctctgagttcttttactgaattttatctaagctgtatttcaatattccacaggttcgtaatgacaaatgtgtgtttttggctgctgcttcaaatttgttgccaatactggagatgtaccaagcgggtgacacgctaagtgaagaactattacacaaaaaacactagttttaccctttatttgcatactcgatgccggaaactcgatagatttttacttgtacttatgttcatgaataaaaaatagcaaaacaatccttatcatatctcttcctgctcgctaattggtttatccatttttctggaaggcttcccaggtactccctccgtcccataaaaaaccaacctagatgtgacacatcctagtactacaaatctggacattctagattcattatactagaatatgtcaaatccagtactagattcgttttttttttggacggagggagtattccttatatgctggtagattcatagttcatatcctgtaccaaacatggagtttcagtttacaaaacaatgatccttgatata

SEQ ID NO: 88962 - DNA, 722 bp, Oryza sativa
gaccattatcacagaactaacctacaccaaaaaccggtcgtagctgcgcttcttcctgcccaccgcatgccctggcgcctccgtgctgcagcatatcatgtagctgtagtaaggcgccatcctggacttccatcctagagcctcgaatctcccgcgaggtgtggcgcttcccagcatgatgtccgagatattgggagcctggtccggacaggagtccgtctcatagtaatcagacatccacagaggattgctggcctctgcaaatctcaagcaatgcacccattggcccttcagtaagagattgttagggtgatcaccatgcaaacggagctggttgcgtatgtatgccctcaggtacttcagagtagagcaccagaactgggcattgaaattatccctcagtaatccaccaatggtgtatgcagccagaaaggacccgctgtactccgttgcaatctccatggctaccgaagcaagcttcgggtgctcatccgggtctctgcttccaaatgcaagcttcttgaagaaataccagtaggcttctggatgcaagaggtccagccgaatagctgctgctgttcccagattctcgatcttatctgacctgctggtgatgattattttgctcccacgggcccagcaactcatcgaagattttaagctttgccatgtttgttcactgatatcgcaagctacctcaataattatcaaccaccttttac

SEQ ID NO: 88963 - DNA, 662 bp, Oryza sativa
gcggcgctggcgccggcgccggcgccggcgtgctgcacatagttggcgtcgcgagggtcgggaagagcaccctcgtcgaacacgtctgccacgacgagagggtccgcggccgattctcctccatcgtgtgcttgagccgagaagaccttgaggacatgggagaccatcgtgctctgaccgtcaagcacggcagccatgcctcccacgggagctcgctcgtcgtcgtcgacctagccgaggacgaggagcccgtgggcgacggggcatggaggcggctgcggtcgtcggcgatgtgcagggcgcgggggagcaggatcatcgtgacgagcaggtcgccggagacggtccgtggcatcccggcggcgcgcgccatcgagctcaagttcctccgcgacgacgtctactggtacttcttcaaggtgctcgcgttcggcagcgcgaacccggacgaccacccgaggctggcgtccatcgccatggacatctccgcggagcagaagggcggcttcataggcgccaccatcgccagcagcctgatgagggccaacccggacgcgcactactggaccctcatcctcaagaacatgagggagtacacgcggaagcaccgcgccatgttcggcaagcacccgcacgacctgctgcggaacaaccacccggtg

SEQ ID NO: 88964 - DNA, 1261 bp, Oryza sativa
tcttataatgggttcatgccatatagcacatgattgcaggattggcaacaataacatatttgctaacaatactctatttgctggccatgttgttgttgaagtgggtgattatttaccatgataatcttcatccattttcttggtcaagaacccatctgtgtattgatggaattcattgtttcaggattgcacccatactgcaggggctgttgttgtccatcaattttgtcatattgggtcattttcatttctaggtggaggctctgtggtatgttgtgtcgataagctttcatctgaattctgtaaaattacaaagttcttatgccaacaaattacattgcatgtaatcttgatcgatcttctcaaggaatgataatgatgcaaataagacataagaagcaggcctcgtgaactgaagtcatagaattagcatgcacttcatctggtgatacttttctaggaataggtgcatgatcactactactaggtacttatgtttgttagcttattagttgcagccaacatttgaattttgaaacttaattttagagtcaatattgtttttttttatcatagcctactttgcagcattggcttttaaaccacgaataatacatatacagaagttccacccatattttttttgttgcatcgttcatatttctatggcttatgagctgtagctcaaccaatcagaggcctagacttgtatgcggtcaatcatgtcaagtgtcagtacttttgcatatattttctttccaacaacattcttatttgatgctgatggcgttgcagttctcacctaggctgtccatttgtactggcactgcaattctttagtctttttttggggggaatgaattcttgtctttgaactctgaatatgatgtccgagagtatgaaattcattcagttcaatttgaatcagatcgcacaagatgtgccaagatacatgatggttgcaggtgatagagcagagcttcgtgggctgaatcttgaaggtcttaagcgcaatggtttctcagaccaagaggtttccatatacttctgaaatatgtagcctttattcataacatgagtgcacttctttatgttcctctagtagttgtgcgagggtacttaaagttctgttgtgatgttcctttaccaatatggtaatgtttaaacatattgtcatcttatcacatttactggtaaagcataacgaggatgatctggaaccaacctcaattgactgcaccttcttagttaactatataac

SEQ ID NO: 88965 - DNA, 648 bp, Oryza sativa
tcttttcgggcatcctcccagctagcgagcaagtgaccagctgcatcggaagcttctgcggcaccaaaaccatctccaccatgaccagcagagtcaggtaaaagttccttgcaggtacccgccaagagtgcctcatctgtcgcctcaacgggacgcattcagtgccaccattgccaagggtttgggcatgtgcagaaagattgccctagtcaacgggcctatgttgctacagaagatggctacatcaccacctctgacgtggaagaggaagagggggaagaagaagttgatgatgaggatggcgaagtctttggtcgtgatgacacaacggactacaggaccatcatcgtgcagcgggtgctcagcacgcaggtacaacagcatgacaggttgcaacgccataatttgtttcagattttcttcgtcatcaacaaccgttgtgcacgtgtgatcattgatggaggtagctgcaacaacttggtgagttctgatttggtcaagaagcttggcttggctacacgtacacatccacacccttaccatattcagtggttaaatgattccggaagagcaaaggtaacacaggtttgtagggtttcgttttccattggctcatatgcagattatgttgattgtgatgtggttcct

SEQ ID NO: 88966 - DNA, 608 bp, Oryza sativa
agccccatcgacagtggcaatggtggccccaggctcttggaaacctaggtcatcatcgccgtcatcgatgtcctcagcgggggcctttgcttggcctcacttcgccgattgccggaaggaaccgccggggacttgccctctcggcgctcctgccttctctcttctctcccacttcctcgtccgctcagccaaacttttgactgcacggcagtccgcgaggtcgtgaagggaagtgttgtggacggtgcaccacttgccggttgggcgctccctgctgggagcgccggcctccttctttttgtctcccgcaggcctcccctttcgggtggcccgcggagcgccctcgacggcgaggacatgaccctcgtcgtctgaatggactgacctcttctttctcctcctgtcacgcccccctgtctgagcggcggatccgggggcggccgaagctgccacaccggaaccggaagggttccaagtccaggcctcctccttgcgagccactcggtccgcgagctgaaaaaactccgcggtagtctggggctccttggaggcgatcttttcgagcatgccggtgtgccgcacgccccccctgaacgcgtagattaccg

SEQ ID NO: 88967 - DNA, 604 bp, Oryza sativa
ctagaatgacttacattgtgaaacggagggagtacctttcactcttcccctattggtggtcatcaggtcttcaggcaacatttcagagaatcaagttatttgcttgtaaaggcttaaaaatgaatgttgaaagttgaaacctatgacaatcagtgcaatatttgccaacaaactaaacacagaaattgtaagttacctggacttctcacccttccaccagtcactgaaggttcttcactgcttggtaagatttatccatgaattttatagagggcttgcctcacattgagggatatactgcaattttggtagtggtagattgtttcactgaacatgcccaattttaccctctgaagcatccaatttcagcagtcatagtagcagaatttgtcatggataatgttgctaaaactcatggtattcctacattaatagttactgatcaggatatatagattactcaccagtaattttggaacgacttgcttgcgaagcttgatactcaattgaacctagtaccgcactccatccacagcctgatggacagacagagcggattaatcagtaccttgaaatatacctacaaagcacactccatgaaacg

SEQ ID NO: 88968 - DNA, 1894 bp, Oryza sativa
gccccaacttaaggcccgtttgagatatggaatgttatctcaatcgggcctaaagttggtgtccgtcacggatgatggtcatctgtgacgggccccaacttcaggtccgtttgagatatggaatgttatctcaatcgggcctaaactacggctcgtcactgataggtgtcatccgtgacgggcttaatttttatgcacttctaatatgtctgtgcgaccatatctcaatcgggcacttttttggctcgattgagatgacttccttgtgacggcccgctatttccaggcatgttagaggccgtcaaagatagaaggatctgtactagtgtaaagaacaatttaagcatatatgtctagctctgtactccaaagagtatcccatttatgtcatgtgaccatgtcatgatactgcaaagagtatcatttattcattttgaactgtactcattacacattgtgttctctcagctactaaaacacctgtactgaatatatgaacaatgaagaatgctattcagttctttcttttctgcacaactcggaataactcagaatgctatagagttacactgttgcagttctgattcttaggaccataactcttaggagtaattcaagcacagaaactataaaacctgtttttttatgtacctcaacttggttctggaaggactgtagcataactgatgatctcatccaaacggagggcatttcctgtaacctgcagaaaagcgcagttgtatcttcttcttttttttttttaggagaacgacggcaggagatctgccggaattttaaattgagaagggtgaaaaacagagttttacaggggtacaaatctgaaaaggagagattacaacttatttcaagatacaaggattacggaggtttaaaaaccagaatacgaaggtcaatatcatgcttaatctgaagagctatagatagctcagggctagaggagttttggaaaattcttttatttcgctcaagccaaatgttctaccaagtagttagaagagcacccttgatcgatctcacttgctctttagaacccgcatgactaatttcggcccaccatgttgaaatatctgaaagaatagaagcgctggcagggccgaaattctgaaaacgacaaaccaggctccaaacttgtcggacgtaagggcattcattgaaaaggtggtttgtgtcttcgaacgcacaggtgcaaaggcagcaaatcagttgcatggccaatgcctatgcagcaagatttgggcagttaatgtttttttatggaactagccaaccaaaaaaatctcattttaggttctgtcggggccgtccaaagggagctgaagtcaattgaggcaaacgaaccttaaaattgaaagagatacgcactctttgaagagtacgatccagagcttgttaatttccaagagatgtcatccggttcttgagaaagagatacagattggagtaggccaccgagttggaccaattcgtgaagctcttcaacggaggtgaattggcgaaacgaggaaagccatttgttatcatttagttcgaattgtactgatctctactttcgctttgccaatctgaaacagtttggggcaaagtcttttaggcattgattttgcagccaattgtcgttccaaaaactcgtctttgctccattacctaccgagatggtggtggctgcttggaaaagcttcacatccaggccgtcacggggaagttccatgcctacccagggcttttcgtcctccttccatttaaaccacagccattgcaggcgtagggctcgtgaaaatctatccaaatctggtagaccagcccctcctaggtttttcggtctacaaacagtctgccagttaatcagactatcacccgggtttggggtgcagga

SEQ ID NO: 88969 - DNA, 522 bp, Oryza sativa
aaattacgatgtggtttgacaacaccaaaacgaaagctagcctgcttcgtgattatggtgaggcacataccattcacacactatagcctctgtaccgtttttctgtgattttcttttcctaacaagtttcacgcagcaaataaatctggagcggcctgctgcgagactactatggaccaagggctgccatctacttcaagtacttaatattgagcatggagaaaaaagaaccttttgctctggaggaatggaggagggaatggattagcctcacaaacaactggcagagcgattggaaggtctttccaaccacagctacgggagacgctctgaacatctcccggacactttacaagaagtacctgcacgacgctgacttaattcagccagaaggtattatacgactgcgaaatttgaagaatacaccttggtaaatgaactggggttgttgcagctgtaatgccttctttttcatgaacatgaaacgaaacagtgtcgtcgatactagtctatttctatttg

SEQ ID NO: 88970 - DNA, 3389 bp, Oryza sativa
attcctgcagcccaaatgtggagctagaaggcctcgtcaaagcctaggactgaagttcgaagccaatgcatagatcaatgacaatatccttgcacgaagaggtttctccaaagcggtgcccccaaggaggatgcgacgtggatcaccgccaccgctcgttcggaaccgaagcaaggttttcacccggagaatatggtagggaaaagaaaggggtatgctaaacaacgcctataaggaggggaacgacgccaaacggcgtcgccgttgtcagtcggccaaatggctcggcaaggctttcgcccgcgattccctgtccaaacccacaccaccaatccgcatgacggattaattaggcttaataaattcgtctcgcgattttcaggtgagttatgaaattagttttttcattcgtgttcgaaaacttcttccgacatccggtcaaataaaatgtttgatgtgacatctaaattttttttcgcgaactaaaaaaaaggccctagtcactagtgtgggaggcgttgactggacttcgaagcatatgagatcaggataaaaacctttgctatatatattcctcatcagctgctgtaacggactgaatagaggaggctgctctactagcctagtagtagtactgtagtatagagataacttgcacgccgtctttagcgacgattggagcagtcgtgtttcagcttctggtgacgacgacgacactgtcagcagcagccccgaccccgatagccctgcctggttgcccggaaagctgcggcggcatacaagtgccgtaccctttcggcatcggcgacgggtgctcctaccatggcttcaacctcacatgcgacgacgaggcgcaccaccaccagacgccgcccaagctgttcatggccacagacaacggcaccgtcgtccaagtgctcaacatctccttgccggacggcactgtacgcgtccgcagcaagctttcgcagtcatctattgccggctcctcctcctcctcgtctaatgcctcgtcgtcacggtccgacctaccggccgacgggccgttcacggtgtcctccgcgtataactggctggttgccttcggctgcaacatcgtggccgaccttaccccgtacggcaatatcgccgacggcagcagctgcgccgccacatgtatagatggatggcaaaatttcgcaggcccctcgtgctccggcatcgcgcgctgccgtacgtccgttgggaggggtgtccactcgtacacgatccaggtcacgtctctgatagaccgaaattccatgggtgcctcgacatcgacgacatgggcagctgcgttcgtagctgagcagggctggttcagcgcgaatgagaatgccatgttgtacaacttcaccaattggctgccgttcacggtcgagagtgttccggtggtgctggaatggtggctggatttgatccgtgatggagccatactgccgttgtcagttgggcccaatactaccgactttagatgcctaagcttgcatagttcaagctattacaacgatctaaactacgaccgaagacggtgcaactgttcccaaggatacgaaggcaatccttacatccgtgatggatgccgaggtatttttttctttcctgctttattgtgtttgttgcagcgaaggctccaattttcatgtaaaagaaaagttatacatatggcccgttcttttctcatgaagttagagattttatctcgtttttcattagaggaattttacggtccttgaaaaaaataccttaaggtacctaaattttacactaaaatttttggtaccttgaagtacttagtacctagaggtatcaaattttacactagaaaaatatggtacctctagtaacttcttaaggatggtaaaattaaccttttcattagcacgttttttaaactactaaagacgcatttggtgcgaaaactttctatatagaagttgcttaaaaatcaaatatatctatttgttaaatttgtaataattaaacttaattaattatgcgctaatagctttctcgtttttcgtgcccatatttaatcttaatccacatcagattcaacaccaccatatatagtatcacttgatataattatatagaacatgtaattatatcatactatcagttgatagaagctacttacctcgtcccaaactatagcaacctaagatgaaatgagactcatcctatgataacgaatctggacatgatgcatccaatcatgaattgcattctttaattttcactcccatatatttgttccccttttcagatatcgatgagtgccagcagccagatgtttatccgtgtcatggaacatgcatcaatatgcctgggacgtaccgatgcttagcaaagaaaagtgtcaaaagcctcccaggtacaaatgcaattcctcgcaaaaaaagaaaagaaaaaagaagaagcaatcgatcacttgctcgattctattagcggagttttcgattttagaactgtatttgtagccttccaggtacaaatacagttcatttggatccattctatacattataaaccctatgttcctgacgtttattctctgcaggtttaataaccattatagcagttagtgctggttttgggctactgttttcacttcttggtgttgccaaaatcacaaataaaatcaaacaacgcagagccaagaagttgagacggaagtttttcaagaagaatcatggactgcttcttcaacaattaatatcttcaaacaaggatatagctgaaaggatgaagattttcagtttagaagaattagaccaggcaaccaacaaatttgatcaaaatcgcattcttgggggcggtggccatggcacagtctacaaaggtatattatctgaccaacgtgtggtggccatcaaaaagtcaaaaattgtggttcaaagggagattgatgatttcataaatgaggttgtcatactttcacaaactaaccataggaatgtggtgaagctatatggttgttgccttgagacagaagttcctttattagtttatgagtttatatcgaatggaactctttcatttcatcttcatggccaaatgagaatcctttgaagtggaaagatagattgagaatcgcactagaaactgcaagggctattgcatatcttcactcggcagcttctatatcagtgttacatagagatatcaaatctacaaatatactactcactgatactatgacggctaaagtatcggactttggagcttcaaggtcaatttcaattgacgagacaggaatactcaccatcatccagggcacttatggttatctagatcctgaatattattactctagtcgactgactgagaaaagcgatatttatagtttcggtgtcatcctagctgaa

SEQ ID NO: 88971 - DNA, 1282 bp, Oryza sativa
acaaatgaccatgaaagccatggtgctaatgtctcaggagagaatagttagtgtgtatgttttctaattttgtaataaatgttgaagagagcaggaaagataaatgagggtgtgcgcgcacaagagagagcctaattctccatgcatgccttatattttgaaatatgtttgcaaaaactatgggccttatatttctaaatagatagagtaatatttattttattgatgaatgatacaaagatgcgcctgtagtgaaatgagatgacctagaatatatgccgttatgaatctgaagtacaactgtttctgggaagaaaacaataatttgttgaatgattcaagattgatttaatcaacaattaaaagcactcagatgtgcaagacatgcagaatattgaatggaaatttattatggcatattgaaaatatcaccaaaagacaatgttggtgaatagcgatatactgtaaaacttatatgagcagatgtgctaggaattgagcagtaatacataaatccaaaactgcaagtataactttatatgattaacaatcatttcaatacaacaaaattcaaatcaagaacttttagttaggaaaccattctcaccagttcccaaggtgagtaactttagctgaaggaaattttgatcttagtgcggccgggatgttaccagaaaaggctggaagaactgcaatcatgtaagatattagacaacttaaaatgtaaaatgaacaggggtcagcgtttaacaactagaaagggcaaactgcatacttgtttatttaaattatctgattttagcagagaagttctgaaagaaatggcaggagagaaatccaaaccactatattttcatgagatcacataatattaactatgctaaataatctactgtaaaacatatgcatgcttatgtaatcacaataccacataaagaccatgcactaaaaaaatgcaactgttttgcatcacctgggaacatgccaaaagcatacatcctagaaaggattttcttctgaagagctagctgatcatcaagccagctttgaggaagaggtccgccccatctgataaatcaatttgtcactacatgttctttgagctacagttccttgcaacaaaaattgaactcatagcaaaacactaatatgaaacatcaatataagtcatattatcaacatggtggcttgtataaatctctcataaaaaagggacttataagttcatcttacaaccgataagctaactgtttccagcaactacccccttattcgggggggg

SEQ ID NO: 88972 - DNA, 580 bp, Oryza sativa
aaggatgttggacgagcatttggagtgcttcaagctcggtttggtatagtacgtgggccagcttcgtttttggaaagcacttatctgaatcagataatgagagcttgtataatcatcaataacatgattgtggaggacgagcgcgatggtgattttgatctagtttatgatgagatgcgagaacaggtgggtggttcccatgaacgtacgaccaactttgatgattttattagtcagtccggaatcattccagacaaggtagttcgcgaccgattaagggaagtcctcatcgaacatttgtggaatcgtcatgcagaccgatattaattttacattatatattcttatagataatgtcatagattgtaataattgcatattcacagcttgtttttaaattagtacatattgagtctatagtaattatttattgacaatgtgatttattgttgaattcgatacagtacaatagactgaaaaggacagcagtgcatatcctttttcaggactggatatatatacaggatatacaccacaagggtgtacatcagaatatgcactgctacatatgcaagccgat

SEQ ID NO: 88973 - DNA, 2919 bp, Oryza sativa
atcagttttaaatccatgtatggttgtcaatgcactaagaagcagggtgcaatggcactggtcaaggacatgtaccagcattcatgctacttatgatagattatcaccaaacattgcatcaccccacatggagatgttgttggttggtgaggttcaaggaacccttggagcacatctctatcttgtttttatgtttccacacacaactttagatatgtttagtctgtatatgttgagctgagataactctactggaacagctgcagaaattttatttacattttaatatcagaatgattttcctttttttaatccatgttagtggctagcaactttgcatgataattgatatggtcagatttgaaaggaagctccagggcacatgttgtccagaagaagctaatcatgtgttgaatgagtcataaggtttttacaggtcagattctatcgaacatttctaggtgaaactcaaaatatgaaaaagtatgcaaaggaatatcaataccacctccgtcccaaaacgttactacctagtaatagatgctcatgtccagattcgtagtataggatgtgtcacatatagtagtactagataacaacatttcattttgagacaagtatagtagctgggatgggatgacctgatgacagtcttttacttgccttttcactctgtgtcactgatgggatcatgtgcagaaaggagtttagcattcattggtttggtccaacttgtgaaaaatgaacggatgcatgacaaatctttgtatagtgtatcccaataaatccatcactctactgttcccattaaaaatgaataatttaaaataaaatcgatgatctgacctgctgcattgcgtgcttgagcacccatatcttggttcattggttgctatcagcatccccggggcggctccagcatacagtcgaattttttcatttttaaatttttattttttaatatttacagaaatattgtaccggtgaaagtatttacaaaagtaggtgacgtgagggacggacaagatgaaaaagacactagaaaaatgcatttttggcaggataaaaattacatttgcccccttgcagtccttgtagagggcggcaaggcacctcagtgcaaaatgcacacaccttgccgccccaggggctatttctgtaaatattttagatggtataatatttttgtaaatattaaaaaatgaaaatttaaaaatgaaaaaaattcgcatacagtccgggtggtccaacctttgaccaccctggatcgcgaaggcccaaacgaaaaaaagcccacaagcatcagagccaggttagggttagccggcagaggagagggctcaaagccccgtgcacgcgccgcctctccctccgctgcgctcctcgcctcctctcggctctcgctctgcgccacaggcccacagcgccggccgtcgcccatcggcggcgtcgggtccctctccctcctgcagtcctgctcgagctcgacgacgacgacgagtctatgcctcaagccctaaacagctcctcataggtgagttactcattttagtctttactctttagtatttacttttaatagatcggtcatcgatgaattgaaaaatgtggatgaaaaaaatgtgattgaaaactgaaacttagattttttttttatcaacaacttagttagtagtcaatataacttagtgtatgaaggatgggaagaaactattgtttcattttgcaataaacatagtatccaagttccaactttcgatggaaaaatatgtgcctcatggaagatctccacggttttatccggaccaaacaaatgatgatcattttagaaaacaagtgtacattggtgtacaaagaagtagtgtattgtaatcttctacctatctattgtaatgtaagatatttgaattatttatgttgtaactttcgtaacttcgaacttaaatgttggttttaatcaatttgtgatgttctgagctatattgcaatatttgaattatatttccaccgtatttgtcaattttgatttgattttgtaacatcgtgacaatttgggatgccaagtaggaccacccaacgaatcgatcctagagccgccactgcatcgtctcctcgtccgccgccgccgccatgtgggcgctccgccgcgcgggcaaccccctcaggtacctacctacccccgcctcctctctctcccccgccctctgccactgttcttgtgggatttcgttaacagatgattgattggtaataaatctgtggcttatgttagttcgtgtcatccgtgcctttctcccactcgcgtttttctgtccctgttgcgtggtggcgacaagtagatccatccaaatgccttgtttagttcttgggggtttatttgtgtgattttccggtgccaagttgtgtggtgtccccgttaataggccgtagtttcttgttaagattgatcattgggtcttggatgagttgatcattgccagtgatttatttttacaggtggggagtagggagttgctggtattattcatctgatgttgggactctgttttgttgtaatctcttgaatttctatgcaaattgcagtcttaccatcttgggtttgactgaaatatatcagtcggatgtatgtgagagacatgatagtgtatctactgtgtgtatatgtgcttgaagaagtacccatcttagatgtttgtctatgtagacatgattattactttgcgtagcattatgtacggaacgatattagatgtgtttgaagatggaacaacacctcttcttgtttcaatcatctggtcatgttattgtgaaatgaagcagatattttgtatttcgttttgcatgtgaatccatgttcacgatcataatttgtacctatcatcccatgtttcatgcgttgttaatactgatatttggctt

SEQ ID NO: 88974 - DNA, 2035 bp, Oryza sativa
tcacttgccgattgcttcagggtttcgtgcaccgttcagcaccccaccttcctcggctaggccttctgttgtgccccccacaggtacttaaaaaaacaacattacttcgacaatcaatttacatacattttatgtcttagcttacaagggtcccgttgtcgatgtgtaggtttcgcccagttcgctatgacgcaggccgcccacttctcccaggctgcagggtcagcgtctcaggcagctgtgtcgacctcgcactcagcgcagttctggcagtacaccgggacttcgtcacaggcagccggcatgtcgagtcagggtccaccactggaccatgctgggacctcgtcggactgcttgttgccttccaccttcctcttcgacatcactgacttcgacttcgcttcaggctcgacagaggacatcatcggcccctcacagctgggaggcgcaccgccggtgcagacgcaggaccaggcgcaggccactcctccgcgggacactcgtgctacccgtgctgtgccaccggatcgtttcacctactcccaggaccacgtgcgagcacaggcccggaggaccaagcgtggtcgcggcgcggggcagggccagtagagcagtcttctctttgtttacttgcttcactttccagtactgtatgcttgtgtaatgactacgttgttgttatatgtgcacgatacctttcggcgcatgcacgatacctttcggcgcatgcacgactactttctgccgcaccgatgcaacctcctttattcgcgtgtgatacgagtatttgcccgccatttggcgcatacgaccaatgtaactttcggcgccgatcatgcatgtatctttcagcgccaatcaggcgtacccaccataccccaccacgttcacatgtcaggggtatcactcgattttttgcgcctatataagtcgccttaacgagtgaggcctcacaatctttcagaactcagtcacattcagtactctcttccccacttgcttcattacaaatccgaccggctttcgtcaatggctagacgccgaggtgttgaggatccaaactggcgtagcgatccttgtgtatacctactaccaccttggtgccagcgtcctctctgcctatgcggtgatcgatgccaactaatggcttcgaggaatcctgatattcgaggaaggcgcttttttaggtgccctaactatgaccgtgaggtatcttattatctgcatatgcttattcattccgtatgggcaatcgctttattcttcgtaacactactctattcggcagacccgcactatggcttgcgcatacatcgagtgggtcgatacagaaaatcccgttctcaacctaaccacttgtttacaagaaggtcgctggtatttcgcatccgaaagtactgagcaatacttacagagaaaagcggcttatgaacgacaatgtcgtgaacaacagagcgactggcgggtgctaactacggcactccctccatgggaagcccgtccaagatgcaggtgtggtgatcgttgtcaggttcttcgttccataaatcctacaacattgggtcgaaggttctttatttgtccaaatattcttgacgacgatttcatggtaagaatattttgattacatgaatccttattttctcacaacatttactaactttgcttgctttacatctattctttcctcccaggaaccaccaaggagatgtcaatacagagaatggatagacaccagaagggttctaactccacctagccgtgttgtgcagcttgaactaccaaagcaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtaaccgcaatgcaaatagttgtatcatgttcaaattgtactactatttcttcatgttacataa

SEQ ID NO: 88975 - DNA, 1925 bp, Oryza sativa
ggcttctgtgccgagacctcggggtcagagggcgacaggcgcggccttcccgcagtggcctcggggccatcctgggggtcgggggcgcctggcaccgtcggacaagcaggcggagggccagctccggccgtcgggggccttgggccgccgttcggctcgggggcctctcctccctgctctctctctctcttcgggcagaatcccggcggtcgcaaatcgcgcgcatcagcaagggaaaaccgaccgacaataaggagcggcccctcggctcgcgtttgccttcaactccaacgaggagtgcggtgacgacggtgcggacgacagcgacggcgaggccggctacccaggcgcgtcggagtgagcccccaggcctccgccaatcttaatagcttttcattcttcttccgaggccttcgggcccccttcttgttataggctgatttaatctgcaatcaaataaagaggaaatttttgtgtcaatttcatttgttctgtgtatgagacgaggatggtctgtgccatagtccttctgtgtcttggcttgaacaagggctcgtgcccaggtcccagcctcaaacggcgcgggtcaaggctagtgcctggggagatccacatgtcgagactggccaggccgggagcgtggtgaccgagggttatgggtgacccgattgtgggtttttgccgattccccccggagttcaccacgccccggggcacagctcggttctgggccccgtttggcgattttagccgacccgagcccccgagggtaggattgagcacgagtgacctatttcaagccaagattcttcaaaaggaaataacagcacagatacagcctttaagaaatcgaaaatgcttttattgaaatacggaagagaaaaaagataagcccccggccaaccctgcacgcccggggggtgtggggttggcccgagcccaagacctgatacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagtttgctcagtccagcacgcgtttggacgcggcgtaggacgaggtcgtcgacgcagagtgatcggacccggacgtggagctgatggtagcgccgcaggctctgctggtagcgcgcggctcgaagggccgcgcgccaccttcgctcttccaagtagccgaggtcagggagcgtcggcttccttctttttgtcgctcgcaggcctcccctttcgggtggcccgcggagcgccctcgacggcgaggacatgaccctcgtcgccggaatggaccgacctcttcttcttcctcctgtcacgctgccctgtctgagcggcggatccgggggcggcagaagctgccactccggaaccggaggggttccaggtccaggcctcctccttgcgagccactcggtccgcgagctgaaaaagctctgcggtagtctggggctctttggaggcgatcttttcgagcatgcggttgtgccgcacgccccccctgaacgcgtagattaccgcgtgtgcagggatgcatggtatggtgttgcggacttggcaaaaccgctgaatgtacgagcgaagtgattcatcatcccctcgctgtactgcgtgcaagtccgcttcttcgcctgggcgcggatatgtgccttgaaagttcatggtgaactgttggcacaaatcctcccaggagtggaccgacgcgggtggcaagttcattagccaaccccgcgcctatcccttcagggccatgggaaagaaattcgccatgaccctgtcatcacccccagtggcctcaatcccagtcgtatagacctggagagactcggtgggaaattgacgctcccgtcat

SEQ ID NO: 88976 - DNA, 913 bp, Oryza sativa
tttcaggtcagtgctttgacacagctgaaattgagccctaaaagcaggtgcaataccagggacctaaccaaggtaattaattaagttcaatcaataatcagttggtgttttattgaaaagatactattataaattgtccatccatttttttcaggtttctagaaaagtagtaaaaatattgtcttgttttaacatcctgtctcttttttttttccttgaaggaagttgggattggagatgatcgtggaagagaggggatggactatgcagatgcaatggtagagggggtgaggtttgttgatcaaagtcagaagagtgtaactccatgtggagagctaaaggataaggggctttgtttgtttcctttgtccatgttgctacactaccatggatgaaaatttgagaacttcaatgtagagcacgtgtagggtttatgccttacatgaatgtgtgtgggataaatgaccaaaaaatatagtgtgctgagattactgtggatatattttttgggtgaaaatatatgtgaatatatattaccgctcctgctctccttgtttcatttttttttccattttgttttacttaccactagttatgctctgtgcgtgcagtttattttattagatatctatatggatgctcctaaaagcaacaatatatatagatggttacaaatggtacaaaattgtcatggttatttacatggtgttttgagatgttgtgcagtacaaattaatgaattaaggtgagttgctctcctgctgtcctgcacatatatagctatacaggtaagttccaacgattgatcagaggccatgtaacttagtaagacattagtattaattagtatattcacaattcacaaatgagtgaatgactaacacatgagttacagaacatgtcaatgctctac

SEQ ID NO: 88977 - DNA, 758 bp, Oryza sativa
atccttttggagagatgagcagcggccatagcacttggcccgttacgatgtgtatctacaacctcccccctggctatgcatgaagaggaagtacataatgatgccgattattattcaaggccccaagcaacctggtaacgacatcgacgtgtacctaagaccactggtcgaagatcttaaacagttggtgttaccaaccgggactaaagatcgatctttactcccggttatttcacccgggactaaagatagcgatctttagtcccggattggtactcccggtttggaaaccgggactaaagggggttacgaaccgggactacaaagggtttctccaccagtgtatagtgtatgttaaatttgtgtcataaattggaggggtcataaatttctgccatttaacatagagaattttgtccttatataaatatgagacttgcaatagcaatgcgtgtggtttgcgaaatttctaatgggcgattgatcgccccgcgtgatcacccctcctcacgtgatttccttttttggcaccgcattacttttctattttagtaaatttatgcatctaaagtttatacacctcaagtttacacatctaaagtttatacacctaaagtttagagacccaaagtttataagtcaaaatgcccgattcaaatttgaatttaaatttaaatattttatatatatattatttctatatatctaaagtttacacacctaaagtttatagacccaaagtttttaagtaaaagttt

SEQ ID NO: 88978 - DNA, 695 bp, Oryza sativa
aatcagactattgggagtttttcctcacaatccagattatgctgatgtacacatatatttagggccaacgcaaatgcatttgtgatgacagacaatcaaatccaatctcttaaatgtctccttatgacattctttcaacatgcctccttatcctactatgtcaaatacgagaagggaagcgacttgtcctctgctgcttaacattctttttggcatcatttcaaaaaaaaaaaaacattctttttggcctgctttgaattgggaggttctagctggaggaaggctcatatataccttgttcatcgtacatcggtaaatgcataagcatatcttgtaagggtgttcagaacttacttgtgcaaacgcataagacagtggagagtacatccctgctgccttttcacggtaaaagactgtcctctcaactgacaccacaggcaaaagtgtgagcaaatttgctgctccaaggaagaaaacagcagcataggtggctccaagtagattgttcagatcattcacggactctctgtacatataggaaagaattcaaatgatcagctaagaggcaatagagttgtgtcactgtgaaactacattcagtgaaatggttgcaataagaataggcgaatgggtagaatttgaatataaattagaacaagaagaaggaacatacatattctttcccctccgccaaa

SEQ ID NO: 88979 - DNA, 611 bp, Oryza sativa
ccgatgcgcctggaaataatggcgcaacttcctcgaagttatcaggatagcgtaaagcatcttctgggcctgaaggtatcgggtctcagcgtcccggagggcctcgctaacgaagtagacgggccgctgcacctttcggcggggccgatcttcttcgtcaggggccacatttccagggcgctctccatccgagaggccacgcggggcgcactcggcttctgtgccgacgacctcggggtcagagggcgacaggcgcggccttcccgcagtggcctcggggccatcctgggggtcgggggcgcctggcaccgtcggacaagcaggcggagggccagctccggccgtcgggggccttgggccgccgttcggctcgggggcctctcctccctgctctctctctctcttcgggcagaatcccggcggtcgcaaatcgcgcgcatcagcaagggaaaaccgaccgacaataaggagcggcccctcggctcgcgtttgccttcaactccaacgaggagtgcggtgacgacggtgcggacgacagcgacggcgaggccggctacccaggcgcgtcggagtgagcccccaggcctccgccaatcttaatagcttttcat

SEQ ID NO: 88980 - DNA, 618 bp, Oryza sativa
gccggattcattataccccgtccagtaagtgctttcaataagaagtgatgctatcggacttacattatctaggctctcagcttgtcatacatctctgaaatattttctcttgcagctgattcctgtttggtggagatggttctattgggccaacccggtctcctggaccatctatggagtgattgcgtcgcagtttgcggacagcgaccgtgttgtcaccgttcctggccaatctaccaccatggtggtgaaggatttcttggagaagaacatgggctttaagcacgacttcctcggctacgttgtgctggctcatttcggctacgtcatcatcttcttcttcctctttggatacggcatcaagtgcttgaacttccagaaacggtaggaggccggtgtccagcaggatgtcaatccgaggtcacgtttttggagtgtaaagcaaatgtagcaacttaataccgatgctttttttgtgtagatatatagtctgttcgatatctgctagcttgtattgacacttaatgtacaacattatttactcaaatgttctgagtttatggtatattattattctttttctatgttatcgccatcttgccattttgctggccttat

SEQ ID NO: 88981 - DNA, 739 bp, Oryza sativa
catgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaa

SEQ ID NO: 88982 - DNA, 573 bp, Oryza sativa
taagtactacagatattgaaagttctaattactcaaaatctgatccaagattatgatgctgtgagactgataggaacactaacttagtaagcgtgcaccggctcgtgagatcgaacatgtacaagatcgccacggcgtccttacacgcgatcgggacgtggtcgaggaactggctgtctcctgcattccatcacacaacaaaaactcatcaaacaaagcaagtttaggcacaccaaaaaaaaaatctgattcttcaaccaatgcaagtataaagggggaaacaaatcctgcatttgtagttcatatgcttgtgcaaattacctgccacatcccaaatgctgaaggcaattcgagctccccgaactgccaaggtcttgtccatcagattcaggcccgtcatctgcaagccgttctgctcctcgtcgtccccaacatacttaacctgcagaatcaattacccaatagattaatttactttttactatctggattgactattctgaattcaagaagaaatgattcttgtgttcgattgctgactcgagtttcagaatttgattgcttcttggttga

SEQ ID NO: 88983 - DNA, 623 bp, Oryza sativa
aacatggacaaaggaaacaaacaaagccccttatcctttagctctccacatggagttacactcttctgactttgatcaacaaacctcaccccctctaccattgcatctgcatagtccatcccctctcttccacgatcatctccaatcccaacttccttcaaggaaaaaaaaaagagacaggatgttaaaacaagacaatatttttactacttttctagaaacctgaaaaaaatggatggacaatttataatagtatcttttcaataaaacaccaactgattattgattgaacttaattaattaccttggttaggtccctggtattgcacctccttttagggctcaattccagctgtgtcaaagcactgacctgaaagatgcaaatcaaacaggcaaatcaacaccaactagctagtaatctctaatttttcttttctttatttcttttttaaaaaaaaaacaaagactctctagctttaagccttcatagcaacaaaaatatatagggaattaagctagctgtaactaccttagggctatttactggagagcttgcggtatcctccagggaatcatcatgatccagggccttgaagaccttcttcttgagcttcttcaactcc

SEQ ID NO: 88984 - DNA, 561 bp, Oryza sativa
catgcataagtattcagtattccttgctgatggctgaagaaaggccctattgacaagttcgtagaaccattccccacctacatcctccaaccttttgactccactagaactgtccagctgaataaaaccattagctatccacatgtgaaccaatttatctttttcaaacacatagttcctaggaaatattgaacaatagacaaagcactgccgcaaatatccaggtaacgcactgtaacaacttccaagagaagatataattctgattgcaaagttatcatctgaaacattccaccaccaactatttaagatttccctccaatcagcttcttccaactgacttctcaatgttgccccagttacctttatggatagaggcaatccatgtaacctgtgtgatatttttctaccaatttctttgagaccttccgtggacaaacttctgcagggttcaacaaatgcatatctcctgagaagtgcccatgagtcatcggattgtaaaggatccagaattacagggcctgcagtccctacaaagttagctacactgtacaattgagt

SEQ ID NO: 88985 - DNA, 1261 bp, Oryza sativa
catcaatcccatattgttgaaatttcaggtctgaaatatgaaaagaaagaaggtcctgctattgatttgaagtgtttattttgaaacagttgccgcaaagaaaaagactcaaaatgaaactcgggatcaggccaatctggatccttcttccaatgatatgttgaacaagcatcggaaagttgtcctctacattgtaagatttcttatcatttgtcatattctatcttctatatatttcatatgttaccactgttgaacagttgtcaataacaatgtcagatttatgatcaattctatgaatatctgaaatcatgctcaattttatgttatatctgctatataatacttcctccgtttcacaatgcaagtcattctagcatttcccacattcatattaatgttaatgtatctagatagatatatatgtctagattcattaacatcaatatgaatatggaaaatgctagaatgacttacattgtgaaacggatggagtatataattagtggtttacaacgatgtgattattatacatgtcgaatattagtcttttgctataaaaagttttttccacccttcacattttgaatacacaacttttaaatcctgggtctgcctctgctcagaccgctcgactagaccatacaaccactcaacccgttggctacccacgcaggccaagccccaatgcagcctcgagagcgcctttcccgccaactcggagagctccacgcccacttcctccgccgcggccaccccttcccgccggcggctcaccccgaccctgacctcgaccgcgcctacatctccgtaatccgcgcggccgccgcgccgcgtctcgcactcgcggccttcgcttgcctccgccgcgtgggcctgcccgcgccaggacgccgcgcgctcccatccctgctccgtgccatcgcgttcgcgcgctcccttggcaccgcaggggccgcgcacggtctcgcgtttagggtcggggcagaggtcgatggcttcgtcgggaccgcgctggtccgggcctacgcggcgtgcgggcgtgtggaggacgcacgcagggtgttcgatgggatgcctgaccgggacctcgtcgcctggggcgtcatgcttgactggtaacgcactgtgaacagctccatttcttcacgcaatcctatggaatcctagttgtttgatctatctcgtaagtatcatgttctgtgtatgcctggctgcctgcaaaatggtttattcagttgcttgtgcttagttgagagtt

SEQ ID NO: 88986 - DNA, 1398 bp, Oryza sativa
taattactatacaaaaaataggtctaatttcatcatatacatgatgaggatgggtggctacattgcgcgtatggattgcacttatctaatactacctctgtacaggttgtttagcaaaatttaaggtttacgaagaataaacataatgccctttattcaataatgtacggatggaagtgagaaggtagttgggggtaggatggagaaaattttgaattggaaattgttgtcgggaagacaaccatgccacgtcgaaaggcgtggcactcttagaggattggatgtgtagtaaagacaatatattaattggtaaaaacttttgggatccctcattacatggtcctagatggctatttatagtctcagtacaggctcaaatcctctagggtttaatatatatacagaggaatttatatggatacctttatgataggggcattagtaagggcatatagtgtctaccctagctatgggcccctatatgggcttcttgggccagcccgctaatggtgaatagccttcctggatcgttccgtcctttgggcttcctggcgaagatgattcctcttcgggcgaatctttcctgcttcgccccatggcttcacccaaagtgaagatccaacgatgagtcccataggctcggtggtgaaccctctagacgctgtccttcgacttcgcctaggtgtttcgcccgagtgctaacccattgggcttcaactggcgcctcgcgggtgtggggttctttgtggtttcggcaggttcggtcgaaagcccttgtgacatgcctccaaatgattgatgttacaaaaggtgctctaaagtgacaagtattttgtaacaaaatttaaaccctaaagcgacagacagagggagtagcttgtggtgactcgggttagagcatccccagcacctcctgtatcacatgctccatcctgaaaatagcgcatgaggagagaaaagggggctccaacagatacgccatagggggctccaaatttggcgtttctctctcctcatgccatccagcaactgcccgtctctggataaactcacgccaccatccggatcgcgtcgctccatgggtgccgtgcaagggtagaggtgaaggcatggaggtagagaggagagacctactggatctggcggtggaggttcggagtagaggcagaggcccgcccgccgccgcctgtcgttcctccgccgcgacaccgcggcccgtgcccgtgaccccgccgcccgcgcctcgtctgtccacccgccaccgcctctgcccggcgaccccgccgcccacgcctcgcccgtccgcccaccgctacctgcacctcgcccatctgcccgccgccgcttgcctccatctgctccccttgcctgccgccgcctgcctccatccgctcccct

SEQ ID NO: 88987 - DNA, 945 bp, Oryza sativa
cggtggaccaagtccacgcgcgcaccgggacggcaccgtggacccggaccacggtggttcacaggcggctacacacggtggcagaggggcggcgacggctcacggccgggcgcggccaccggcgacatgacacggcacggcggcgagcatgggaggtggccgccgaagaggagaaaggggagatggaggggagtgctcaccatgcgccggggcggcgaggggcaacgggcagtggaggcgctccctcgggaagggcggtggcggaggtccgatggcgacccgcgagcacgaagcggcggacggcagccgggattccctggggaagaagatagaagggttagggaggaacataggcgaccggagcggtgagaataccacgccggagaggagaggaatggtggagctcaccggcgaccgagagataccgagcttcggcgggatttcggcggcttggagtggcagccgaggtgcattgggacgtggcgaacgtggtggaggcagtggcgtagcttgcggtggacagggatggcggcagtaggcggccggaggcagcaaaagcgacggcggcctcgggtgtgcggtggggctagtttttcggtggtggttgaaggaagaggagcggttgccggggtggagctcggcatggcgatgccgacggcggcggcggcgcagcgcagcggccgctagggcggaggtggtggccggctgaaggcgatgaacggggcggccggtagggtgatgttggggggagggggttccggcaatggattgagggctcgaaggggaggccggggcgcggcatcgtgcggcaaggtgggcggtggtggcgacgcagtgcggcggtggcgggagcggccgtggcgtgtggctggagatcgccggcgagcggcggcgcataggtttcacggggaggagggggttccgggcatggggcgcttcggggag

SEQ ID NO: 88988 - DNA, 11225 bp, Oryza sativa
tttggaggtgttgtggtttttgacgccacttaccatgtcaaccgtacaaccttccttttgttccttttattggtgtaaaccatcaccgtagcatggttgtctttgggtgttgtctttcaaatgagacggtttcttcatatgtgtggctgctggagacctttattaaggcgatgggtggcaagtgccctaaatcgtttatcaccgattgggacctttccatggcaaatgccattgccaaggtctgtcctgatacagatcatcggttatgtacatggcatattaattgaggagaacgcaaaacgccatctccgtggggatgcgctcactgaatttcgtagactcatctacgaagtaatgatggccgatgaatttgagagacgatggtgtgcctttaaaaacagtgataatgtaccggagaaggagttatggttagccatgatgtatgcactaagggaaaagtgggccgcagcgtataccgataggagatatttcttagggatgaggactacacagatttgcagcaacagaaataaagaacaactaatgagacacttacatacaatatgatggctcccatcattcaaagttatttctaccattccagcataaacaagggatgacaaagtacatatgttctatacaacactaggttttcaagccttgcagattttttcttcttcagcacattaaacatggctgacatgttttcatcggcacatgataaatcatctagctgcacttgaagaaaaaagaaatcaacggcttagttgaagcaagatgcaaactgaaatcaataggcagtacacataatattgtgtgttaaaacggcttttggtcaaaacagtgtaggtagcacatgcttgagcatttttaatctgtaactttacattcaggaactgcattttcaggacaactggaactgaagttttcatgtgccctatactgatgagtatattggtcaaatctgttctttttgtgaattcataatgtgaatgaaattaaaacggtgcgatataataatggaatgtgcttacataagttattactactgaattgtgtcacttagctagtatgtatttatgtgatcactaattaatagatgaaatagaatgtagtatgtgaagcactacggtcacaactgtggtgctgctggcgaggaaacggctgcagaccgcagctttgatgggctttatcagcgtgcggcaaaattagggtcacatgaaaagggtttagctgttcaagcgccaaggcattccgtgggatatgcaggcctccgtctagctggccgcagcagcgccgccgccaacgaacgttcgacaaaaactattccctatttttctaggttttttttaattagttggttttctagaaaaactatttggtgcatgtatatatggctatacatctacatggctattggatctaactggggtcatgtatcgtgaatcgatagtaattatacaaaagtaattacaaataccttaagatgcgtctttgctgtagagttgagagcaggactgtcatcttcacccgtattaaccgtagaaaattactgcgattgacgcctctatgcagatggtggtgatggaccggtcaagggatccatgatggtgaatgaagatgcaaaatattgtgagaagaagagaggagaaaataagaacggatgtgcaccgaagacaggagaaagaatgccttttgtgtcgttgctcggttgcctttctgttttttttctgttgctgcagatttagtaatagataaagctaataaccaactgccagattgatgcgtgtttttagcagaagtccaggcgtcgggtgcctgacggggagtggaaaaatcgggcgcccacgtcatgctgatgtcagcatgacgcatgtgtgcaaaactattttaaactattttttctcttaaattatttatccaaatcatgatccaattgcaccattaaatttgttgcaattaaatctttaaaacaagaccatatatggatatattccgatgaaaaaatagcttattattgaattatttataaatattgcacgttgttccaccaagtatactggaattatttcactaagtagatagaaaatgtttcaatcttttaaaatcgtgcgctatttcaccttttataaaaacaattttcagcaaatagtaaaagaatgtttcaattcattgcaacattagatctatatatagtaaaatattttgagtacactaggtgaaatatttttggtggaacaagaaataaaacgaattcccttgatagatggattatgtgggtgattttgttgcaaaagaatgtttcaattcattgtaacatttaatctatacttagtgcaacatcacgagtatactagatgaaaaaaattgttggtggacacgtggcggcgtacggacacgcgtggtggggccacgtggcagcggcgcgtgtaggcgcccgacgctgaggattatcggtgtttatagtagtaatagtctgattattttcgttggtcagatggatcgtactattgtttcctatataagttaaactaatcccgagatcaacgttttgtacctccgcatgatgccgagttatctgtttttttagccgcggatttagaatagctaataaccgtctaacagaactttttatctccgcatgatgccgaattatctatatttcccaaccgggtcgatttttagaaacatagttttccggcagatccttcatagaataaagcggaactgtttattttggacagataaaaaattaagtccgggagaccgggtcgatttttataaaacatggttttccggtcgaccacgcatagaataaagtggaacggattattttgaacaaataattattaagtccgggaccgtttgggaagggtcgatttttaaaaatcatggttttccggtcgatcgctcatagaataaagcggaacggattattttgaacaaataactattaagtccggtaccgtccgggccgtgtcgatttttaaaaaacatggttttccggtcgaccactcctagaatatagcggagctgtttattttggcagaaaagaataagtttaggttagttttggtcgatcgctctagaatatagaatatagcagaatggtttttttggcatacaagaataagtccgcgaccgtccgaactaggtcgaatattaaaaaccatggtttcccggtcgatcactcatagggtatagcagaatggtttattttagcataaaataataagtccgcgaccatccggaccaggtcaaatattaaaaaccatggtgggtcaaatattaaaaaccatggttttccagttgagcgctcctagaatattgccgaacggtttttttttacagaaaagaataagtttgggtcagttcggatcgggtcaaatattaaaaatcgttgattttcggtcgagcgcgcatatattatagccgaacggtttattttggacagaaaagaataagttcgggtcagtgcggaccaggtcgaatattaaaaatcattgattttcagttgagcgcgcatatattatagcagaacgtttttattttttacagaaaagaataagttcgggtcagtctggaccgggtcgaatattgaaaattgtcgattttcgctcgagcgtgcatacattatagtcaaacggttttttttttgacaaataaaaagttaagtccacgaccgtccggaccgggtcaatttttaaaaactatagttttccggtcgatcgctcatatattattttgacatatattattttaggacatgattggtgtccgaacgtaatttcctagaacttagtctgtagttggacccactctagctttttttacacacaatttatccgtatcacctttaaaaaaatcaataaatcaaccgtgaatatctgaaacgattgggcctgtagttcaggagtcccaacacctgacgcatgcaatactttgtcaccctaatgattacgccgtcagtgccgccgtcattaaccataatattggatttcttccagacaaacgccgttgcggcgtcgccaggtggctttcttccagagaaacgccgttgcgacgaccagcgacacctccaccccggaaggatctacatgtggctttaactcaaggttagtcttctcttcatttttaactagatgattaccccgccgcgttactgtagaaaattaagttgcgtaatatatacaaataagatgtaatttgattatcaaaacaaaaacagtttgatacaattttgagattaaaaataattgagatggcatgtttttaagagagaaggaagaagagacaatttggaccatagatctatcatccaaaggttagaaataattaggggtgatgtggcttaatgagataagtgagaaattgcattaactacgtttagtggggatgaactatataactatgtatgattactcctagttaattaccatacttaatcacattgttggacggacttgtgtgtcattcgcgtgcatggaaatggatcaagttaaatgacgatgtactacatataaaccacaggaagtgtccaggaaacatcacctacttatttacttattatgctaattacattcacacaaattacacgaggtagatggttgttgtggctgtaattatttacaattcgtggcatgttgtacacaacaaactagaaattaaaccactgttaatatatgaccgaattaattctccagaaccagtccctgttctacgcttttgaattttcatagttagaaagtaaacccttggtcttattttagattttgaattttcgtagttgctgaagtaatggctcatcagcaaccgccatacttcatctcttaattaacattgtattaatgcatgcattactatttaaatgtttttaaatgatttaattattccaatcgcatcacagaatataatcctcgatgatacccaactatgagccgccaccgagaatgactaggaataatattcgagccaacaaaccggtgagcaactattctttcgacttaacgatcgctctctatgcaataatgaactaaattgtgatgtttattattgcagggaacacaagtatgctcacaagtagcctactggaaattcatacagactttggacaaagaacagctgcaagccagagatgatctaggttttgggggcttaacaaaaatgaatggagtccagattcgccggcttttctgcaagcaaattgctaggcaatatgacgagtagactagagctttcaatataaatggaaccatgctggagataaccattgaagatgtggatcacatactcggcgtgccatcggaaggtgctgaactggttgaagtcccacaagcaatccaagctgacgttgatgccccaaaggacaaagatgaaaacaaagctctacagacaacaaaggccgctttgtttgcattatataaagacaaaaggggaataagataactctgtcagccttgcaggattcattgaatttgaacaaatcttgtgacgatcactttaaaaggcagtttgtgctatatacaattggtctgatcctatgtcctacaactgagagatttgtccattcagattacctaaatctgctcataaatataccagatataaagagaaccaactaggctagcttaaccctaaaccatctcaagaggtctatcgtcagtttccagcatgataaggtcaatcttaagggcaaccaaattcttctactggtaggtgtaatttcaattcaagttatggtttaagtttgtatgatgtgactacaaaatttttttaaaaatttttcttgcagctttggtactgggagaagtttcgagtgagtcacatagatccttccaaagattacatcggacgtgtcagaccactgatacaatgctaggatgagaagaaggccagaaaacgtgaaaaaatcatgtatggagtaggataggtaattcgtgtgttgtaatttttgtacacataattaggacaatgtctagtattaacaatttgtacacatgttcgaacatagattgtgaatgatatcaagatccctatcgaggccaccaaagagtataccactgaagatcactctggaacagatgccaaccaaccaagtaacatggtacatactgaattgtttttctaaaaaattgaaagttgttttcttattatttttccacgtaggataatactaaggcacatacaacagaaatggcggatgtctagttgcagcttaaatcaatgaatgaacatttaatcatattaacaaaagaaattcaggtacgagttgtgaagtacaactatcagttatcatgaactaactattttaagttttaacatttgtgcatgctagtaaatcaataatgtttgaaggcaagaaaaacaaaccttaaggggtcgttgcaagtcgacacacctggtgttaggataagtccaacaaaaaacatggcatgacacaggcatcgtccccccaacaaaaggtatcaacaaatttctataataataagtaactctatacgatttacaaacttgttgttaccgaaaattgttcttcataacttgccgaagcaggccaagaagaaaaaagatacaagtaactcgcctattgcaccacgggtgcgaacaacaggaagggtcctcacatcaacgatacaattaaacactaactttgtgtacccagagaaccccaagaacaagcagaaggcaactccaaccccccccccaatacattccgaagttatgcctcgcacaaatgcttaaaaattttcctaacacagcattttatatttgtgactatgtaattaattgggtagtgattgcagagtttacatgcaccgaagaggatgagttcctcatcgactacattaacacttcaccgcatcaccgtgttatggtgagaatggaaggattgctccttacaagggaacaattgcaaccactgacaaatcggttcttgcccgatggtgaagctagatacgtcattgacgaagtaacatcctacttaccctctattgtatcattaaattatatttgttatgcatactaaattgttcaaaatgtagatcatcgatacatacatcatgcacctggaacataaataccttgaagagtcacaagctctcagaagagtatatatgatgaaaacgttcatcacaggtaaaatatcgattgactgcgtgcacgaaatctccaagcggcagtaggaaaagggatacatcttaagaattactaaccaaatttcccaaaacgaacaggtaaaactagaaatctccaagcggcagttggaaaagggatacatctcaagaattactaaccaaattgcccaaaacgaacaggtaaaactattttacttcagttaatgacaatttgttcggcataaaagaactaaacaaagcttgaaaatgcagatctttatccctattaatagaaataagaaccattggtacctggtggtggtccatgttaagcaacgtcagattcaactactggactcatcacctagcaccgataaacaagacacgaaactgacattagtggtgagcctataatgtcccgtaccgctttctatctataaataacatccttataatcttagttcatatttggatctcctgcatgatcaaaagctgataggaatggtaagatatttcgaaatatctggatacaatgaaagatctaaccaaaccattttggccgagattttgatttgtcgacttggcatgtgttcagtgtgacaagcatacccaggcagaaagatttgtatgttacccttcttggattaaatgcaattatctttcttacacaaataattgttatgttaaggaacatctttctataggtcttcatgtggcactacgccagatcctcacacctctgacgggatacctgtgacgggcaaacgaattggtcagtagtgaccattacctttgacgggttatacgggatgccgtcaccggtgaggcatctggccgcggcccgtcacaggtatcccctcacctgtgacgggccgaaaggaaaacccatcagaggtataccagtgacgagtttttcttccaacccgtcactggtatcccctcacctgtgacgggccgatacattagaagccgtcagaggtgatgggccgccacctgtgacggctttcatttctggcccgtcacaggtgagcggataccagtgacgggccgttgaatagaagcccgtcaaaggtatgagcaatacctttgacgggctttttttatctaacccgtttgaggtgtgttggctctataaatacccccaaactgccaactgctttccatcccgaccattgtactgttcacaaatcggttgggagggcaaggggggcgattttttgctaaaattcaaggtaaaaaacacattattctccatttattctcaacatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttggatcaggatgtagagaacaccgcagcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacagcaagttgtcatgcgtgttggaactcatgaagcttaaggctagtaatggctggtcggacaagagttttacagaactccttgagctgttaaaggatctgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctgccctatctgtggggcatcaagatacaaacgagcaaagagtgaaggtgaaggaagtaagtcaaagaggggaggcccagcaaaggtggtgtggtatctcccaattgcggagcgcatgaagagaatgtttgcgaacaaggaacaagctaagcttgtgcgctggcatgccgaagaacggaaagtcgatactatgctgaggcacccagcagattcagtacagtggaggacaatcgataggatttaccaggaattctcaaaagacccaagaaacatgcgtttcgcaatatgtacggacggcattaatccttttggtgatttgagcagtcgtcacagtacatggccagttctgattgttaactataaccttcctccctggttgtgtttcaaaagaaagtacattatgcttgccatgctcattcaaggaccgagacaacctggcaacgatatcgatgtgttccttgaaccgataatcgatgactttgaaaggctatggaatgagggcacacgaacatgggacgcatatgcacaagagtatttcaacctccatgcgatgctgttttgtaccatcaacgattatccggcccttggcaacctttctggccaaactgtgaaagggaaatgggcgtgttcggagtgtatggaggaaacaagaagcaaatggttgaagcattcacacaagacggtctacatgggtcacaggagatttctcccaaggtatcacccgtataggaatatgagaaagaatttcaatggacacagagatacagccggacccccgacagagctaacagggacaaaggtgcacaacttattgatgggaataaccaacgagtttggaaaaaagaggaaagttggaaagcgaaaagagaagagcacatcgaaggaaaaaatagaggagcatgtggaaaaacaaaagacaaaagagaggagcatgtggaaaaaaaagtcaatattttggagactaccatactggaaggatcttgaagttcgccactgcatagatttgatgcatgtcgagaagaatgtatgcgagagtttaatgggattactgcttaacccaggtactacaaaggatggtctcaacgcccgacgagatctggaagatatgggtgttcggtcggagctacatcccataaccacggaatccggcagggtttaccttcctccagcctgctacactctctcgaaagaagagaagattgatttgctaacatgtttgagtggtataaaggttccatctggttactcatcaagaatcagtaggctcgtttcactgcaagatcttaagttggttggaatgaagtcgcatgattaccacgttcttatcacacagctgttgcccgttgcaataaggaatattttgcctcctaaggtgcgacacacgatccagcggttctgttccttcttccatgcaatcggccagaagatcattgatcccgagggactagatgaactacaggcagaacttgtgagaaccctatgtcatcttgagatgtactttcctccaactttctttgacataatggaacatcttccggtgcaccttgtgaggcaaacaaagtgctgtggtccagcattcatgacgcagatgtatccttgcgaaaggtacctggggatccttaagggttatgtacggaaccgttcacaccccgaggggagtatcatcgagagttacaccaccgaagaggccatcgaattttgtgtggactacatgtcagaaacatcttcaattggattaccacgatctcatcacgaagggaggcttgacggtgttggtactgttggaagaaagactattaggttggatcggaaggtgtacgataaagctcatttcacggtactacagcatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgcctagtgaaacacttccgtggttgtcacagggtcctgaatggagtgccaccacctggcaaggatatgacataaatggat

SEQ ID NO: 88989 - DNA, 713 bp, Oryza sativa
ttcatctttgaaggatccgataatgccttatccgctctaggcgtccccagccgaagttcccttaggttcctcagaggccttatcaagacggcgtaaagggacattaggataggtttcaacgctaggtgtcttttgtggtaagggatctctgggtaaaacacttggcattattgtgtacctgatatcaactttgttgaagtagaggtaatgggagaatcgctacacctctggtcaagaaccaggtagtagtcgtaactcaaccactagaagtaaatgtacgagagatcgctacaattgactggttgagaaccagtgagtaggtgtctctcgatcatttgaagtcgtggtacgaggaccgctgtattattgctgtagtcgtacctcgactatctgaggttgcggtgcgagagattgctacgttctggttcgagaaccagcgagcgagtagaataatctctcgaacacccatggaggttgcggtgtgagagattgctacgtactggttcgagaaccagcgagcaagtagaatcatctctcgaacaccaatggaagtttgcgatgcgggagattgctacgtactggttcgagaaccagcgagcgagtagaatcatctctcgaacaacaatggagattgtggtacgggagattgctatgtactggttcgagaaccagcgagcgagtagaatcatctctcgaacaccaatggaggttgc

SEQ ID NO: 88990 - DNA, 602 bp, Oryza sativa
tcactggcgctttctacaatagtgctggcacataataaaaaagaaaattgtggatgtttttgcaagctttcacaacctcacaggggggaactttggaagcataaacagggccatgataacactgttgccgaagaaagactcgccacgctcggtgaatgatttcagacccattagtctgatccactctgtggcgaagcttatatccaaaactttggcaatgagactggcagcatggcttggtgatttggtctcgcatgcccaaagtgctttcatcaagaagagatgcatacaagatttacttcctctatgtgcgcaacatgatccggtccttgcacatgcaacggaaaccatccctcttcttcaagttggatataacaaaggcatttgattcgatatcttgggaataccttgtcgaaatgctgcagtggagaggctttagtcagcgctggagaaattggattgtgcttctcctatcgactgcatcatctagaatcttactcaatgggatagtgggagaaccaactacacacaggtgaggcctttggcagggtgatcccctctcgccctacctcttcatcctagcaattgacccgattcaacga

SEQ ID NO: 88991 - DNA, 523 bp, Oryza sativa
agggtttctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccacagatcgagtgcttagaacctcacctagcgcccccggccgaaccggcaaggggggcccgcgcggtctctcggtgaggagccccacgctccgtcaccggcgatcacgtacccgagcgcaaggtattcctccatcgcttggacagacaggccgcccctaatatctgcaatctaggagttgttgcagagagcggcagccactgtgatgtcactcagcttgacgaaggagaaaagaattgggaatctgtactgcactgatcctccgtctggcaacaagctatcgcaccaaaacgaggtagaggctccgttccccagcagtactttgctactagcggcaaagcagtgcagtgactttctgtcagctag

SEQ ID NO: 88992 - DNA, 1425 bp, Oryza sativa
cttcacactaaggacttcatgatcaatgatctgttccactttgtgtacttctactgactatttgcgtttaggtggcagacattgatcaagagcttgcaactgcaattttaacatctgaaatgagggaaaaacagctttctcctggtaattgctttgttttagataaaccactataccagtgtgccttttatggcttatccatggcagatcaacacaatttccagttttttttctccttttgacttatgaatgtgtatataacatagtgtggatggtagtaggcatatgtaatcatggatcgatgggctctctttctcctattttagaactaacaatattttcactatatcagcctatattgcatccagaaaattgtgtttgctacttagggctgctaggaaacttttttgggtgtaactaacatgcgttaacatttattctggatgattgttattctacagaaaaggttgttgctgccattgatccagagaaggttggcattcaccaaaggtacatataatgaatcgacaaaatcattacaagttagaactcaagattccatgatgatcctccaatgatccttgttaaaaaaatgttaaatagtaacagagtgaattatgggtatacgttgtgcaagtttgttcattatacaattgcatgatcataaacaatgaactaatagcagtttgtcaggcttcttactaattacttggtatcttgggatccatcaccactgtagagtgacctgaacattgatacgattgattgatgatcttgtctttccatgccagattattcgagtaaatgctgacaataatagttgtaaccaaggggggcctgtttggatcaattccattcctagtgttaccaatttttttgggcaatgacaagatttgtctattgccaaaaattttggcaagaatgagtgggttctaatttgtatgggcataagagtgatgccaaataatttggcaatggcagttctttaggttgcaaaccaaatgggtgacaaatttcttggtgttgccaattatttggcatggttgaattggggtataaatcaaacaggacctaagcgtattctaaatatatacgaaggaaacataatgaggctcaatgaaataacatattatgacttgaagctactgtatcatatgcgtattatattaggtagttcttaatcaaatatagttaccatttgcatgtttctttgaaagctctatgtgttctatgccttttgtactcttgctgaataaattcctcagcttttatgaaatctgaatatgctaagttttgcagatatttgcaatggttgattgaggaacaggaatgtgatgagcctcactatcacacgtcatatgcattgtccctctccagatctgccatggacgcagtccgtttgggatccaacaatgaagagagaaa

SEQ ID NO: 88993 - DNA, 2011 bp, Oryza sativa
  unsure (1)..(2011): unsure at all n locations
tttaacaccacgccggattgtatagcggaggtgtacccctatgttgttgttgccggggactccaaggtagatgtctacagaagaaagcccggcgcacatttgcaggctattcgtttcgcatggcctggtacaggtggactaattgtagcgagcgaggatgccggaattggcagcgacgtagttgtgattgctacggcttataaggtaacgtaggtatgtcaactcatccatcggtgcaacttgactcaaaatttccaatctgctctaccggattgcttagctactgagctgcgttctgtgtttgttagtaatactcaataattacaatttccaatgacaagacaatgattttgtatgctcaagtgaaaccctgacaatggattctctcataaatgtgcagcgccattttatcatgtcgattttgtatcacacactgtacttatggacacatttattggcttggccaggtattttgctaccgtaaagtatcagcggtggaacagatcaaggcactactacgaagaaagagttatgcagaagctatttctttgttacaagagttcgaggccgatggggaaatctcaaatgacatgatttcctttgtgcatgcacaacttggattcttgttgtttttcgacttgcgtttcgaggatgctgtaaatcatttcttgctctcggaaactatgcaaccagcagaaatatttccattcatcatgcgggaccctaatcgttggtcagatctggtatgcctcattaccacatgttaattgtaatgctgtatctcctcgttgatttctataaggcatattttgatttaaaaagtcaaacgttgtagattttgaccaaaaactagacaagttacaaataccagttcaaaatgttttcacacaattttggttctatttagaatatattttatgacaaaaaaaatccatgctcaaggtttaacactgtagactctttgaaatcaaaatacgccttgtaaaatccactggccactgggtataaataagacaactgttttaacacattccttgttttatgttttatcctgtaatgtgctcgaggagctgactaactgcacaacctttctcatgatactctcttaaccttttcttctgtatgtgaaaagttcatgttgaatgctgcaacttcttttatctctttaatgtggttttcaatggataagactttataatttcttgatatatgaacccgttcctcttgagtatcaacatgagctggttccttcaaatttgagcgtanagcttatattggtaggcacatctgttaagttttgatctgctagattaatttgtcaacatatttttgtaattgtcaaatggaatctgtagttttcatcacctaacatactgattaagttctcaagacaaactgctcatcttccactatgactggctgccttttgtattcagcagttttttatctgattgtgaactttgtaaattttaggtgccaagaaagcgttattggggcttgcatgctcccccaaagcctcttgaagaagttattgatgatgggctagtaacacttcaacaggcattgtttctcaaaaaggcaggtgtggacacagttgtggatgatgatttcctttcaaatccaccaagcagagctgatctgctggaagtagcaatcagaaatattatcaggtttgctcattcacgacattttttattcattacgaattgcaaataagctgctccatccagctgatgtctgaatgctatatgaaactaggtacctgtgtgcatcccgagagaaggatttatcttcttcagagatggaaggggttgatactcttctgatgtatctttatagagctctcaatcttgttgatgacatggagaagcttgcatcatctcagaatagctgtgttgtggtatgtaaatcctttaaacatctgcaaccttgaagcgtttaagactgttacacacctacgatacttaaatcgacattaactcttcatttgagaacagtacataactacata

SEQ ID NO: 88994 - DNA, 1200 bp, Oryza sativa
  unsure (1)..(1200): unsure at all n locations
cacctattgtgggggcctttggaatgggtggctgttaccattggccatatttgcgatgcattattatgcccaccatcaacgatgaatagatgatgcatggtgcctctgtcctttcaactttggttgccttttcaccagttatattgcacaatttggttcagtgattgtttcttgccctgtgattgtcccacatggcctgattagctgactgaaatagtttatttcacaacccgcccttttgacataggtgcacatgaaatttccttgttcccttgtgatcgtctgatctcttctttgtagttgcctcctctttgtgtaaagggggaaaaacacttgttttcagtattttgcatcctctggtatcaatatagtactggccacatttttccaatattgccatattggtatagactttttttggtgactatgtgtttccctgtggtgggcttctgtattttgattcagcaacgtagatctgcattcaagttgtacaaacatcatagctaatcagttattgagcctgataacattatttgttcacttttcatgctatgccttaatacaatatgggtacggtttgcactgttaattcctgccgtttgggagttgacatggtttaatttgtgtctgctggatataggtaatgcacatggtttgggagttgaagccttgcgaatgctcatgcaaatggtcctcaccaatgaggaagagcttaaactgaaatatttcaaagatgatctatccaccaaactttgccctgtggaagcttttctaaaggcagtgctggatattccatttgcgttcaagagaatggatgctatgctctatgttgccaacttctatttggaggtcaatcagctcagaatgtcatatgctactcttgaggtatagttgagcccttggttgaatatttttgacaaattgttttgcaccctttgttgaaagaagcaaaacataactttcatatgcaattgggtattatgcatatcaatatttacacanatgatttgaatctgtgaacggaatagaccctcacttacttgttccttgtttatagtattactcatctctgagggtttcttatcgtttttcatacaggcagcttgccaggagctgaaaaacagcaggttgttccacaaggtccttgaggctgttttgaactttggcaacttgatgagtatcgatacaggatctccgaat

SEQ ID NO: 88995 - DNA, 555 bp, Oryza sativa
ggtctgcacccattgcataatgaaattgttttaatattcagcaattcttctgaaacagtctggactacagtaaagtagggcacataattaattttgtaaacaagaaaaggaagttgattttcttacctcaattatcacatgcatgtcgaattctttggtgtccagaccaatcccttcatagaatgtagtacgttggcaatcatttaggtacatggtcacatacacctgcaaaggatcacacacaaaaactgttagaagaggagcacagtaacaatcttcagtgtgaactgttggtccatgccaaccacggaatagcttggaagataaccgaaaggcataagaaccgtgaccagagcttggccttccagtcgttgaggaactgcggctgcgccttgatcagcgcggagaagaaatcaccgtgacggttctcatcctggcaccagttctcaaagtacttgaagatggggtacacctggtactccgggttcgccttgaggtgcctgaagatgtgatgtacctcagtaccctaatcttctccgacaggtaggtcgcgta

SEQ ID NO: 88996 - DNA, 560 bp, Oryza sativa
tgtttttactactaaagaaaaggccttaattaattattgcgcaataaaaccccagggctgacgtcatcaagggagggggcgcggcgccggcaagcgggccccgcctgtcagcggcacgaggcggctggtccaccatggaccgggaccacgcgggtggtccaccgccggtccacgggaccgactgtccagatcggccgggaggccgatcggacggcgcgggcggtggcttggcatggctcggctcggcacaaaaccgaccggccggccttggggagcggcggcggcgagcggccgccggcgacggcaagcggcgccgcgggaggcggcggcaaccggcgcaaaagcggcggcgcacggccgaagacgacgacgcacgcgcggatcacagcggtgctcatgggagagaaagaggaaaggaaggaggagagcgggattcctcactggcgagaacggcggccggcgcgaaggaagaaggcggcggcgacaaccggcgatgcggaggcgcggacgggcggcggtggcaccctaggagggagcagagatgggttaggggtggggta

SEQ ID NO: 88997 - DNA, 547 bp, Oryza sativa
ggccccctgccgccggcgctcttcagcaagctcaacaccacgcagcagggcggcgcctacctgaggctgtcgcggaacaacctcaccggcggcatcccggccgagtacggcggcgtggcgttcgaggtgatggacctgtcgcgcaacgcgctgagcttcgacatgaccgggctgcggctgcaggaaggggtgagctcgctggacctcagccacaacatgctgtacggcggcgtgccggcgcaggtggccgggctgagcagcctgcaggacttcaacgtcagctacaaccgcctctgcggcgagctgcccgccggcgccgcgaggttcgatcagtactccttcttccacaacaagtgcctctgcggaccgccgctccctactccctgcaattaagctcccattacttaattactagctatgtggtgaaattatacatcagcaatgcaagcaaaataaataaataaatatatatatatatatatatatatatatatatatttgtataatgattttaataagtcaaaaacagattgatgcatttggaagg

SEQ ID NO: 88998 - DNA, 772 bp, Oryza sativa
aaaaaaaaacatgagctttctactcacctgggtgtattccagactcacaagctttgattcctgcatgatacaagatacaaaaaatgtacacgagtaatattcagtaaataaggtagaaatctggatattcagtaaataaggtagaatctgttccggtacgaggcacataccagactccgaactacaaggttaactgattgtaaatcctcttggaaagcactcagatccccatggatgactgtgacctacaagtcagtcatgaaatgccattaggtcgccgaaaatgcatcaaaaactataaaagtaaacacaaaaaataaaaggaaaaacagttccaacctcatcccttgtcccttcaataatttcttgtgtttcatctaaactgatatccacacgatcaatccttccagcgagatgtttccttgcagactgaatagtgaaaatcaaaggccagtaagatgttttggttggaacaatgaaaacatggaatcacaagtaacacatttgagttcagcgttgctgaaagaagttaaaaacttacagtgacatcatctgaaaccttgtccaattggctgccaactacattgcaagcatcagataagccacgcttcgtgacaaacatcaaatcagaaagtttccagccctgcaaatctatgtaactttagaaactagctagaacagtgaaacaagaaatggcaagcagataggattgtaataatatgcacttgcgtccatgatctagaatgacggacagaacaataaacatcaagat

SEQ ID NO: 88999 - DNA, 883 bp, Oryza sativa
ggagagaaggcactgcccctatttaagctcctcaaacgctccgggccgtttacctggacggaggaggctgagcgggccctcactcagttgaaggcgtacctcagttctcccccagtcctggtcgccccggagccagatgagccgttgctactctacctggcggcaaccccgcatggggtcagcgcggcgttggtcgtggagcgcaacgaggacaaccctcactccgtgcatccccaccctgcgtcgactcgacccgggagagagcaggcaggagaggcccccgagccgaatggcggcccgaggcccccgacggccggagctggccctccgcctgcttgtccgacggtgccaggcgcccccgacccccaggatggccccggggccactgcgggaaggccgcgcctgtcgccctctgaccccgaggtcgtcggcacagaagccgagtgcgccccgcgtggcctctcggacgaagaacgccctggagatgcggcccctggcgaagaggatcggccccgccgaaaggtgcagcggcccgtctacttcgttagtgaggccctccgggacaccaagacccgataccctcaggcccagaagatgctttacgctattctgatggcttcgaggaagttgcgccattatttccaggcgcatcgggtcacggtggtcacgtcttaccccctcggccaaatcttgcataaccgagagggtactggacgggtggtgaaatgggcaatcgaactctctgaattcgatttgcgctttgaaccacgccacgcgatcaagagccaggccctcgccgactttgtggcggagtggaccccagcccctgagcccatctccgtccccgaggccagctcgggcccctcgcagctgcctcacaccg

SEQ ID NO: 89000 - DNA, 2906 bp, Oryza sativa
attgcacaagaaattaaaaatacaatgcttgcagttagtttagattcaacaatgggaggcactagggatgtaataatagagtttgtgagaggcagcaaacttgaagagaaaacaaaaggctggctgtcaggattataaattgcaaatagtccgattcatatacatgtatgaacttgtgcatgctattttgactatttgcttacacgatattacaaacaattgtggaagtgctaactaacaccccagaggtattgacctgttgccatgactgcaaacgcactctcatgactaagccccccaaagtagtaattaagcaaatgcgtccccatgactatatggctgagcgctagaacagcgcttagaaatctatcctataaaaccttgaacgtagccttttgaggccgtgggcattagttacatggtaaatgaatggtaacctaacaacttcacatgggtggacactgtaatcatgattcttaaatagcttaaagataggtaaacaaacttaccattttctttgtgtcatatcgagcaacaaagccaactcctgattttctttgttgcccaagccagaaagcttcagttcccaaggagaggttcttagttacactctgaaacacacaaaaatattagtttaatatatatgttagaataaaaacatattctcggcaactcaattcatgcagttaaatcaggcattttcttttggatcatgaccctaacaaaaaaagtgaaccgtttaatcacttttatcctccagtttaatcaacagaatcacatggcaaacaccacaaagttacttaagagatttctggagttatattcttatgcttattgtacaaagaagctaccacggcacattgtttttgaaatatgtttgtcttcttagcattattacttcctctctcccagtttagtgggcgtattttttttttggttgttgttgatgtaccaaaacacaggacacactggggctttcagccaagagtgctctgctacatgcatgcatgcaagcaaggaggtgctggccacataattggtgcatgcagtgtggcgccattttaattggcttatccgtttcatgcatgaggaaacggagcgcttcaatttactagaatttggtggcttggtgctttgtttacatgcattgtctgcttaataggggcagatcaggaagaaaatatattgcatgcaagggccttagcgaaatattttacacaccctgtaaatggggacagagggagtacttcgtctaggtaaattttaagttgagaaaaggaaaagggaaaaaaagctgtctagtcattacatcatattaacaagaactgtcttcatagcagctgtctatgcacttacacaagaatctaaaatgtagaaaatcctcaaagggcatggttattatatgcaaacacataaacacatacctggatgtagttccctccatagaaggcattattcccaagttggaactgtgatctaaaatctttgccctgcaatcaaagatataaaagcaacacaagttataaaataaagtacaccttcagatataattgataggaagaaactaaataaaagatatatctatctggaatacactatatctcaaatacacccctttacacttgcgagaaatttaaacaggaaacaacacaaagtttcatggaaagaaaaagtttcttgcattggccattcccagtagtattcttcagaactagatattatggaaaaggaaggggtaaaactgggaggaaagggaacaaaagaaaactacggaaattatgtgttgttgagaactcctaagaaatgcatcactacatcaacaaacacgtctatcaaattaacaaactagtaaaaattaggggcacgtttcagagtgtgcattccatcttcacattcttgatgttttcgattgaaattaaagatacatgacaataggaatttatttggaatgcaaagtaattgtaggaaacagactgaaaatgagctataacgcatttcattaaatcagccataactttcctttgaaactaaattgttcagcatctgctaagaaagagtcatctgttaatgattcatgagatgcattatgaaaatactacgaaagtttcgatgccatctcttttcttaaaatcgttcggcaagataacaggctttatgttgtcctaagtggaaatttaaaagatgccagaaaaaacaatcatatcttccattattccatcattttaataaaaaaaatagcaacaatataggacacactttcattaagtgagaaggattctataccaaaacacagtagcttgttgaagaaaagaaaaaaaaatgtatcgctggaatgacattgccatcaaataaatttaccaaactaggaaaacccatcatcacaaatccaaatgtacacaaagactgaccttataatcaaagctaaacatgccttgggagtaatggggctcgttcgtcaactgccaggatacatacaaggtaagctaattagtaagtacaaaaggatggtgttaattagcgctaatctcatattgaacacagtttggctcatatggttccaaacaaaaaacctgagcatttatcttgaggcaaagattttccaatagatcgcacttaacgcgcgcggtcaccctcccgtcgtgcgaaaccctcccaatgagcatcatctggcaaatgaaccacactcggatcaacactgaaaccaaccatattagaacaccaagcatgaaccccttcacagaagaaaagcattgcaaaccttgggatccataaagtttgcgccgaactcgtagttggaggtggggaccttgatcacatccgccccctgcgatgggagctccatggatcccatggacacactgaggcgcacaaggattgtcacgatacagccaaaaccgctagtaata

SEQ ID NO: 89001 - DNA, 654 bp, Oryza sativa
  unsure (1)..(654): unsure at all n locations
ggctcgtcagccggctcgaacagcgcncgcgggcaccgggccgaccggccagcagcgacggcagcacaacgcgggcaaggggagaagcggagaaggggaaaaagaanagccgaaggaagncgncggcgctccggtgactgacggcgacgacagagggacggccgaggatcaggacgacctaggaaaggtggtggcacggccgggcgaaacccctctcgcacgcggggagcggctgaaggcagccaaaggcggctgtggcttgggagcgcgagggagaaggcgtttaggcggtgggttggaggagcaaagcagcccccggggtggagcttgatgcagcgaagtcgacagcgcaaaaagagcggtgaggcgtggtgatggctagcgcggcggcaacggccggccggaggcaacatatggtagtggcggcttgggttggcggtggaagcagcgttcgggcggtggaatgaaagaggggcgcgtcggttgttctgcaacgtgaagtggcggagctggtggtgcaggtggcgtagggcggcggcggctctagcggcggcggcgcgcggccagagctcgtcggttagcggcggagcacgggctcggcgtggggagaacgggagggggcgcagggagctcggggagaatagggaaaaatgg

SEQ ID NO: 89002 - DNA, 587 bp, Oryza sativa
ttatgtttgcagatcagttagttgcccgatcccatgaggcatgctaacatgaacatttcctggttccttttggacatcaaggtgccgcagctttgtcaaattcattgtgctttccggtaactcaatgagacagcaacaatacttgagttctaatgtctgaagggtttgtaactgacctatttcagctgggagactttggatctttgtattgttcagagccaagaattgcaagagtttcatcttcataatagaactggggagctctcgtattgttgtacagctcaaattcaacgctcttaaaaatctacatttcatgagaagatcattcagacccagtattttcaaaagtggcacaaatgaacctgggtactctgatgcagatctcttgacaaccatcagggactgcagatgtctttgtactttagtcagcacaactgacttggaatctggaagaacaactgaaaggtggcaaatattttctggaaggctgcaaaatgcttcccctgaactgaagcattcatcctttgagacggagcacgcccaatcatgaaataactcatgcataacaaacttatccttatgatcat

SEQ ID NO: 89003 - DNA, 581 bp, Oryza sativa
ttcagcagcaagtcccaatcgaatccggccgaggcggcgccccctccgcccggaggcggccggcgccaggtaccacctccgcgtctgtggccgtagccgtagccgtagtcatacgaggccgacgaggaggaggccgaggccgaggcggaggcggaggcggaggaggaggcgcggctgtagaaggaggacgagcggatgcggaggtcgtactcggcgcggagtcggtcgtcggagaggaccctgtaggcgtcggaggcgaggcggaagcggcgcgcggcgtcggcgcgcgcggccgcgtcgggggagtgggcgtggcggtccgggtggtcgcggagcgcgcggcggcggaaggcggccttcacctcggccttggtggcgtcctgccgcagccccagcgtctggtagtggtcgccgcccatcgccaccggcggcgacgaccgcggcagcttggagaggatctcgccggccggtggatcacgaaatttctcggcgagggagaaggggaaggaggaggcgatggagcgcgacgacggttgcgtggcgtggcgtggcctttcttcccgaagcgcgtttcctcgggc

SEQ ID NO: 89004 - DNA, 578 bp, Oryza sativa
cagagttcgggcttttctccaaacttcttgggctgttctggctgagcaggcagagctggctgaaatgactgagctggaatcattagaagacttggagtagggttgaggctgtgctgctcactgttgtagttcttgttgaagctacccgggtggtagggacggtgctgccggataatcattgtggaaggtccaccctgatgtcccatcgtgaagcaaggcttctgactgatcccctgggaagttctgagctgagctgccttcctcttacggttcattttgttgcactgctcttcctgacggatagctttgtccaccagcttctcaaagtcctcataatctctgcagatcaactggttggtcaattcgtcatcaagaccagacaaaaacttctcctgcctctcggcatcagtgcgcacgtcctcaggggcataacgcgcgagacggttgaactcatgcaaatactctataactgctctgggtccttggtgcggagaacggaactctctcttcttttgtgccacgattccctcaggaacttgggctttattgaaactctgacaaaactctgaccaggtaac

SEQ ID NO: 89005 - DNA, 736 bp, Oryza sativa
ctatagggcgaattcgagctctgtaccccgaacaaggagatcctggagcacgaccggaagcggcaggtggagctgcggctgctcctgctgagggacgcgctcgaggagcaggggtacacggagggggagatcgaggagcgcgtcgaggaggcgcgcaaggaggccgagatcgaggccgcggcggccgcggccgccgaggaggaaggacgcggcgcggggcggcagccactcccgggcaaaggattggtttgtgaaaattgagtgtttttagatggttttcatacggagttgaccaaatttgtcagattttacccgtttttgcttagtttttggtaaaccgaaagtggttttcaccttgaaaatggaaatgtgaaccctggtgtgcacaagatttgcgcttcattggctcaagaatggccataattactattgtactcagttttggtcatgacctaaaccatggattaagttgtccagatagttcccatgtttttctgggccagttcgcaatggctatgacagaaagaaaggaaaacaagagacagcactaactaaaacttctgtcttacaaaatcatgtatgatttttttgaccggaaaacattaggggaggctatttgactttattactctaggtctacaaaattctgtaaattagtttctggtactgaatatggaaattctttgaataataaacaaccgcaaatctggtacttaaagatattttttattaccat

SEQ ID NO: 89006 - DNA, 690 bp, Oryza sativa
gcctgctgtttgttgccccagaggaggacaacatggagacgatcgtcgcgcagatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgctt

SEQ ID NO: 89007 - DNA, 1612 bp, Oryza sativa
gacaggttatttcgtagctactgtcatttccagttctgtcatcattattatttacttttggattgattcagatgcaagaaatgtactgaaaagtaaggagatcaatatgtataccttttgcatcttcacagcagtgtcctcgttcgcaaactgtggcttcacgccactaaatagtaacatgcaacccttcagaaagaactgggtccttttgctcctagtgatcccgcagattctagcaggcaacaccttgttttcaccactcttgcggctatgcgtatgggttttggggaaggtcagtggaaaagcagagtatgcttacatccttcagcatcctggggagactggctacaaacatttgcatgtgaggagaaattctgtttacattgttctgagtgttactggactgattctactgcaagtaatgtttatttgctcgtttgagtggaactcagagagcttagagggaatgaattggttacagaaattggtaggattattattccagagtgttaatacaagacaagccggtgaatctatccttgatatatcaacactttctccatcaactctgttgctatttgcagtcgtcatgttagtatctcctccaaaccctgtcttctaatgaatttaactaaatcagtagaacacttagattagttattacaggaacataacaaattatcaggagaaactgttggaaaatttgatagcttcatcatttataactttgaagattactaaacacatgcattcatgaccactgcagcttgctaggttttatcgattttatacgtcaccgaaatagtagttatgaacttcaaatctgcatctaaataactactgttgaatagagaaagtgagactactttgaacaaataggacagaacttctgacaagggtttaaatgaaaagtaggcagcatacaacatgttttatgtggaacagcatgtttcctactccttgttaacagataatcaacttgcttgcaggtaccttccttccgatgcttcatttctcactgccaatgctgataaccagcccttgacagataaaaagacaaactcgattagcagagcactgtggaggaattttaccgttaacaagctttcttgtttagcaatgttcacattcctggcatgcataacagaaaggaagtcaatttcttctgatccactaaatttcaacatcttcagcatagtttttgagataatcaggcaagttcacatccttttttttttgtctgcccataacagaaactatggctacatcaaaattacatcactgaaaatccgaattgcctagtatgatcactaagaaccactgaaccagcataattaaatttgcaagaacatatcaaatctacgacctgtcatttttttttcttttttggttgcttacaagcaaacagaaataacgccattttatttccacagcgctttcggcaatgtaggctactcactaggatacagttgccagaagttgttgaagcctgatgccacttgcaaagatgcttcctacgggttcgtcggcaggtggaccgaggagggtaagctgatagttatcctggtgatgttcctggggaggctcaaggagttcatcctgaaatgaggag

SEQ ID NO: 89008 - DNA, 686 bp, Oryza sativa
ctactggaggcaccacttcccgatggcaaaacggatccccagctggccggagccggtggcacagcgatcgtgtccaccagcagcggtgccgcctcatcgatgcatctcaccctggtcttcaatggtgtctttggtgccgaggagtacgccgatgcagcactgagtgtgaaaattgagctggcagaacggaaggaggtgatcttcgatgagattccacgtgtgcgcaaaccctctgccgagatcaatgtcctggagctgtcgtcgcccatttccatacagaatcttcgactgatgtcgcgtggcaaactcctgctgaccgtggagtccaagaagtacccacatctgcgcatccagggacacatcgtgacccgagccagctgcgaaatcttccaaccctgctggcgccgcacagtgccgaatcctcgaccaagagcagcggtttggcgtgggtctacttgaacaccgatggatctctggcctacaacatcgaaacggagcacgtgaacacccgggataggcccaacatcagtttgattgaggagcagggcaagcggaaggccaagctggaggatctgacgccgagcttcaacttcaaccaggccattggtagtgtggagaagttgggtcccaaggtcctcgagtcgctgtatgccggcgaactgggcgttaatgtggccaccgagcat

SEQ ID NO: 89009 - DNA, 705 bp, Oryza sativa
ttcctgcagccctgctgctagttgttgttcacagattctttggcttttatctactttgaaagattatggtcttacttttgaaaaagtacctctcttttgtgataatactagtgctatcaatattgctaagaatcctgttcaacactcacgcacaaagcacattgatattcgttttcactttttgagggatcatgttgagaaaggagatgttgagttgcagtttttggacaccaagttgcaaattgctgatattttcactaaacctttggattctaatctctttgcttttcttcgtggtgaattgggcataattcatccttttggcatggtttgagggggagtttgcacctcatggttttatcaagcaataatatgacaatgaaaaaaattgagaaaagagagctttgtttatgtatatggtattttcttgtgcatgctagcaatactttgaaggtttatttgtctctagcatagcttgtatgtattctagtcttttcatgagatttagattttgcttttaagggagatgatgcatgacacttaaattctatacttgaattaagaaaatatgcaatgttgatgctagcatatggtttgatttataaatgctctatatatatgctttattgacttgttattcctcaaatacctttaattgctcattgtgaaaaagagaataaaaaatataaaaaaatgaataccgaa

SEQ ID NO: 89010 - DNA, 6349 bp, Oryza sativa
ctaccttttctgaatatacatcaatcagaacatattgtctccattcaaatgataatttctacacgctgactcactcacattatccatcctgtcataaaaaaatatgcttatatataacactggtaatcctctggtttgttttacagatttcactccaatctggtcaattcgaaggtgtgatacgattcaggtatgtttgcggttgcaccatgttttggtgttcttggttaacatcaaatagcatagccagctgattcatccatgcgcaactttgacaaaatgcactttttttttcaaatctctgttagccttttttttttttccaatagacgtgctgcctcacctatttctcattgttctgttcaccctttttgttatagctgtgtttccatcactaaatcctcgctttgttaaattagacgacactcgtttacgtgtttcaccacttcaacagagttgatgacttgcaaaagcccattgaaaacccagaaaacataaactgggagagctatgcaagaggtgctgtttatgccctgcaaaattttggatatgatctcaagaaggtgacttttacatttaataattcaaagtccagaatatcttatgctttaaataatattgacagatgacttcttgtagggtattataggatatatttctggtgtgaaaggacttgacagttcagggctcagttcatctgcagcagtaagctaactgatatgtcatgtatatttgagttaaaattgctggcacaatcatctgtaatatgtagaaaactggaaatatgagtttagtgccaacctagttgtgaatcgaatatgcagtatttcataatcatgacatatacttggctcacatttgacttggagttcaaagcaaatttgtgaagctactaactttgtactagtatcttctaaaccttcagctcaccataacaaggacagaaacttccagttcttactctaggttctcaaaagaattattaatataattgatactttggttagttatgtgatcatcaaatgcctatttctgtatgctcctcatcaggtcgggattgcctatttgatggctttagaaaatgtgaatgatctggttgtatcaccagtggacaacattcagttggacaagtgagtttgtttccttttagtaagcattccatgtggactaacattatgaattcatacatgggatccagaacagttctaatttcaagtatctatgttgaagtccccacaactatctactattgccatgttctaaagcaacaatcaaatattgctacataagatttattagctcattgagtcatggtcactagcagagttcttaatttcatatccctatttgtcaggtccatcgaaaataaatatttgggtcttgaaaatggtattctggatccatcagctattttgctctcacggtatggctatctcaccttcatggactgcaaggtagtactttcccttgtattttctgaaagtctactattttagtaatatattcagtatgacttctgttttttcaaagttttgagactggtatatcattttttctgtaaaaaaggcttttttttattcacacaagttcattttttatgatattgcattgggtccatataattatttcaatccttctcgacaattctttctttgttttgtggtttcattgcgcatagttttagaaaatgtgcacttcaatgctctctgttagcatttatagtgactgagactctctttgcttgagtagaccgccacacattcctacgtctacttctcagtgttgagtaaaagtcagcaatgtcaaggagaactaccattcaagattttgttagccttttcagggctgcaacataacctaccgaagaagagtggatataatacgcgagtttttgagtgcaaagaggctgcccgtgctcttttatggtgagctttgtttgagtataacaaattctgtcaggcaaatatgcatcttgttcagtttgcagattcgtctatgatggatgttggcagattttttgttcagaacatacccaatttcaattatcattttgttgtttgaattcccagtgcttcaggctgtgaagatgcatcaagtattcttcgtaatggtaaactatttatatgtactttttgttatgaccaactctaaaatttaaggttgataccattttgttttcttctaacacagttaacccagccatatacgaggctcagaaggttgtcatttgaattctctctcttaaaatattttcttacttgtaccatattttgaatctgaatacattccatcacactcttttcttgcagtgtatattagaagaaaatctcgctaggagagctgagcactacttctctgagatgaagcgagttgtcaagggtgagcacaaccaaatatttttccgtgcgctcttttagtatttggtccactcatttaaatttctactcgatgcatatgtactttcatgaacacaaatagcaaattacgtaataattagcgattgtactacttgctgtagaccttacatcatgaagaactatatttgcacacttctgctacctctattgtctccatagatgaactgcctttactactaaaatttggcattcgttgtgacttaacttaaagccatatatgcaaaagaaagaggcaagattatgatattctttcttgtgttccaatacgcacgaggaatcaacatattgagttgtcatcttaggaatcaaaatgcttagtagagtacatatattcttcgaacctgcatctttaccaaatttgaactgaaagtgcaatgacatattatagtataacaatatccggatactctgtgttcaggaagagatgcgtgggctcgtggagatcttcgtgagtttggccagctgatctctgcatctggtcgcagctccatactgaactatgaatgcggtatgtcgatcgcacgttagacatctgagataataaccatcactaaaaactcaatggctgcttgctctcacaaattggcagggagcaaggagatgatccagctgtacgagatcctcctcaaggcacccggcgtcctcggcgcgcggttcagcggcgccggcttcagaggctgctgcctcgccgtcgtggagagcggccacgcggaggcggcggcggcgttcgtccgggccgagtacgagaaggcgcagccggagctggtgagcaagatcccgccgggccgccgcgtgctggtctgcgagcccggtgacggcgcccgcgtcatatagctcaccgcccaccgccgttctgccggtctcgccggagcagcctcgcattgccgtgcccggcgcgccgcgaaggcggtggcgtcgtggcgacgccggcgtgcaaggatggacggtggtcgcttgggcctcggcgcggcgagctcccccggtttacgcgtacggagcttggctagttccagttgagacttgagagtgggtgtaatggtaatggtataggtacgaactgtccgtgtgtatacgggtacagactacagagtgccagcttttgtccgtgtatgtgtagaaccaattgatgatcaatttttgataaatatctcagcaataagcagcgacgtagatatgtactattacatgatgactacgattgcattgcaccgatgatgaaaaggcgttatcgttcttgccactaatttgatggtgcacttgttatttttcagtccatatttctttcgcgaggattttttttcagttggtattcccaaacatgttccatggtcagaacgtaataagcagagaaaaaattgatagcgcataagcccaacgtgagatgatagcgcataagcttagcccaccaatgttacaagcaaagggttagaaatctggaatagaggggctgagacatggtagtttggaaacataggaaaagtccaacttatgtttcttaactactccctccgttccccgttacagaatataaagatttttaaggttgaacacatgtattaataaaatagatagaattaaatagaagaatgttgtgattggttgaaaagtggaggtaggtgagaaaattaaatgatggaggattgtgatttattaagaagagaacgttgatgaacaagttgttatattttaggataaaccttgagggctaaaagttgtgaaggagcatgaaactaaggtataacacggaataaaatttgaaaatatctatttttttataaaaaaattacgtttacatacgctagagtgaagaatttgtgaaaatatccctaatccgcgggtcggttccgcgggagcgcaactaaagcacgaggtggcggcgccgagcagacggccgaggcgctcgcgcggaacgaggctgcgggaccagagccgggaacgcggaaccggctcacttccgcagcgctggcgtgcggaaccgtggcaccagcatatttttactacgtgacactgtacccgacactgtttcggtactgttttacacaattccagtctccgttccgcacaatggagacgcggcaccagcgcatgaacagttccaaacagcccttgaacagtatcaaaacggtgtacaaacagtactacgcagtgccgaaatggctggccaccgcggttctgcgttttggcgccacgggaccgtcgcggttccacgttttggagctgcgggaacttgatggtctcgcggtcgtcccacgggatcgtcgctcccgtgttttgaatctgcggaaccgccgtggtcccgcatttttatttcgcgggacgggtatatttttgcacaatcttttcattcatgtatataaatataaattattgaaaaaaataagtatatttgcaaatttttttcgtataacacattccttatattttaaaatcagtacaaatgtagtactaacgaggtaatgatatgactggtagagatttgaccaaccacgtgtactcctaactcctagttggcactaaaaaaagagagaaatgaaaaaaaaaatgagtagagggatggagagctcaccgttgggagcgccggcctgcaatagtgtatttgatgtatcgcaatctatgtactatgtgttaattttatcataaaaccacgctaatgatctaaactcgaaagtcatcgttttgcgatatcttgccttaaatattttgtttcatgataaatttggttataaatttatagttccatgatacactttctcaagttttttttcacaacggttttgtataagttttttgggaatatggaaggaccgcatcttcgtattaagggggaaaaaaactttatttacatctaaaattcaataagtgaagaagacgggatacagaaatacagagatcacttaaaatctattctccggtccattgttgcgacctttcctctgtggattgtaacacaaactctggaacagccgatctggctaaccgctagagctctgccttagcggccattgcccttaccacctccacctaggttttctgctgctgattgaagactctattgtttctctccttccaacgtccatgtgactagaggtttaatataagtatttgtagttttgtaaaatttatttaaaattttacgtctaagttctgctaatttgtgctaaccaaccaatcagcactgctaatcaaatgcagcattattctagagcaatgattgcattaacgaagggagtctaagcaaggcaggttatcagagctgatcgatcggttggttagcacatgttggtgtaaatatgtattgtaccaaggacctatctgtaaagtgttatgctaatagaatagatgaggaaggggtgagctgagtaggctaaccctagaaaaattccccaaattgaataatatggtatcagagcgggtcgccggcgactggggaggttgaaccctagctggcgaggtcgcagcggcgcggcgcagcggcgcgggcgaggagaggttggcgcggcgcgacgacgcacgcgcgaggccagcgtggccgcacgcggcggagacggttggtggccgcggcaggaagcggcgctgtgccggcgcaggacgacagcgctgctaaggcgggacgtggagtgaggaagcgacggtgtcgacggcagggagcaccaacggcgacgacgcgtgcagagggctagctggtgacggcgtgtggcagaggagcaggttgttgctgctgctggtgaggtgttggtgctgctgctacttgagaaggtgaagtgggcgcttggcttgctgttgctgctgtatttgctgctgctgtgctgatttggggaagaaactgagtacttgctgctgtgctgaaaactgagaagtagtgctattgctgctgttctgttttggtgagaaactgaggagtagtgttgttgctcctattagttgatttggct

SEQ ID NO: 89011 - DNA, 2684 bp, Oryza sativa
cagaagaacaagaccaatgagagctctaacaccaccactcactttggtaacttcgccaactacgcccaagtgggcgaaggtactcaggcacaggcacttgcatctacatatagacatcctatagattggatcatagactcaggagcatcaaagcatgtcacaggattgcataatactttcacatcatacaccccttatatccactctaaaactatccaaatcgctgatggtacatccaagcctattcatggtatagggtcggtagagtgcacatcatcaatgaacttgtcttctgttctgcatgttccttcctttccagttaaccttctctcagttagctcggctattgatcaactcaagtgcattgttgtatttgatgagaagtcttgtctgttccaggagaaggggactaggaggaggattgggactggagtcaggcgtgatgggttgtggtacatcaatcatgaggaactgggactagctgcggtggttggagatgttgagaaggagatcagtttgcttcactgtcagttaggacatccatcttttgagattttgagtaagttgtatccagacctctttagtagagtggataagcatagattggtgtgtgatgcttgtgagcttggcaaacatactcgctctacatatgttggaattggtcttcgtaactgtgagcccttcatattaatacattctgatgtttggggaccatgcccagttacttctgtgagtggtttcaagtggtttgtcacctttattgattgtcacactcgtatgacttggatttatatgcttaaacacaaaagtgaggtccttcgttgcttccaagactttcataaattagtgacaactcagtttgatgcaaaagttaagattattcggactgataatggaacagaatatatcaataatgaatttgtgtcatatgtctcagatgaggggattattcaccagactacttgtcctggcacccctcctcaaaatggtgtagctgagagaaagaatcggcatttgctagaagtggcaagatctctgatgttccagatgaatgtaccaaagtatctatggagtgaggctgtgatgacagcagcatatcttatcaatcgcatgccttccagaatacttggtatgaagtctcctgccgaactgttattgggtaagcgagagttcaaggttcctccaaaggtgtttggctgtgtttgttttgtgcgagatcaccgaccttctgttggcaagttagatcctcatgcagtaaagtgtgtgtttgttggctatgcttcgagtcagaaggggtataaatgttgggatcccattgagagaagactgtttgtgagtatggatgtgacatttcgtgagtttgagccctattataaaagtaaaggagatcttgaccaatttcttgaggaattctcgactgtcatggaggttgatagtcgagagggggagagagagagagaggtgacatacatgaaaaaaatgttggtgacaagaatggagaggcaatagtgattggatcaataccatgttctattgatgatgcgagtaaagaagtagtggaagtcattgaagatacacaagatgaggatagagaaatggtccctcatgaagaggatggagaagaaggagaagtagttgttgggacaattccatgtcctatggagggagccgaaagggtgaaacaaaaggatgtgctagtttaccaaaggaggcggtttgatagtcagggggagaaaagaaaagggttagtgcaaagtcaaattgaagagttaccacacccaaaatgtccagtccctgaatcctcccagagtctctctcctccagcctccttggcttctcttgagacaattggtaatacttctccaactcttgaacatgtagaattacctcttgcacaacgtagagagactagatccaatgctggtagacctcctatacgtcttggttttgagcatcttagttctatgcatgacattgcaaactatatcacatattctcatgtttcaccagcatacaaaacatttattgcatcattacagacagtgcctataccaaaggattggaagtgtgcaaagcaggatccaaagtggaaagatgcaatgaaagaagagttgaatgaccttgtgaagaataagacttgggaacttgtaaaacttccaccagaaaaaagggcagtgggatgtaagtgggtctttacagtgaagcaaacccctgaagggaaggtggataggtataaagcaaggttagttgcaaaaggctacagtcaaacatatggaattgactatgatgagacatttgcaccggtggcaaaaatgggtacagtgagagctttggtatcttgtgcggtgaactttgggtggccccttcatcagcttgatgtgaaaaatgcatttctccatggtgatttacatgaggaggtctacatggagatccctccaggatttgggaatagctagacagttggaaaagtatgtaaactcaagaaatccttgtatgggttgacactacaccggactaggtcatctctgacgggcccaaaccctcacctttgacgggtttggtcttggtcagtgattagtggtcactgatgacaaaatcacctgtgacggatgaaacacccgtcacagataacccatctctgaccggtgtataagtcatctctgacgggttaaaacttgtcaccc

SEQ ID NO: 89012 - DNA, 706 bp, Oryza sativa
cttgtgggggtcgtccgaagggcccagagaaccgatagcaattcttctggccatttgcctttctttagtgcttctaggatcttgccatttgtacgttcggccgccccatttgactgcgggtgggcgaccgacacgaacctgatttccaggttaagccctttgaacatttctctgaacttatcagagtcaaactgcttgccgttgtcactaatgaactcttttggcactccgaaacggcaaacgatgtttttccatacaaacttctgtactgctgccgaagtgattgccccaaggggtcggcttcgatccatcgagagaaatattccacagctacaattgcgaatttatacccgtttcgtgccaccgggaacggcccgatgatgtccagtccccatctggcgaagggccatattggcgcaatgggctgcagatcatactggggcgtggcttggcttcggccatggcgctggcaactttcgcattcttgatttactcaacacagactttcaacacagtgggccaatagactccttgtctaaatactttggaggccacttttcttgcagcctggtgcgcgccacatagcccctggtgtatctcctttgccatttctttgccttcggcaaaagagatgcaacgaagtaagggttgaagtaccccggagcggtaaagttgacccgagaccatcttatacttcgtggctctg

SEQ ID NO: 89013 - DNA, 560 bp, Oryza sativa
ccactcactaccttttcagctcctacatcgcaccaccctagactactcccaccttcgcgtctttggctgtctttgttacccaaacttgagtgccacgactccacataagcttgcccctcgctcgacaacttgcttttttcttgggtacccggcctcccacaagggataccgatgtctggatctctccactcgccgcatcatcatttcgcgccacgtcgtgtttgacgaatcacgatttcccttcgcagcaactccccctgctccctcgtcttttgattttttgctgcagggactccctccagcggtcgctccctcatcagaggttgagcaaccgcgacctctcacggtggctccctccttggaggttgagcaaccgcgacctctcacggtggctccctccacagaggttgagcaaccgcgacgccttacggtggctccctccatggaggttgagcaaccgtacgttcccctcttcggccgacgcttgccgaacaacacccgtcctgcggcacgtgacgcccgatcagctggcacgcccttggtcaacgcctcctcgatcg

SEQ ID NO: 89014 - DNA, 563 bp, Oryza sativa
cggcccaagggggctcgcggggaggggaggagagagggagccagtgggccgggtccaccttgcgtggtcctgggtggacccgcttgtcggtggctcggctcaccgtgagcgaggtgcacgcggggcgtgctagggtttgggaaggggaggcgcggtgcacgcgcggctcgcggtgggtgcggatgcggcgggcccacacgcagcctcacggctcgcggtggagcgcgcgcgcgagcggggctgaggggagcggctgaccggggttgtcttgacccattcgcggccgaggtggcaccgacgtggcgccttcgtggcagccacgcaggccggcgagaggtagacgacgatgtcggccggaacggatggcggacggcggctacgaacggcggggcgaaccacggcgatacaggcgaaagcgagcacaccgggtggtgtacgagacgaggggagacgagtcaacggctcagattcaccggagggagttcgtcggtggaggattgcggcggcggccaccggcggcgagagaagaggggaacgacgactaggcgaatagggttcgattc

SEQ ID NO: 89015 - DNA, 652 bp, Oryza sativa
caaccggcggcggaaaaagggggaaacggcgacgaggtcacgagggcccgattaccggcggcgagagcatctacgcggctacgggaatccgtccctagcgttggattaggaggaaacgcatcgagggaggccggcgacgagaggcgcttccgagctcgggcggcgatggcggcgagcacatggcgagcggcggcaacggtcggggcggcgccggctagctacggggaggctactcgtgctactacctgagtctaaggggaggagatggaacgaggtggaagaacggagagaggcactaccgtgcgggcgggcgcagtgacgagagccgacggcgcgaaacgtgatcgtttcggcctcgggccgaggaagaggaggaagattgcgcggccaaagtccccttccgcgtccttgctcgtgccggctcctccgacacgcgcaacgacgaacggcgatggcgaacagggcgacagtggcagcgagagacgaacacgagggagattggagggggggagcttgggtttaaatgggcgacaaggtcggtttgggagagaggaaccgacattggacggtcaagccgcgagctggcgctccggctagcggccaaaacggcgacaggaggtgacgccggcgagagggaaaaaaagggggaaaa

SEQ ID NO: 89016 - DNA, 678 bp, Oryza sativa
ccctggctctgcttgatgagggtaaagttgttttgggtgtattggcttgtcccaacctttctttgggatcaataggcaaccttaatggtggctcctcgggagatcaagttggtgctctcttttctgctactattggttgtggagctgaagtagagtctttacagggctctccagcacaaaaggttacatctccttttatttcatattataactttgacttacttttacctatttgagaatggaactaattttttaatctgcttttggttattttcacttccagattagtgtctgttccatcgacaatccagtcgaagcttcattctttgagtcctacgaaggggcacactccttgcgtgatttaacaggctccattgcggaggtttgtcctgaattattctttgcctagtacaggtccacgagagttacttgggtaatctggtgtttgaatgctggcagaaacttggtgtccaagctcctccagttagaattgatagccaagcaaaatacggtgccctagcccgaggtgacggtgccatttacttgcgttttccacacaaaggttacagagagaagatctgggatcatgcagctgggtcaatcgtcgtgacaggtatgaaagttctctttttgaacattgaaaacatagaacccaacaacctgaaaaaaaacatagaa

SEQ ID NO: 89017 - DNA, 2629 bp, Oryza sativa
acctggtgacgaagggcgtgctgccgccggcctccctgcagcgccgcggcgtcggcggcgggggatgggtccagctccagcctccgcccccgccacctccgccgccgcagggaaccctggcgttctatggtgcccagaatggccggcggcggttggatgatgatgatgatggtaatcctaacccccgctcgcggcggaaccgcggtggtgagaacaataatgatgacagtagtagtagctacaatggtagagggaagaggaaattcggtgcttacagtaggcattcggattgggggagggacaaggggaggagtagggggaattcggatagccggagttacgatgatgaggatgatgacgggcctcctggttataggagagagcggcgaggtggtgggagatttgatgatgctgggagtagcatgtcgggggtggcagcgtctaagacggaggccatgggggagtcggagctggaggatactgggtcgaaggtgggctctagcagtaatttcaggaaggatgtcgatccgccacaagaagtggagggcgttgataagttgaataagattaatgaggagagtaatccatcaaattcagaggtggtggagcaaatgactaatggtgagagcactagtaataatgcttcttgtattgttattgatgaggaacagacgaaggcaaaatatttgcctgtgccctcagatgacaaggtttcagatgagaagcctgacgatagtagtgttttgaatgagaagattgaagatgacgagactttagctgagaaagctgaagatgataagacttctgatgagagggtaccaggtgtgaagaataacttgcgtgatgattgtaataatttgctgagctattgcagttatccaaatgtaccgacaaggcggcgatcaatagttgcacacaggaatgcagcaccagcccatagggaagttgctgttgccgaacagattgatctggtttcctctgaagatgaaacccatatggccactgatgttacagggcatggcagctccttgactaatacccaggaaggcaacaaagatggccttgcctgcttggaacataccgatacaagcactacttgcaatcagatggtggagccagtaagattccagacagaggaaacacagattggaactgatgatttgagaggacagaaaaacattgagcaacattatgcagttcacgaatctagggaggagaatatgttacctcctaaagtgggtgttcagcagcaagttgaggaaggaatgcagatttacaatgttgatacaccgccacaagatgaagacttgattgcttcagctgataaagagaaagtagctggtgtggcattattacctagtatcaaagctgaagctgttgttgcgaaggaagaggacaagtttggtcagtcaagttcatttaaaatatgtgatctaaacctagttggtagtccagaggttgctgaattacgaaatgatcctggtttgggtcaattctcaactgctggatgttcaatggagccacaaaatcagcaacaagagtttagaaatacgggtaacagtgcagatgataccaacatgcatgcccaaattccattgcacaataaggtggttcaagttattgatcttgaagatgactcgccaattgaagctggtgcatgtgatacttcaaaagcaaagtgagttccttccacctccctcttatttgctatgtcattctgcttttatatgagtataattttttcttttggtattacggtttgatgatacagtacctagccttaaaggcttgtcccagactagttactattaggcaaccagttttgtgtagccagcgatgaatggtagctggcccagacgctcagcaatacaaaaatacaggggtgactgccttcttccagtcgctgcacaaggagaatgagtctaggcctttgctgtcttcttattgttgttgcttttcatgttctgtaggagtggcagctgatcttgctgcctaatcagcagacttgctgtcaatctttgtactcttcgctctgatcttaataaaatttctctgtcatctttatggctagcctgactaaaacagtatttgtacataatgcaccgacaaccatctaatttccacatccaacctatgcattagtttatttctgtttattttctcttcatttatttatccattgtggctgctaactacatacctttaattgtgtatgctagagaggaaaacatggcaaaccctgctgtgaccacagatgttcttcctggtatccaagatggatataattttgcgatttcagattatcttggtgctgatataccatgctaccaaccaatgcaaacagatcttcccaatgggatgagcctaaatgattcagaggtgaggttttctgatattgttatacatcatgtggaggcttaataataggaaaatagattcaccactatccagtaccagtagtgacatttgaggatttgtgaccatatgtttgcttgacatgcgtagacacatatagtcaccataagttcataatactgttttttttccatgagtaagagattccttacactttttttcctcctgttgcagggcattactgtcatggatgattcaatatatggttctctta

SEQ ID NO: 89018 - DNA, 602 bp, Oryza sativa
cagcccagggctgggtgtaccagatcccagtcaacatctgcgaggcgctcaagacattcggctcctgcggtggccggtcgctctgctcgccgtctcgcgccgccggcgccggcgagcgcggctctctctctgccgccgacaagaagcgtcggcgcccgcctgccagcgggagctggctctgcggagccgccgtggccaggtgcctcttggcgatccaggaggaggaagacgatgagatcggcaagggagcagccgtcgtgccggccgaggatgtaaaggcttcagaggtcggtctcgtgatgcaagggtgggacgtggaggaggaggagagcacggtggtagtcggggaggtggaagtggagaagaaggacgagatcttggtggttgggaaggaggaggaagggagggtcagcgtctgcatcccgccgcgaaacgcgctgctgctgatgcgctgcaggtcggaccctgttcgtatggctgcattagccactcgcttctggggctcccctgcagcggcaaatgtcagtcaggttgacaatgtcaaggatgaaaacgaaaacgacgacgacgaagaggaggaagaggatgaggaagacgaagat

SEQ ID NO: 89019 - DNA, 731 bp, Oryza sativa
ggataagtttgaggcacgctctactgatggattgtttcttggttaccccgcacatactagtggctatcgtgtacttattttggggactaacaaaatcgtggagacttgtgaagtttcttttaatgaggctagttcaggtactagacccgaaattgcaggtacactgtcacaggttcagggggaggatggtcgtatttttgaagacgagagcgactacgacgacgacgacgaggtcggctcggccggtcagaccgggcgccaggccggtcagaccgccggcacacctccggtcagaccggcccatgaggagcggtcagaccggccagggtcgtcgggttcgggtactgttgatgctgatcgtgatggtcctccggaaattactacttcgaccagtactgatacagaacgtggatcaacttcagaagtcgctgctcctttgcacattcaacgacgacatccgccggaacaaattatttgtaatataggtgagcggactacaaggtctaggtaacaactcatgatgtttgtgcaaattctgcatttgttgctttttttgaactcaaagatgtgtcacatgcattaactgatgaatcgtggattaacgccatgcatgaagaacttgagaattttgagagaaacaaagtttgaactttaattgaaccaccttctggacataatattattggaaccaagtgggttctcaaaaataaacaaaatgagtatggtttgat

SEQ ID NO: 89020 - DNA, 1206 bp, Oryza sativa
ttaagttttttcaggggtctatttgtaaaataagttttcaaaaaggaccaaaatgtaaaaattgcaggcgtagcgcggcaggcgtggtggggatgggccggtttggcaggcccggtacgatgctctggcactttctcgctggcccagcgaaggagctcctccgggccgagaacggatagcaattggacctgctagtttcggcgaactacggcctgtcaccgactcaccgtgcggtgcggacgcgactcgatgagctactaaatgcaactggatatgtcccccagttccaaattaagtttacgcacgtaaaacaatctgttcagattgtagctaaaataaacccaatttagcaatattgtcaagttttggcaggatttcttattagtttggtaagaaactaaatggatgcatatatttagcaacttttttaaaaaatggtatggtttgaaataacgtcaatcttacaaaatagcataattcgtatagacgaaaaagtaccattatagcctactaaatcgatggctcatatagtttttacaagtagtataatattatctatgtagagagtacagtagtactaatagcactctttgcggttacccttcgttagatcttcaatgaatcgacaactctaccaccacgagagaaatgttcatagtgtccaatcaacaagtccttgcccttgattcccctgtaccgtgctgattgttgcttcagccccagcagctcagccaccggctctatctccttctcgccatccacagcgtagaacatggccaccgacattctctccctctctgcatttgtcaccaccctatgcaatggagccctgaaggtcccattggtcattatctgcaacaaaaacaatgggcaaacacaaattaaccatgaacatatttgaccacatcacacatctttttttcatcaaaaatgcaaagtgagaattttgcttaggtgttcatgtatgtaatatgggtaattttatcatccttaaaaaaattccgggatgtattataccttctagtataaaatttggtatctctaggtaaaaaaaaaatctcgaggtacttttccgaggatcataaaatttctcatgtaatatagttacctccagtgtaacaccaatgttaatcagaagagagtaatctcgcacagctggaacactgtaccatgttccatctctaagaacttgcaggccaccgactt

SEQ ID NO: 89021 - DNA, 2841 bp, Oryza sativa
ccaccgtacgatggtgaagaatttgttgctgacccaaatttgaagattaaaacaagagggaagaggagatcgaaatggactcgggtctgggtggttctggaaggaaaccaccttcatgcgttcaacttgatgctgcgccggtacaaaatagatgctcgttgtgtcaccaggagggtcacaagaaaactaatgtcctaagcgtccaaaaaagaagaagtccaaaaaaaatataagtgttagggaggtaaatattttgttttcctactcatgttctcgcattcattttctgttaatatgtcacattggtaactaacggtgaatttattactttttcatgtaggatggccgaggagagacaaccgccgacttacccagccttggaggcgtactacgaggcccgtcatcgcggggctgcgatcgaggcggggagggtatgaatcggcattgattcacttgtgcataagtatctgtagcgtgtatttgacattatattaactaattgatttacaattgctaatgcaggtacttcaaccgctccgagtcagagctcatgcccccccagtgttcgacgataggtacatcccatacctaagggcagccgggttgctcggggtggccttggtcgtgagcagaggaatgccagtgttcaacgctcctgcgttgacagcaattgtggacagatggaggccggagacacacagcttccacctccctagtggtgagatgaccatcactctacaggatgtggctatgatcttggccctcccattacgggggcatgccgtgacgggcaggacagagactcctggatggcgtgcacaagtggagcagctgtttggcattccactgaacattgagcaggggcaaggggggaagaagaagcagaatggaatacccctgtcttggctgagtcagaacttctcacatcttgacgacgacgctgagccatggcgtgttgagtgttatgcccgtgcatacatcttgcacttgttaggaggggttctgtttcctgatgctgggggtgacattgcttcggcgatatggattcctttggtcaccaaccttggtgatctaggccgtttcagttggtgctcagcagtgttggcgtggacatgtagacagctctgtgaggcctgttgtcgtcaggcaccatcatccaacatgagtggttgtgtgctattgattcagctgtggatatggttaagactaccggttggaaggcctaagtggaggcaaagcttcattccttggccctacaatgagccagacatggagaagacagtggcctacctttttgagagtactgccactgcacatgctcaccgggatgtggcatacaagcattatgtcaatgagatggactgcttacagcctcaacatgtaagtacttccaatatcacttctagttagacatttacttctttaattgagatactaaccaacgacatctcttcaacttttgcagattgaatggttacccataccacacaaatgaggcttcaagcctgaccctgaactcgatgtgcaatcgagactctgactatttcatgtaccagtgcccattgatttgtttctgggcagttgagtaccaccttccgcaccgtgtcatgcgatagttcgggaagaaacaagactggccggttgaggacatctcaactggagttgaattacacaagtaaatatttcttatctttgtttgctttcattgtcaatgttcaattttgtaccatttaacccttgtcgatgctcactattgtttcatcaccttctacttgtctaggtatgacagggtgagaacaaagaaggtgaaagactgggggctagagcataatagatacattgatgaatggaggacagccggaaggaacgacaggtacatagagactatacaccaaaatcatcttttctcagagtaccttcgttggctgcataggacatatagactgttcctccaccctacttggacggaagccgacatagatgatgaccgcgactccgatgagggacggaatccctatgatgtccggactagagttggatatcaaatggagcacgccccacttagagacagagtcgtaagttttcttgcatttgtcaaagttatttccatttgcaccctagaccctaacatatatcttctcacgctttcagtcgagagagctcctcaggagtgtgaatgaaatggggcatgccctccaagctccgaggggtggtgaggacacggagaacacactccgcaatgttttagaggtaaaatttatttagcactttgcattacttgagttatgcctaacaaacttcttttttttttgaaatgcagaaagttcgtcaaaggtgccggaaacttgcagcaagattaggttgcaagtcggttggattggacgacgtgtaccaaccgcggagactaccaccactactacctcactccgcacgtccaagtaccgctcgacactgatagaagagcgtgaagaaattggtggctcgttgtcgtcacgcattccgcaagggaggggaaaggggaaggcgccggctccacctagcgacgacgatgacgacgacgacgaggaggatgaggactacgtcgcaccagacgctgaggagatagacatgtcgcagcttcccgacgcgcctcaggggacgcaacccacgcaatacaacttgcgatccactcgggcagcgaaaaagaggtaaaatgagcttaccattctcaaatgttatttgatttccctcattttgtttttaaaatgttttaaacattggattttcaaatgtaggtacactccgggctcgcaagctattcgacgccaacggaagaagtgatttgtatgaagttaatctatt

SEQ ID NO: 89022 - DNA, 559 bp, Oryza sativa
gatgaagtatggcaaggcttggagggcacgagaggaggctatgaagctcatttacggttaatggggtgaagcgtatgtccgtttgcccactttgctgcaagccattaagcagaggaattccagtatggtctaccacatcgatactcatcctgatagggttgtcaacgttgatggagtgaccaagaaaatttttatgcgtgcattctagtgctttcgtccttccattgaggcttttaagcattgtaggccagtactagctatagatgcaaccttcctaactgggaaatacggtggtgccttgatgactgcattatcagctgatgcggaggaccaacttgtacctttagcttttgccttggtggagaaagagaattcacgagactggtgctggtttatcaatcttgtccgacgggttgtggttgggccgcatagggaggtttgtattatctcagatcgacatgctagtataatgaatgccatgacgactcctgttccaggattgccaccggttcaccaccgatggtgcatgaggcacttcagtgctaattttcacaaggcc

SEQ ID NO: 89023 - DNA, 719 bp, Oryza sativa
gctgtgtgtttatgtgcgcgctttcaagcttctcctcgtgcttcacatcctcaagcggtcaagcgaataatgaggtatttgaatcatacacttgagtttggaatttggtattctacttcatcttctatttgcttaagtggatattcagatgctgattttggaggttatagaattgataggaaaagtactagtggaacatgtcattttcttggtacatcattgattgcatggtcttctaggaaacaatctagtgttgctcaatcaactgctgaatctgaatatgttgctgctgctagttgttgttcacagattctttggcttttatctactttgaaagattatagtcttactttgagaaagtacctctcttttgtgataatactagtgctattaatattgctaagaatcctgttcaacactcacgcacaaagcagattgatattcgttttcactttttgagggatcatgttgagaagggagatgttgagttgcagtttttggacacgaaattgcaaattgctgatattttcactaaacctttggattctaatcgctttgcttttcttcgtggtgaattgggcataattcatccttttggcatggtttgagggggagtttgtacctcatggttttatcaagcaataatatgacaatgaaaaacttgagaaaagagagctttgtttatgcatatggtattttcttctgcatgctagcaatac

SEQ ID NO: 89024 - DNA, 577 bp, Oryza sativa
tgtttcaatgctgactagtgatttgtttcaatatttgttgctgtttactcaggttgaaatacaccatgccagtgaggtagatgagattttcgatgccattagctatgacaagggtgcttctgttattcgtatgctacaaagttacctaggtgcagagcgttttcaggtttcatactggctctccttgaaattcttcagaatcgtgttattcttatctgtagtgagcaccttttgctcaactgtattgcttaaaagcgtatgaaaattaccccaaaccattttcttttttgcttctcggaggaagcattgaccttttagtctgtccactattcatttagttgaaaaacgtcaagtggacctttggatattccaagtttccaatattttaaatgcgtgaatgatccttaggcgatacaattggtgttaatgttcttttgttagtgattttgtaagtgaaattctttttttaaaagcttcctatattttttagggcaaatattaccatttcccccctaatcatcttgcttttgtttaacgagtacctgttatcgatgacgagtcaaccattaatacttca

SEQ ID NO: 89025 - DNA, 600 bp, Oryza sativa
ttgttgcaatgtaaacaacacttattttttttaatctccaaaacaagaagttcaattctgaaatctgattcctagaaaatctaaccataaaacaatgacttataaatcagataagtattatttcttagaatatactattatatgcatatgcatattcacctgtaattaatgaattggtctaagttgtgtttgcaatgttgcaaaatgtgagttttgatagtttagactttagaatctgttttcctttttgaagtctgcagatctaagcagcagctttttcctgatgtttgtgatactgctttagacctattttatgcacaaaaagcttctcatgatgcaagtaagattgatgacatacctcagcggacatgattccatggtggcaatggatgctttctggtgactggccaaaaccactactggcctcaatgaacacaccagcttcagttattccaacagtctcaatcagggactggcgaggggggcttttcgtcggtatgaatatggagttcatggggttatcagccatccctttacccacatacttgttatggagaactacaggaattttatggctcctaaggtcattcttgggtccaa

SEQ ID NO: 89026 - DNA, 575 bp, Oryza sativa
gcactcccgcgcgcgcgcaggcgccggcggcgacgtgctcctcgccggggtgcacctcgtcagcgcggcgcgcgggtggggcgtgcgcgacctgctcgaccacgttcgccagctcgctgggtcgcgtggcaatgtgtgggcagtgggtgcgaggaatgttggcaagtctacactgctcaatgccattgcccggtgctccgggattgaaggcggaccgaccttgacggaggcgccggtgccaggaacgacccttgatgtgatccaggttgatggcgttcttggatcgcaggcgaagctgttcgacacaccgggcttgcttcatggtcaccagctgacatcgaggctgactcgcgaggagcagaagctggttcgagtgagcaaggagatgcggcccaggacatacagattaaaggtgatatatatttgcacatcacccactcaaccccagtcgtgtttgtgataatgcgcaattgacatagttgctgctcattttctaaatttcagcacaaatttcttgttaacgagtctagattttctgtagttctctgcaacagaattgaagatactttgcttaa

SEQ ID NO: 89027 - DNA, 503 bp, Oryza sativa
ttttgactgactggatttatgattgctgtaggcaatgtctgcatatgggtatgagattgtgcaaactctgatcattgatattgagcctgatgtccatgtcaagagagcaatgaatgagatcaacgcaggcaagtaaccattgccctttccctgcataattgttgcttgctttcgatcttctcgccaaagattgagttggcaatagctttttgggaatactgagttggcaatagttccttccatcaatcacataatcatttacacattgattgttttgattgattctgtaacatgtactcagaattatttccatctaacatcttgatttatggtattgttgagcagctgcaagattgagggtggcagccaatgagaaagccgaagccgagaagatactacagatcaagaaagctgaaggagaggcagagtccaagtacctggctggtgtcggtatcgcgaggcagcgtcaggccatagtggatgggctgagagacagcgtgctc

SEQ ID NO: 89028 - DNA, 583 bp, Oryza sativa
atataaatatggaaaaagacacgggaggtccttaatctagtaaataaattaaaaaatcatccttgaacccaaaatccagatataaaacattttttaacttaaaaaaaagagtcactttaggtctttagggtgattttgaaccgggttttatcttaagtggaacctgagtcagcgtgggacccacatgggtcccacatgtcaatgactactttctttcccctctctaaacctctttcctctctctcttattctctacctctcttcctctctctcttcttggcaaccggccatgcgggaggactgaggagcgcggctgacgacgggcggggagaggagcggaggtggagacggatgcggcggggcgccaccggcgatggcctcgccgtcgcctcgctctccgctctgcttgacgagaagcaactccagcgctcgcccaaacccaccctcgccgagtacgctgtccggcttgaagttcctcgtcgccgccctgagctctgcgaacatgaagattcagaggttggggacctccaggatcctcccctccggctccgggtagagcggggtaccgagctcgaattcgcgc

SEQ ID NO: 89029 - DNA, 574 bp, Oryza sativa
tctgtaagtatttacgcttatttacgtttggaactgtatattacttgtcattttgtgaccctgcctggtcatggacagggatttaatacacaaaatagtctagaaatttgggctaaatttatgggcgtgacaagtactcaatattcctgaccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgtctagctatgtggtgtagttcttatgttctatgttggcatgtggctttgcttgtaattcgtttcgaacttatcgatgtgtttatgtttcgtcgtgtaatgtcagacttcggcatgtcatgtctttaggtctcgtgatgtaacatcagactaaggcgcctaacatct

SEQ ID NO: 89030 - DNA, 536 bp, Oryza sativa
cattggagaaggttactactgtgcacttgcaaaagggccacttgttccaaaccatgttctagttataccagttgagcactgctctagtacactaaagatgcccgtggaagctgaggcagagcttgggagatataaggatgctctggccaagtattttgagaaacaaggaaagatagctatatacttcgagtgggtttctcagcagtcccgccatgcaaaccttcaggtgaggacatttttttcctgatatgttgctccatgcttccatttaaatgatgctgtcatttggaatttggatgcttgtatgcgatctcatttgttttttgttcatactggatggtaatccactaaatttctgcgcaggctgttccagtaccattgtctaaagcatcaagtgttaaaaagatattccatttagcagcacagagactgggatttgaattttctgtagtgaatccaggtgaagttgtacctaactttatctctcttagtcagctgaatagaaaggggatagacaaaaacaatcttaggctgcg

SEQ ID NO: 89031 - DNA, 667 bp, Oryza sativa
gacaccagtcggcggcggataagccggccggtcggtgaagacgcaaacgcccatcaacggtggcataataggccagccgtgcaggcggaagcaccagtcggcggcggacgaggcggccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaagcaccagtcggcggcggacgaggcggccggtcggtgaagacgtagatgcccaacaacagcggcataaaggccagccgtgcaggcgaaaacaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacagcggcataaaggccagccgtgcaggcggaaacaccagtcggcggcggcgaaggcaagccggtcggtgaagacgtag

SEQ ID NO: 89032 - DNA, 541 bp, Oryza sativa
  unsure (1)..(541): unsure at all n locations
tatttcaaacagaaggcaattctgaatcactgatcattgtagagacaaaacaaattgtaccgaacagatggaatgagctagaattttgaaagttaaatgatgtgcatgggaggaatcaggattcaggaatgtacctggcaaaagaatcaccaattcttcctttgctagctggcagcagaagtccatgtcatctttgatgccttgcaggcaggacagatccagtttcacctgcaccaagccaaccaaaacatcatacaccatcagaaattccctttgattctcttcattgtgaagcagaatatttgactgaccatgacaaacatggaaccctcaggtttgcttgggcaagtgatgcaactgatgcccttcagcttctcccaacaaatatctgcggtctgccttaggacatcgacggtcttttcgaagaattcttcctttgtgttctctatgagttgtggaattgctccctgaaaaaaaaattaatcaaggtagaatgtaaatcattatgttttgatattatgtatctncactgatcttttta

SEQ ID NO: 89033 - DNA, 651 bp, Oryza sativa
ggttccctcgcgcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgaacttttcctcttactcgacttaaccagtaccaacccagcttctgaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagtcgtttttgctcacgaatatcagaccagtcaacaagtacaatgggcatcgtattgcccgaacagataaagctagcatgccaacggtatacagcgagtcgctctttgtggaggtgacgattacctaacaatcggtcgattcgttgatgttatgttttgctctcgctatggttggcaggttacgggccaagtttggtaagagtgagagttttacagtcaagtaatgcgttg

SEQ ID NO: 89034 - DNA, 578 bp, Oryza sativa
gttgatatcgccttaaatcatctggagataggttcattatatgtttatgaatcgaagaagggaaaggtaccttagtagcaaatcttgaccaatttgaaagtcatcagcccttgttttcccccttgctcgtgtaccagctaaagcctcgctggaaatgtttaagtatttccgatgaaataattgctctggctattcagaatatttgcataaaatgaacattagttagaacttaggtcattgttatttaacatgagaaggccaaaataagaaaaaacatccaagttcatgtaaatatagtaagagatattctaataaatcatttggagtaaaatcgatacaagagatcacacagaagatgtgatgaaggaatttgtttttcagaatagaattgacatacactatttccaacaaatgcaggagcatcaggtggctgtatacagaactgataagcattttggccctcaacctgtatattcagtgtcagaaagatctaattgttttaacagcaatacaagagatgcaatatacctttaaacatgccaacagttcaacaaggtcaatgcaggtttcagtaatat

SEQ ID NO: 89035 - DNA, 521 bp, Oryza sativa
actatagggcgaattcgagctcggtacccctgccagcgagttgcagcggcggcgtcggcagcgtcgcgcgcagtggggagggaggcggaggccggcgcgcagcgcggggagaaaggggagccgggcctggcggtggaggtggtggcggcggcgtctgcatcggcgcgcaaggagggaggcggaggccggcatcgacgaagggagggaggggagccgggcctggcgacggagacggcggcggcggcatctgcatcggtgcataaggagggaggtggaggccggcgccggcgaaaggagggagggaagccgggcctggcggcggtggcggcggcgtctgtatcagcacgcaaagagggaggcggaggctggcgccggcgaaaggagggaggggagccgggcctggcggcggcggcgtctgcatctgcgtgcggggagggaggcggagaccggtgccggcgaaaggagggaggggagccgggcctggcggcggcggctctcggtggcatcggcgtctgccgagg

SEQ ID NO: 89036 - DNA, 646 bp, Oryza sativa
cttgatcatagtccaagaaggatgtagtacagcaatgtgattggaagagctattagcatgccaaaaattaccctgtaaaaagtgacaatttgcccagaataaatataaacaccatccaaacaaaaatatcagcaagcaaaacaagcaaaggaaattgcttacgctgtgctcaggatggccgggtggacattgtattcttttgcaaaaacaaaaggcacaatcccttgtggtagagccgcctatcaaatcgaattcccagatatatatatcaatgagcattagcttcacatatactagtagtatataatgcacagggaaataaattgctcgaatgattgatactactccagtaagtactacctccgtcccatattacttgtctttttgagtttttttatcaatgtttgatcattcgtcttattcaaaaaattttgaaattattatttattttgtttgtcatttgctttattatcaaaagtactttacatatgacttatcttttttttatatttgcactgatttttcaaataaaatgaatggtcaaacgttgcaaataaaaagtcaaaaacgtcacctattatgggacggagggagtacatatgttccagtaaagaagctgatggaatcatatatacggagggcctgt

SEQ ID NO: 89037 - DNA, 588 bp, Oryza sativa
cgcgggcgggcgggaggtagattacaacgccggccggaacggacgccggacgacagcgccgagcggcgaagcgaaccacggtgatacgggcacagcgagcacaccgggcagttgcacgtgacaagggaagccgagccaacggcttggattcgccggaggttgctcgacggcggcggattgcggcgccggcaaccggcggcgggagaagagggaaacggcgacgaggtcacgagaggtcgattcccgccggtgagagcatctacgcggcttcgggaactcgacgctagcgtcggattgggcggaactacgccgagcgagaccggcgacgagcgggtgctacggagctcgggcggcgacggcggcgagcacacggcaagtgacggcaacggtcggggcggcgccggctaactacggggaggctactcaagctactaccgaaagctagggggaggagatggagcgaggaggaagaacggagagaggcactaccgaggtgaggaggggcgctgtgacgagaggccgacggcgcgggagtgatctctccggcctcgggccgaggaaaaggaagaagagggcgcggccgaagtc

SEQ ID NO: 89038 - DNA, 538 bp, Oryza sativa
aaagaaattcgagtagcgcgttgaaaagtaggacctgcattctttaacccaaaaggcattgaagtataacaataggttcctacaggggtaatgaacgcagttttttcctcatcctccctagccatgcgaatctgatggtaaccagagtatgcatctagaaaacacaaaaggtcgcaccccgcggtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaatccggcctccagaagtctcgccacctcctcgcggatgaaggcttgacgttccggggcctggcgccgcactttctgccggaccggccttgcgctcggccgtacggcgagacggtgctcaatcacctccctggggaccccgggcatatccgccggtctccatgcgaagacgtcagcgtttgcccgcaggaaggaga

SEQ ID NO: 89039 - DNA, 626 bp, Oryza sativa
tactaatcaaacctgaccaattcaacattgatgatgcaaacagagaccaggtttttttttcgagtgtgcattgagtaatggttttagcttcttctcttttgcaggcgcatttgtcgcagaatagcaagttcgacttccacaaatacatcaagaggtctttggaggacgacttcaaagttgtcgttggcatcaggtccgtcctcgctttattaattataggactcttatattcaacattttttttataaagaaacatatttagtctccagttgtgtatgtgtatgtggatcttgacacatttggctggttttgcagcctccctctgtggttcgtcggaatccttgtactcttcctcgatatccacggtaatccttgtcctatttcattctgttttttactctcaaaaccttgttctgaattggtcttataatcaccatcgattttttttcaactttttccccgcgtgtaggtcttggcacacttatttggatctcttttgttcctctcatcggaagagcgaaatttccctgttcaaagaaacagttaacataattaattatgctttaatttatcatgaaaattaatatgatcatttaactaatgaacaaacattcatgtgaatgcca

SEQ ID NO: 89040 - DNA, 550 bp, Oryza sativa
tcggccaatagaatccttgacgaaaagccttgccaaccaaggtgcgcgaggcggaatgggctccgcactcgccttcatggatatcggcaagaagctcaacgccttgttcctgaggaatgcacttcaggaggattccgttagccgcgcgccgatagagggtcccttctaccagcacgtagcgtttggaaatgcgttggacgcgttcactcccttcgcggtcctcaggtagagtcttatctgtgaggtatgcttggatctcggagatgcaagcaatcaatctaagggagcttggagcgctcccttcgggtcccgaggcctggactccgacgggcctcgggggccggtcaggcacacccgtctcccctaaggggtcaggtcgcgccgacggctgggtaagcctttcttcaaaggcgcccggtggggtctgggctcgcgaagacgcgagccgtgagagttcgtcggcaatcatgttatcccgtctgggcacatgccgaagctctatcccgtcaaaatggcgttccatacgccgcacttggcgtacgtaagcgtc

SEQ ID NO: 89041 - DNA, 725 bp, Oryza sativa
ctcgcttcaaagcttcatcatgtctgttcacaaagtagtcattgcacttcatgaacgtaaatgatacaaatggccgtcactggaagcttacgaacaccaactagcacgctattgaactgttcggccatgttggttgtcatgtaaccccaccggcggccatttctatcgtatgcacgagaccacttatctttatccaacaactcatcttcaagccatttacgaggaccttcgggaatacgctgccttagtgcctcaacatccctctcaaatatccacttctcgtcaatctgacatatccttaggagctcttttgtctgatgcttgtccgcaccggccttgtggaaattagcactgaagtgcttcatgcaccaccggtggtgaaccgatggcaatcctggaataggagtcatcatggcattcattataccagcatgtcgatctgagataatacaaacctccctatgcggcccaaccacaacccgtcggacaagatcgataaaccagcaccagtctcgtgaattctctttctccaccaaggcaaaagctaaaggtacaagttggtcctccgcatcagctgataatgcagtcatcaaggcaccaccgtatttcccagttaggaaggttgcatctatagctagtacaggcctacaatgcttaaaagcctcaatggaaggaccaaagcaccagaatgcacgcataaaaattttcttggtcactccatcaat

SEQ ID NO: 89042 - DNA, 5367 bp, Oryza sativa
atcagtaaaaatccacacaaagaaatattgcattggagtccggccagaggagatgctccatgacatggcttcaccaaggcatgctctgtgccgattacttgtgccagccattgggatcttcttttttttttttaaggaacacgacggcagaagctgtgccggaatttaattagaaggagagaaaagtgcttacagtccagagaaaaacattaacaaaccctcaagggggcctaaaagccgatctacagagatccaggtcttgctttacaatatatgccacttccatctccgagcttgtgttattattgaagattctcttgtttctctttagccaaacattccaccaagtagtaagcagtgctcctctcaccgccttcttttgatccttcaaaccaacacaatcaatttcagaccaccactttgatgttccaactggaggatcgacattgttcagtgtcaaattttgccaggcacagacaaggttccacacttgtctgacaaaagggcattcgctaaacaaatggttagtgtcttcaaaggcgcttgtgcacaaacaacatatccaattgcacggctagtgtcttcgaagtagattttgtgcagtaagtgttttctcatgatgaacgagccaaccaaaaaaatcttgtttttggtttagccggtgccttccaaagcgaggtaaaatctgtggaagcaaaggatccttgaaattggtaaagataggcgcttttgcttgtgtaagtccctgatttgttccagttccatgagatatcatcagggctcagtgagagctggactccctgaagcatactccccaggcgcactagttcatatagcttttccactgtggttatttgtctgaaggagacaatccagttattgtttaggatctccagttgaacacttctttgctttctctttgccagcttaaagcacaatggtgcaatgtcttttgggcagccattttggagccaactatcatgccagaaacttgttttagctcctttacccaactcaattgtcatcgctgcttgaaacaaccttttgtcagattcgtcacagggaacgctcatacctgcctaaggttttccttcatccttcaaactgaaccataaccattgaagacaaagagctctcgaaaatctctctaaatctggaaggtctagacctcccaaagattggggtttgcacaccgtttgccagttgactaaactactgcccgggttagcttagtcaagatcttcacctttccaaaggaaggatctatgaaagcaatcaattctttttatcacccatttaggcgcatgaagagctgtaaggtggtgagcgggcattgagctcaagactgattgaaccagagtcttgcgtccagtcgaggtgaaaaatattcctttccaaccaggtatttgtgatccaatttttccgatcaagggaaggaaatcgatttttcttagctttcagtagtggaggggtaaaccgaggtagcggcaggggaactgttttatcatgcttgggaaattcgcgagaagagaaacgaggtttatttcttcacacctgatcgggtagatctttgttttgctgacatttgtgtgaagacccgagacttgtgcgaaaaagactaagagctgcacaagcatcgataaatcaataggctgaggtttcacgaatactgcaacatcatccgcatacagagagcacctgaacctgtcaaatctcccaccaaccggagagagaaaggatgcattttcagttgctttcagaatccgatggaaaggttccatggttagaataaacaacatgggcgatagcggatcaccttgtcaaagaccccagacatggtttgctgtttgacccggggagccattgagcagcacttgagatgatgaggttgctagcaggttccaaagccaaaatgatgaaggacatcaaggagatatggctagcacacagtgtcaaaggctttagcaatgtcaactttgatgaacagactctgttttttcgttctatgcaagatctgcaccatattttggacatagaggaaattatcgcggatgtcccttttgcggatgaaggcactttgattaggagaaacaagctcgcatagccttggcgctaatctgtttgccattaatttagagattgtcttggagaagctgtgaattagacttatgggatggtaatgttcagctcccgaagcatcttctttcttgaggagacaaatgaaagctgagtttagatcatgtagttgcgaggtgtttaggttaaagaaggatgttactgttgttaggaggtcctccttgattatctcccaggctgccttgaagaacaccccaataaaaccatctggccccagtgccttctcaggtggcatggagaaaacagtcaccttaagctcttcttccgttatatcatcttccagctgtgcaagatccagtgtttccttcatattccaattgattcctgaccttctttgaaaacatgttccaagtctctccttgaggaaacggaacaattccccttctttatcttgggttgaaattgctatcccggaaggtgtatgcagcgattgaatgaagttctttcttctcctggagttgactttaatgtgaaagaattttgagttgacatctccctccttaagccatgtttgcctagagcgctgcctaatctgaattttgtttaggactaagagagccaaaattttgttttgagattagagatcaaaagacgctcttcattggacaaggtcctggtttcctgtgctacctctagttggaatatcacttcggatgcaacagcaagttgtaacttgatatctccaacttgattacggctccatctcttaatgtcgcgggcaagacgtcgtagtttcaagcggaaattggctaggctgtttgtggcgagaattggcctttgccaagaatcctgcacaatccccagaaacctaggaattttaagccatcaggattcaaatctgaaatttggaaatttcgttcttttctcatttccaactaaaaggagaggtgcatggtcagagcacgcagaagacagtggatataagttggacccatcaaacattaaatcccagtcagtggtaacgaaagcatggtcaatcttagtttgtgttggatttgcgccttgtcctgcccaggagaaacggcggccaggaagattcaattccttcacccggattttgtctaagaggccacggaaatgctgcatcattcttctattgaggcggtcatttgtttttatctgaagctttatagatgaggttaaaatcaccaataatcaaccaagccggtttcatggagggttgtaagctttcgagttcagagagaaaggcaattttatcggcttccaattgaggcccatacacaacagtgatggaccactgcagaccctcctctcgcatggtcacagttgcagagacagagaattggcccaggacaacatcagagatacagaaaaagttttcattgcatgcaagaagcacaccgcccctgttggcaaaactcaggatcaaactacacacgaatccctggaaattgacaatgcttgatgttgaacagtggaagagaagaacacacgcgagaagtttttgtgccgccaaacttacgcagcttttctgtgtatttcatcaccatttatacaaagtgaaaacgagatcatgcgatcgtgtagatcatgtctccgactctgtgcactcccacgaactccatttgcgcatgtgccatcccacacggcgaagaacgtgagcgtacgactcgctacactacgcctcatcgtgaacaagcacgattccggctttacaagcgcagctcgatccttaacaaccaagcctcaaaaaacggaaataaaatagactctaacaaacaccttgcatgcaacgaacagtgcacggtgtggtgaggaagaaacagagctccatagcgccagcttatatcatcaagtctaacattctccccctaagcttggcgccttggactgacctcgacgacgccgatacgaggtcgcaattcttgaaaacaaacccgcccgagtgccttggtcagaatgtcagcaaccttcccatcggtgccaatgaactcaacctgagctctcccgtcctccacgcactcatggatgaagtggtagcatgtggcgatgtgtttactccggtcatgaaacactggatttttgctgagggtgattgccgacttattgtcaacgagaagcttgaagctttgtggctcctcttgttcgatttctctcagcagctgcgccagccagattccctgacacgccgccgtcatcgccactatgtactccgcctcacaagacgagagcgcgacaaccttttgcttgatggactgccaactgaccgggttggcgcccaggaagaagacgaccccgctggtgcttttgcgagtgtcgacattgcctgccatgtctgcgtcacagtacccgacaagctcaggtggcatctccatcctattgtagtagcagccgaaatcaaccgtgccggcaacgtaacacaagatgcgtttcaccgccacgtcatgctcggtggttggaacttccatgaagcggctcacgtacccaacaaagaacgcgaggtccagccgcgtgtgaaccagataccgcaggcagccgacgatgctgcggtactgggtggcgtccaccatcgctgctgtgctcgccttggtcaacttgagatgaggctccataggcgtcgagcaggaattacatccctgcatcccggctcgctcaagtatgcattgtgcatacaatttctgcaacagtcgaacgccgtccgccacctgttcgacctcaatccccaagtagaacgagaggggaccaagatcgctcatcttaaacagggacatcatctccgctttgaaacggtcgatctccatcactacgttgccggtgatgatcaagtcgtcgacgtacacgccaaccagcagtcggctgtcgccactgccccgcccgtagaccgtgtgctcgcagtcattgcgccggaagcccagcgacagcaggctcgtgtccagcttcgcgttccatgcgtgccgagcctgccgaagaccgtacaaggccttgtccaagcgaagcacttggtgttcacgtccgtccacaatgaaacccgggaggttgcttgacgtagacctcctcggtgagctccccattgaggaatgccgacttgacgtccatgtggtggacaggccagcctgcctgcgctgcccgcgcgagcagcattctcatcgactccagccgtgccactggagcaaacacctcgtcgaagtccacccccggctactgcatgtatcccttcgccacaagacgagccttgtgcttggtgatcatgccgcgcgcatccttcttgat

SEQ ID NO: 89043 - DNA, 1070 bp, Oryza sativa
tcttaaccacatgcacatgagaatcaatatcacacaaccgctcatgttggatgatggtgcctgacgacaacaggcctcacagagctgtctatatgtccacgccaactgaaacggcccagatcaccaaggttggcgaccaaaggaatccatatcgccgaagcaatgtcacccccagcatcaggaaacagaacccctcccaacaagtgcaagatgtatgcacgggcataacactcaacacgccatggctcagcatcgtcgtcaagatgtgagaagttctgactcagccaagacaggggtattccattctgcttcttcttccccccttgcccctgctcaatgttcagtggaatgccaaacagctgctgcacttgtgcatgccatccaagagtctctgtcctgcccgtcacggcatgcccccgtaatgggagggccaagatcatagccacatcctgtagagtgatggtcatctcaccactggggagatggaagctgtgtgtctcaggcctccatctgtccacaagtgctgtcaacgcaggagcgttgaagactggcattcctctgctcacgaccaaggccaccccgagcaacccggcagcctttaggtacgggatgtacctatcgtcgaacactgggggggtatgagctctgactcggagcggttgaagtacctgcattagcaattgtaaatcaattagttaatataatgtcaaatacacgctaccgatacttatgcacaagtgaatcaatgccgattcataccctccccgcctcgatcgcagccccgcgatgacgggcctcgtagtacgcctccaaggctgggtaagtcggcggttgtccctgctcggccatcctacatgaaaaagtaataaattcaccgttagttaccaatgtgacatatattaaaagaaaatgaatgcgagaacatgagtaggaaaacaaaatatttacctccctaacacttaaattttttttggacttcttcttttttggacgcttaggacacttagttttcttgtgaccctcctgatgacacaacgagcatctattttgcaccggcgcagcatcaagtt

SEQ ID NO: 89044 - DNA, 584 bp, Oryza sativa
agatttcatctattagaaaaacttgaaaaaggagaagatgatgatgtcatgctgacatcatccatggcggcgggctcagatggcgacctcgccggagctagggtggtcggccgggaaaaaggagggcatgtacacgtagaggacgacgagacgaacccaacggtactcaccacaacgacaaacgacgtcggacgacgaccggcaacgagaggggcgacggcggcggctcggttgaccggcggcggaggggctccggtggccggcggcgaaggggaacgggcggccgagcatccccacggcttggcgcacctaaaggcgatggcggcaagcggcggcgacggcggagaaggctgctcggcgcggctgcaacccggccggcggcggcggcggatggtttcacgcggcgacggctctacgggtcacgggaggggacgggagagggggcaaacgaaagaggaggactagggggtcctatttatagccttggattgaagagatcggactcctcccgcaagaaatcgatccgggaaatcaaaaactcggttttggagataaactcaaaaacgagttcgattcggataaaa

SEQ ID NO: 89045 - DNA, 1751 bp, Oryza sativa
agcagcaccggggtccgatcttgtaagggcaactatgaccccgaaaccatgaagaagtacatctacctcgtcgatgccaaagaggtggagaaggtggagttcgggcagcaagtcaaacaggtagcctacggggttccggagacggtggatgtcgagaaggtctggcaatgcaaagggaaactgctgaagttgagcgacggtcgaagggatcaaggtgtggcgcggcggcgggacctatgcctgtccttcgccctcttcaagatgctcaggttaaggtttgccgtcgatcatgttggtcgttttgccctccctttccaagaaggcaagtcatgggacttcgtcgtcaaggggctcctcgccgatgaccaagacctcgatagggcgtaccgggtggtcgaggccgagcttgggttcctctttgatttcttctatgcccgttatccatctatcaagaacagcctggctcctgaccttgctgtgtatgtcgcgatcctcacgacaagcctattcacccttttctccccggaccttctccgataccggccgcttcggcctggtcccggagacggtggagatgccagcaacatcatcatccatggcttcaaccttgacctccttgtcacccgtttggtaatcgtttggtacatcttcctcgagtcctatcagttctttaccttcatcttctctgattggcacaaggtgaagatgatgtgtcggtacgtgcgcaatgagtcatggcacagggcgctcatggaggtcccactcaaggtgttgtgccatttcagtaccatcacgaggtactggaagggaaccatcggccaatacttcctcctagacaacattcatcctcactggatcaagaccttcctatcatggttctccatcgaggccaaggccctggactcatggctgatgactcgctccatccgcttgacaccggaggtgagccacgccgtgctccgtgagctcaagaactgcaacggcaacatcaccgacgggaggatgtggttgtatcagaagggcatcatcgacatggacctcgatcgtgacgtcttgctcggcaacccatacgctaattacatcctgaagtggcacattgccactagcatctgtgactacgggctgagcatggagaacggcgctaccaccaccgacgacgagttcgcgaggaatcacgaggtcgcaatgaagttgtcagggtactgcgcgtacctgctagcgttccagccggagctagtgcaggacaacacgtacaggagcacgtcgacagttcaaggcacgctgcaaaatgcccgggacttcctcggcggctgcaagtcccacggggaaaagtacaagaagctgatcgagctggggcgctcgaaaatagtgatggaccacgagatggcgcagaaaagcaaggacatcatctacagctacgactccgacgaggagaaggtgaagaagatgatcgagctggacaactcgacgagcaacgacacggtgaacgtgcttaagatcctgtctcagggcgcgagtgtcgccgtgtacctcgtcgataggatcgaggacacgagagagcggtggaaggtgctcgccgctttctgggcgaacctgatgctgtacatctccccgtcggatagggcggtggcacacgccaccaggatggcgaccggcggcgagtttataacgatcctatgggctctgctgacacatgctcatgtggtagacccgctccagtcgcgcggcggtaactcgggattgcatatgca

SEQ ID NO: 89046 - DNA, 1208 bp, Oryza sativa
attccatctaacatccatgtccaaaccaaacatacgaggacgataacccgcagcaatgcaaacatttttatatgtagcaatgcgctgattagatgcattcaagaatgaaatggcagctctaatgtcatttagcatgggcttgaacttgtcaagtccagccttaacaatcaaattgatgatatgacatgcacagcgttgatgcaaaaataaatcaccaatataaccagacagagcaggagtaagggtgtccatagctttagaattagcagaagcattgtctaatgtaatagagaaaaccttatcagtaataccatattcttcagcaacagcaatcacacgctcagcaatattagcaccagtatgtgactcatcaataagcctaagacccaagaccctcttttctaattgccaatcagaactaacaaagtgatctacaacactcaaataatcttccttagcatgaccagaccatatatcagatgtcaaagcaatagagctagcagaattgagacgatcaataataacagaacgacgatccttaaacaacttataaaaatctctggtagtagtttgtctagagacaggaacaaatctagggttatgagcaaccttaatatagttcacaaaagcaggagattgaccaaactgattggaagatcctctctagcaatcaatctacacaattcaaacctagcaacttcaggactatattcccatggaataacagaaccatctgcactaaatctaagcatggactgaggcaaagcattagacccaagctttctaggtttgcatgacttaatatgcctaagcaaatgtccagtgccagcagaagaacgagcactcaaagttttatgacagtaattgcatttagcagagactcgaaccctattaccattggtcgtttcataaagttcctcaaagtcatcccataccttggaggttttggtcttcttgttggtacaagtcgcactagagccagtcggcgtcccattgccactgtcgtcgaccggcgggtcgtcgtcatcgacattcacatggatcgggatgtcggaggtattgccgaacacctccacacgatcctcctccacatcatcatcgcatcaccgcgcatccccatagtcctcaactcgtagttgacagaggtaggatcgtcgtccatcgcaggcactctggtccctcaacggcggctgccgctaagcaacggg

SEQ ID NO: 89047 - DNA, 936 bp, Oryza sativa
gggaaggagctgacaccatcgtgatgagcaaaaataacaaagactaacagctagctaagtcttctaaacttcattatttgcttaagaaaatgaagtgatatatatacacatctaggggcgagcttcaatttattcgtggatcaaggcgctgatcaattgctccctccgtccctaaatatttgacgtcattgacttttttaaatatgtttgactgttagtcttattcaaaaaatttaagaaattattaattcttttcctatcatttgattcattgttaaatatactactactactcaagtttttgaataatattcacaaatgtttttgaataagacgaacaatcaaacatatttaaaaaagtcaatggcgtcaaatatttaggaatggagggagtatttgcttacggccaaggccgggatgttatctattccattatctaaaaagttttgcttacggcaagaaaacgattgtgctaattgttacaggctaacaaaatccttcagctttctcaaccataggaggtattcttcgttttccttgtagatcatgtactcttgcaagaattttgcggccatgggtgtgatcccacgcagctccaggtacttgttcaacgccttttgcagactttcatcgaggtcactgcagcagacagggcaaagcaaattgcacataagaactcggcgattaatagttaagaattaattagactgctcaataatttaggttttgttatcttactcgaaatcaggaccctcatctgcgatcatttcattgttgtcatcctctggtggctgcatcaaggacaaggtgtcgatgacgatctcttcaggatgggcagtgcaggagaattcaaggatctgtccatctccctttgagatggtgacggtgagaggaatgctggatttggagggaacctgaatctcttcgtactcagat

SEQ ID NO: 89048 - DNA, 821 bp, Oryza sativa
gaggttgcttcgattgcacacaactatggcacttagaaccttgcaatggaaaacttaggaattaaacacatgctggaagccgagacatcaagccaaaattatatgacataacgtgaatgccaaacattagcctcattatccatactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccatgccaacaccatgaacagaagcatgtgacccattccccattaggacggtgtaactctgtgtgtcatagtaaatagcaaacagttatttgcttgcacaacaatgttctctggctcccagagctgtatcttgtcaggtcttttcaatcacgtaagacaccattggtaatatagcactgtatctttctatctatcaattatcttattaatactgccttgcaagaaggcgttatagttatctctgtaggctataacttgtcacatcaattgaattaacaaatgtaatttgtcttagtaggaactgaatctttgaattttattttttcgtgagtttcaattaagagatatcgagagagaagtgcgtgtagatcccctttttagagtgcatcaaaagttggaataagcgcctcatacccgcccgactgaatca

SEQ ID NO: 89049 - DNA, 1363 bp, Oryza sativa
tcgttaaaaacctttctaggtaaaaacacacacctcgtgagaaaccctagaaagaaaaagagtacagcccatagctaaaatgttcatatcaattacaatcatccagttcaagggtttacatcaatttcatcatcaagatacatattctcataagcattttgaagctccacattctcagtagtatgctgactttttgcatctgctagctcccagtccttgatcactgccagaatttccaccagcctatggtttagacgccgccgacggtcctcgatgatcctgccagttaagctaaaagtagactcggacgatatagtagaaacagggaaggcagtttccccggttgttgcattgcttcgcataattctagtaatccttgttacatatgcaggtatgctaaaaggctaagctaccaaaaatcctgccaaattgctcggcaatttctcattgccggacgaagtccttcagcttggtcatccacccgacgtactccttggtttgcttggtcaccatgtaatcgtgcatgtagttggtggtcggcagagtgatccctctttgctccaggtacttgaataggcccttctgcacattcaccggtagctcgctgtagtagaaagaagcgattcgatgaggattatgagtagagatggtgctcaagaaggattgagaaatggagattgaaaccggtgttcttacgtgaattcagggccctcgtaagggaatttctcatctccttctgtggctgcattctccactattaacatgtcgtcgatggtgatctcctcacgaaaggctgtgcaggtgaactcaagtttgggcccagagcccttggagactgtcacctttagagacacgctgctatctccagcgctctcgtcttcctcttcatcttcatcatccttgctagcattcttgccctcaccctcggcttcttcgtcgtcaaactcagggcccccttctaaatttggcatgctgacaatgacctcaatcttctcatctttgtagtcccttttcagaataaccacactcatcccttcttcgtcaaggatttcaaaagggaagttttccggaacaggttcctgttgcaagaaagataaatgggtaagatgaaacacctttggaatattcaataacagatgttaaatgccttgatgtcaaaccagcatgtcaattttacagctagatgtcacacctgcagaggtaattttacagctttgatgtccattcattcattcacttttcagggttatgcggaaaggattattcaacctcaatgccagttctaatattgcccttgcctggagcttccaattgatcaaaatattgaacccaaaccatcacaaactctatcatcagtcccact

SEQ ID NO: 89050 - DNA, 699 bp, Oryza sativa
ctaattgttacaggctaacaaaatccttcagctttctcaaccataggaggtattcttcgttttccttgtagatcatgtactcttgcaagaattttgcggccatgggtgtgatcccacgcagctccaggtacttgttcaacgccttttgcagactttcatcgaggtcactgcagcagacagggcaaagcaaattgcacataagaactcggcgattaatagttaagaattaattagactgctcaataatttaggttttgttatcttactcgaaatcaggaccctcatctgcgatcatttcattgttgtcatcctctggtggctgcatcaaggacaaggtgtcgatgacgatctcttcaggatgggcagtgcaggagaattcaaggatctgtccatctccctttgagatggtgacggtgagaggaatgctggatttggagggaacctgaatctcttcgtactcagattcatcgctggtccatcttttctcacatttgaccttggcagtggcaggctcaggttcatcgtcactctcaaggctgtccatggaaacctgaagctcaatcttctcaccatggtaagttcttgtgagagtaattgcattcgagccctctccataattgattttaaagaatttaaagattttaaagggggagttattagggatctccttggcctgtatcagtatgacaatgaaaatga

SEQ ID NO: 89051 - DNA, 1335 bp, Oryza sativa
caagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgcttacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaagatttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtatcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtttgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggt

SEQ ID NO: 89052 - DNA, 696 bp, Oryza sativa
catccttttgttaatgaccatccattactcacagacttacattgggcatgtgctgaatctgttttgtgtttccttgaacaattttatgattcaactgttgttttgtctggtgtttattatccaacatctccattaatcatgcatcacattttagagattgctggacatctaaacacatatggcaatgttcaaaaccttgcaaatgttgttggtcccatgaaaactaagtttatgaactactggtctaaaattccaattctttattcatttgcatttatcttggaccctagggccaagattagggggtttagtaaagtgcttcagattatggctcaactcattggtgatgattactctgcttatttaacaactgttagagcttcattgtctgatacttttgctaagtatgaaagaaagtttggttctgttagattgcatagttccactattccaggcccttccactggtaagaaaaggactgcatgggggaagatttttggttctgttgttgctgctgggcttggtgctggtaatgcaagtgccagtccaagtgctggtaatgctggtgccagttcaagtgctgggcttggtgcttgtaatgctggtgccagtccaggggctgggcttggggctgggtcattaaccaagaatgacatctgctactgctttggttcaggcagcttcttcaactgctaa

SEQ ID NO: 89053 - DNA, 745 bp, Oryza sativa
tgcatatgcttctgaaattacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagttttaggtccaagtttgcgcttcttcgttattggtacattgactttcgccaagcacccccatgtgcgcaaataagaaagtgatggttttctaccaatccatatctcatatggtgttttgtccttatttctgttaggaactctatttaacacatgatttgaggtcaacaatgcctccccccaccatgccttaggcagtcccgcggtgtccaacatggcattcaccaagtcagtcagtgtgcgattcttcctttcagcaatcccattagactcgggagaatagggaggcgtcctctcatgtatgatgccatgttcctcacagaataagtcaaactcgttcgagaaaaactctccaccacgatcagacctaagcctttttatctttc

SEQ ID NO: 89054 - DNA, 686 bp, Oryza sativa
gcgaattcgagctcggtacccatctaatttttcttgagctctaggaaaagcgtcacggaagagtgatgtgttcagttacggcatcatgctgcttgaagtgttcactgcgaaaagacccacagatgctatgtttgtgggagaactgaacatcaggcagtgggttcaacaggcgtttcctgcagagcttggccatgtggtggactgccaacttctacagaatggttctttttcttcttcaagtaacatgcatggcttccttgtgccagtgttcgagctgggtttgctctgttcggctcactccccagagcaaaggatggcgatgagtgatgtggtcgtgacactgaagaagattaggaaggactatgtcaaattgatggcaaccacagtgagcgttgtgcagcattgattttttgccgggtccggcgaaggaaccggcgaccaaattttattaagattgggagggaaaaaaaatcaaatacaagtagttctcgcttgcaacgacaggaggctgtcgaattagactgtggcaggaaccacaacccggccaactaaagaactggtaacgtcaacacaacagaaagaaaactaagaactgcatttgcgaaatagcctgctttttccacactaagatctcttttttgatagcctttgctaactggttagggcttatcgatctttggttgaaa

SEQ ID NO: 89055 - DNA, 668 bp, Oryza sativa
agctcggtacccgtatactaaccatggtcgggatgtggatgaagccctcgtcggcggtgaactcgagcacgccgcatagtacgaggtctgcagcgtggtggcgttctgaatctgaaactgcatcgggtactcgatgtgcagatacccttgaaagtaaattaaccacaagcaataacatcagtaatttaaccaactaatttattaccagatgatcaagtatggagacgtgtcactcaagatgacaagtctttctggatgagcgaaggaccgaggtcttgtataattttcttccgcgggcggcggctacggccatggagatctcgcgactcgcgggtcgcggccatgtgccggtgaggtcggctgcttcgccggcgtctccgcctacgcatctacgcctgattgatcccccccaacctatctccactgtgctatcgcgtttcttgcggacttgcggaggttgtggttgaggcagtagcctgtggggcggtgatgcggcacccagatcccgctcgtacaccgattttcggtcgccatcgccgggattcgtatttttcgggcaaccccttgtcgagccgcccgtccttgggcaagatctggtcgggatcgcttgtggtaggtgttgggcacctggggggtagaaagacagcatcgttgatgtgctttgaggt

SEQ ID NO: 89056 - DNA, 536 bp, Oryza sativa
tgctggatgccgaaatgagacccaaaatagcagattttgttatgaccaaaatttttggtgaaaaccagcaaaaggcgaatactaaaaaatccgaggacatgcagtacaagagaagaataatcttaaactttccaacgctgcggttaacagattcacagaagaaagcatatgccttgatcgaaaaaaagaaactaatgagacaagcaggagaatcgctaagggactacccagacatagagctaccaaatgctgccgagatagaggaacttggtaacagacttataaacgaagagcttaactatgacaaagcccaactgaaggatgagcacctcgccatattaaacagccttaacacagatcagaagaaagccttcgatgcgataatggaatctatcaacggagggcaaggaaagcaaatatttgtggaaggctatggcgggacaggcaaaacatacctatggaaagcactcacgacaaaactaagatccgaggggaagatagccctcgcagttgcttcatgtggtacagcagcactt

SEQ ID NO: 89057 - DNA, 746 bp, Oryza sativa
tcaataattattaacagtgaaatttggtaatcggcaaagacatcatcggcttaaaatcattatcgggtgtagcatctgggaaacagccgatgggagttatcaagtcgccaatagtcggattcctgctatattcggttaaggaaatcaatctactaaaggaagcttatctctaagtgaccgagtttaaagagaatacggcatggcaatttatctattaattaggaataatttgttagtttctttttatctttaggaaagtgtgtttagtgtccaataaggactttatattttccttttatctttaggttagtttctttcttgtccgacaaggacttgtatcaacccatgggtataaatatgtacacccggggtctatgtaatctatctctatgatcaatacaattcgacgcatcgccaccctttttacttctatttttgttttttacgttctggcggaacttggcacccgacgcggggctgcatcatcttcaatctccggcgaagggataagtccaatgttccgtcggcccaagcaattgtctcatctacatcggcgttatttaaggctgcatcagtacattcgacctcttggattgctctagtttggatgatatatttgcctacatatttatcatatgtctctattaatctagtcttagcatatcaatttagctctatcggctgcttctcattttagggtttctgccgatatcggctaaatcgcgttgctagattagattagctca

SEQ ID NO: 89058 - DNA, 686 bp, Oryza sativa
ttgcatcaaacagtgtcctattaaattctttggatttgcatcctacagccacaatatgaccttttaagttgcagtaataccaagaactgcacaggaaccaaatccgattcgttttgcttcaatttaagattcactatatggctaaacccgatcactaaccagagattacggagaatgcttgttgatttccgggttaaaaatatgaagggcatgttcaacatcacaaaaacaaaggtaaaatccatgaattacttcatgcataaaccgcacgacataatggaatggacggtgaacaacaaaccgaattagatacagaacaaaacgtaaaatacggtagcaaattattcactccctacaatgctccctccatctgatggaaatggaagtcatcagatcggaggcccagaagggaatcctgcgttccagcaattattcgtcaggcgatggactaaaaaggcagagaaacaagaggctggctgattacaatttttcgacagagtttcatctcatgaagagagatatactgctcactcaggcctcgagctggagcttcttgattgtgtcgatgtgcttcgctgggttgaggcccttggggcaggcgtgtgtgcagttcttgatggtgtggcagcggtacagcttgaactcgtcgttgatggaatccaggcgctccttagtgaactggtcac

SEQ ID NO: 89059 - DNA, 5993 bp, Oryza sativa
ctgcgagcctgctacttccctttcgcatttaaggttgaactcttgccctgctttagagttggcacacggtgcagaattcatgccagcgtcccttaagagactcgcaataagttgttgtgtgcttgcacccgacttgttctgtggccactggccgcatctgaaagatattttcatacacgactgcagaagctctgtgtcgttgtttgttggtgatcttagctccctgaaagaattcacactttatcatttgccagatttatgtgtgcttgaaggcctgtcttcccttcaacttcacagcgtgtgtttggtagatatcccgaagcttactgctgagtgtgtgtcaaagtttcgtgtccaggatttactgcatgttagcagctctgcggtgttgaacaacatcatctcggctgaaggtatcacagttcagcgtctctcatccttcaaaggtgcaaggagccatccgtttcatttgaagaaactataaattcctcatctgtcaagcagctgcgattagaaagttgtcaaatgagttccctgcagggaaatctgaagtgcctctccagactggaggaacttgacatcttcagttgccccaatatatcatgtttgccagatctcccatcctcccttcagcgcatatccatagtggactgccccaatatatcatctttgccagatctcccatcctccctgcagcacatatacatacgtgactgtccactactgaaggagagctgtagagtacccgatggggaaagctggccaaagattgcgcatattcgttggaagcgtattgactgaattatgcttcagattcacaagaacaaaggaacagaaaggtaacggtttcatcaatgcattatgaaaatataaatttatgcaagatcattccatccattattgttcgtctaaatacttctttcggttaccagttaaatcgctctcttgtcctctggcagtgctgttccttcgccccctgcattgcagacctccagagtctcacacagctgtttggctatgaacgagagggaccggttcgtattgactgatcggtctgagcttcttcttcttattcttgtgtggttgcatttcgctggctgctggctatggtctatatgcctatggactattaccgagatgtatctgtgtatttggatcttgctctgttatgtttcctgtttgttcttttggactgaattgcttgtagtagctgttatctatggtgtgcaacgtctactgtattactgcaccggtgaagctttgtatgggagtaccatggtgcttttgaactcaggctactgttatcctctcttggagtgtttccttttggacttggtttctattgagtattgactgtaagcctgtaactattatctcttgtatgatgagatgcaagataaggcaaacctgcaatagctctagtcaacttggccttgcattgctgatgacctgatggaaatcgttttattttacccattcgttctaaactgtatattgtagtcacgggtttcctgtatatttgaggccaatttttctagactagctgaagaccaattaagtctcttttatcctcatgtagctttgagatcttgaaaggatggaaaatatgtagtgcaaaccacatatgtggtgtaaatctagaatataccgtcggatctaaaaatggacgtacgagatttggtcatgtcaccaaaggtaaaaattttattcctagattaaccataagtaaaactttaaatggaagtaaaatttttactcttgacatgaactcggacatctatttttttattcaacggtagtttttccagggttccatcacatatgtttgcaatacatttattttccaagagtggcaattatatgtttgcaatacatttattttccaatagtggcaattatgatgaaagggaaaggagtaacgggttattactgctgtcacgtaagtaccattttatttgtttgttttgatgcgctcgtcactctactgcaagatatgaggaagagaagagacgtgatcctattctaactggtggagcttcagcgattaaacatgaaatcgaagtctgtcactgtctctgtttagtgaatgtctccttcaatttggcaagtctcaagtggtttaccagtaatttggcaatttcaccggctgttgctgggaagagtttttcccatggcaaaaagcattatcactgactgccgagttaggcttgctgttgccaagttgttggggttagcttaagcaaattcatgtattttattcaccggattagtaagtgattaacaataagggtttggttttcaacaaatccagctcagctaaaccttaagtaaatgtcattaagtacttagaagttgttcttcattactagtatctggacagtaataagtacttaatgatgaccatctaagcatactaaggttagtatctggacagtaatgaagaacaacttaatttagcagtaagttcttcattgcttagtattcctatacttaaccattatcagtgcataagtactccactaaaccatttagtacttatgcttagattttattgtacattatccagtggtgtggacaaccagattaggcagtggtttagatttggaactcaattatcctctggagtccctactttctacagcatttccctgtttgcgcactttcatggatgatcctgcttctccaacatcttctgattttgattgttgttcaaaaggatgattcaatggctgccccctcaggtattgtttggataatgggatagggaaatgatttcccacctattaaaaggtatctttaaatcctaacaatttattcttccatttaatcctaacccttcattcatttcccaatcccaatcccaccctccatttcccattatccaaacacacccttatggtttcgaccctggatgtcacctaggattttcgacgaaaaataagagagtttagagacgagacgtttgttggtcactcataattagcaattgagtgccaatgagttgcttcaaacgatatatcaaacgtaggattggatgcaaaagtgaatgcaaaattaacgggaacataggcatcgtatcacacacgagtcagggcactgtcaatcgggaaaagcccctaatgaatcaacttgtacaaattttctcaggaacagaactaaaatgaatcaagaattctataccgaaattaaaaaaaataaacaacggaactacaagttagataaaatactagagcaccaggtatgtcctgggtattgtagtacaagacaaacgcatccagacatccagttctgccaaaatgcatcccagaaaaagcacctcaactctagaaccaactttatttcttttcagcatcataccccccccccccccccacacacacacacacaacaacaacaacaaaacaaaaaaaccactaagaaaagcatcatctaaaaacatgttattttcagaaagagcagagtatatgattttagtaaaaacaatcctactagctatcaactttttagaatgatgtaatctaaaatgttgctgctatgtctacaagtctggcagcaaataaaccaaaaaaaaaaaacatgttgactcataaggcaactattgctgctatctgtaacctccaataagaaataaagggttcttgatccctgagcgagacatgccacttcacatttcaccttcctattgctatgattacttacataacaaactatataacatctggctcaatgtagctacatattcggacagcacgacaaaaatccactggttaagtagcaaccagataccaggacggctggaaaccaatagcttcaataagttttgggttttcgaactcgtgtactcctccggggatccacagccaccaaaacagtcttttcattcttcatattgccgggatctttctcagttttaattttcttcgcaagcacaggaagcccatgtttcttatttggtttctgtccacgcttgtctccagagatgatttgcttggcaactggagctgtttcttgaacttgttcatagtccactatgtctgcacttgctttttgtactttggaaggaggcataaccagctctgaatgctcctctggcttgaccttctcaaatagctgataaccttctttggctgcttgattatctatgaggacatcatcagcgctctgcaaagataaccaaaccatcaaatgaaaaggtttttgcaaatatgttgatccagcacgagtccctatttcttacaacagtttagggagtacactatttagctttgataaataattcagtataaaaataggaatcattatgattacgaggcaatgtcagatctatgaaagatcagcaaatcattacaaatgatggtatcaagcacatgtatatcgcatatcacactatcgccttgtgactgtatatcgcaaagcaggaaacaccatgacgttacacagatctactgcatattcaagaaaacaccatcatgctcagcttgtttttcaccatatacttcgacataaaatatttatagttgacttctagaagattatgaaggactagaggtcccacacccacacacatgcaactagaaatcctaacatgacatgacggagatctacatggtttattggatgggcaaagagttggtatatcctatgttcctttttattaggaaccagctactggtcaaagtgttcttcatacattagttctaaaatatcgtgtgacaaaatagagaagaataagatgctatagctaaacttacttctttgtataactcccctacatgggcattggttaggaaattatctttaccacagaacatctcaattgtgattccatttagatctgattgtactgcatcttcttgtgcatcatttttcttcatacattccaacacacagtcagtggacctaccaaatacaggtggaaccacagcaagtgatctatctaagtcatccttctgaagcaaagtatgcatacactttgttttctgatgagaacgtcttccatccttcttacaacaggtcatctgattctgaatcttttgaggcaccttaacctgtttacggtctaagcattgtgacaacttcttgtatttgctgcgagcattgctgaggcgaccctgaagactaagaattcgggactggacatcatcaactgtaagaagaatctctcttaaagaatattgttcaaataccctgtcattctcaactaacgcatcatcagtgctttcgatgtcctcaacaactgcgtgaagagcgacaaatagagaggattagcaactattaagaggaacaattccacattaaaatatataaaagagttcaaaaatacacatttcctgcctttcagcttcattaatataacatcgtgcacaatcaatccccaaaagatagaaaagtaccataaaagataaactaaaagagataaacaaactaaatgtgacagaaactcagtctgatatcaagttcgatggctgctccgatagatactgtatacagaaacaattttacccaaccaatttttgcaggtatgcagcttgcacgcaagcctgcaactctagcatcccgaggaacaggctaaacgtgtgctttagaaaaactgaaattttaacagtacaggcatactgaattcagaccccaaaacaatgcacagtgcgataatctgaccactgacaaaaaaaaaggggcaaaagcacgtacgttaatgctctaacaaccacttgcatttcagattgaagagtgactgcaacaaaaattatattttctccttctaaactacagaaaataatcttgagcacacaggcacaaccatgtaacttacctgaactgtcaaaaccaccattaaccaagggaccatccgtttgaactccactgtttttgttttctgcaaaagatcaagagtcttcgttacagtcaagtataaacacgaaccccatgcaaaatatgatactcattcaagacaacaattttctctaccctataaaacaaggacaggatgtcga

SEQ ID NO: 89060 - DNA, 1997 bp, Oryza sativa
ttgtatttcagaactcttatttatttatttacttttgtaaaaagagatccttaaagttaacattggagactaattgagtgctacaagtaggactactgaccgttttcctggatataaaacagcaaatttccatacttttcctgaagatattcaagcgcgagctctagcccccgaggatctaatgaggtccctggtagaaactgcctcaagagtaacaagcaaaaccatgttacagtctgcagatgttatgaaaagttcaatatattcagttcagagacagtgttgtcgtttatcacctctcgagtaggtgtgctattcttgctggctgacaaaaaaaaaagcacacatgaataaaatgattgagcttcataaaattttaagaacgtatgaataatgaaaagcatatcagtatgaaatttcctaccccagaacaaagaagaaatatcgtcagtgacatcctgtagcggcgcctttactgcgttactattatcgctcacataatttgaggtataatgattcaacccaatgaagtcgaacgcattagtaaccagctcagattcgtagtcagagaataatggaagacgggaaccggcggccttcttcatggtctctgggtaatctccaaacaccaaaggatgcaagatcctgcaatttggttgcatttagttgtgtcaggattcagagtctactaggaacctatgttttcaaaagaaaaactcaaagcatggacagcagagttcgctgtagtggctggtataacaagcttacaaccaaagctaggaaccaactctctccgtcccataaaaaacccaattctaggtttaaatatggacaagtcccataaaaaacccaatcctaagtttgaatctgggggatcagggtttttatgggacggaagaagtatttgtttcactcttgctatagtaaatacttcagaaatatgatataacatgacataccatccatacatgaaatcctttactctttcagtggcagcaatatcttcagttgactctgtgagtgggtagaaccacatggagtatatgttcatgccgacaacgcccttctgtgcagcctgaaacaatgaaaccaaaaacagagaaataaaaatcatttttcttgcttaatggagcgatacgcagatctcctacatgttcgaaaaaaaaatcattttcttgacttcataagaataattaagaatatacagtatacagggccattcaagaaaatattcagaagaagaaaattgctaatgataatgcacactcacttggtgcttttccctgtaaagtctaacagctgaagcatgagctagcagggtgtggtgtatgaacaagtatggctcaaccgtggaatttcctagtgtgcagttgcttctgccaaacggatacgagcaacgatttggcgggagatacccatcgtcatagccagattgagccatgacatttggctcaatggaagttgtccaatgcgcgactctgtcaccgaactcgcggaagcacacatcagcgtatgctgcgaagtcatccctgcaacacatttgcaaggaaggtgaagcctgtgaggataaaagtttctaatggttattgtcattcaagataatcttatcagcatggagtgaaagggaaattactgcttaatgcttacacaactttggggctaacccatccaccgtactcatcttgaaggctctgtggaagatctatatggtacagaacagcatgaatctgaatacctattcatgaatcaggagcagaaagcctaatctcagactcaggggtcaccagtcatgcattattgttgttaagaagatatttggttagtaacaactaatgcgaagttaagagtgatgtgcattaatgaatacaattgtttttttttcagaatttggataggtcaaaatgataggataatcaagatatactaacctgcttttactagctcatttatcatactattgtaaaactgcaagccttttggattaaccgctcctctcc

SEQ ID NO: 89061 - DNA, 683 bp, Oryza sativa
acaagtttggttccaaattttttcttcaaacttccaacttttccattacatcaaagcacacacaaacttccaactttgacatgcatgctcactggagacatcgattagcagaaaacatcaacaggtggatctataaaggagacatccatgcataactaaaggtgacatgcccaatggagatatagattacttggaaaacaaacatacataggtctgatccatgcataattaaaggggcagctcaaggcaaggtgggtatgaaaagatggagggagagctacgcagttgtgctgtcaacagcttctaagcatggaagctctgccttggttctcttgtatgcgtttctagcagagttttgtccaagtttgaagcttgcgtaggtgatgatggataaacggattattctacccctgaaattcaataaagcatgaccaagactcaaatttaagttctactcctgaaactcaataaatcatcatcaagaccaagagttaaatttaaggtagcagcaagaaagtcgtagaaacagacggaagggaatcggtattgcaccagaaaagcaagcgaggactaggagcaagatcatctcccccaatgctttgcacccccgattccgcagcatccctttcctgctgcatcatcgccgaagcagatcccttcttcatgtggccgctgttctttgc

SEQ ID NO: 89062 - DNA, 779 bp, Oryza sativa
agatcttcttggcgctgtcagcctgtcacaaactcgcaatccaattgcacttccagcggttgagcaggttcaattcaacatgactttcatcaggagatggtaagttaggaacagattactgtcacaactcacaacagttattactactatcgcaacaaatgctagctgtccttatcctcatcgactggatacttcagaaacaagcataacagtagcattggagcaaaggacacagcatggctagaagtagatgctgctacctagagatatcatctcgaattcatggcatgaacaaacgtcgttcatgcagccatgcaggaataataagctcagaacaggattcaggacaaattcaggctatctacaagcttgccagcatcatcatattataataatcgctttaatagtcagcaaacttgtacagaatatccagatccaaatttccacaaactatatatcatcatcaggaattttaaaaagagaactcggaatcgatttcgcatgatattcgaggacacccaagccaaactgacgataacgatgactaacgctaatacctactacaacaccaggtgctggcccttatttgataacttgcgcctgcgagaattcttaggcagaagcagatgcagcagtggcaccgacgtgcttcacgatggtgttctggaggtcatcctccctggcgccaacgaccttgtcagcctcagcaccatccttgatgaataggaaggtcggcattgcctcgacattgtacttttcagcaacttcctgttggataa

SEQ ID NO: 89063 - DNA, 769 bp, Oryza sativa
tcttcaagccgaaagtcatcacaacccactcaacaagccgattgcaccaggacatcggaaggctgtcttatgaatgtcttcttcggtaatgaagatccgattgtaacctgcattgccatccataaaactcaaaatcttgtgtcctgaacggcatcaaccaactgatcggctactggcatcgggtactcatcctttggggtagctttatttaaatcccggaaatcaatgcacaccctaactttgtcgtttttcttgatgactggaactatattagaaatccactcagcatatcgacatggacgaataaacccagcatcatacaagcgtgcaacttcagccttaacagccacaagcatatcggctttacatctccttggtggctgctgatatggcctaaccccgagctttataggtagccgatgttcaacaatcgatcggctgagtcttggcatctcatgatattcccaagcaaagaaatctctgtattctttcaaaagttctattaacttggttctaaatccggaagataaattcttactgataaatgttggccttggtcgatctcctggacctatgtcaatttcctccaaatcatcagccgacataaaaccttgcccttgtttgtcatcgagatcatctactgcatccttggtgtagacatttgaaccctccacgacgcctcaaaataacaatttgggctctgcatcttcaatcggctgtatatcagaatcggacacttttagaaaatctccatcccaaacttatccag

SEQ ID NO: 89064 - DNA, 581 bp, Oryza sativa
ataaaaacccgcgtttacgacagactcatgtcacatgacaaaaaatgggttgaaaaactccaatcagtactattggcggtacgcaccacaccgacaacatccagcaaggaaaacaccctttttcctcgtgtacgggtctaaaaccatgctctctggcgagttacgacatcaaagtacacgagtacagaagcattccgacgaggaacagcgagacattgatgtaaaccttctcgaggagcatcgtgagcgagttgctgttcgagcagctagctatcaacaagccctccgctgttatcacgagaagcgtatccgagcacgcatactttcgatcggcgactatgtcctctgacgagttcaaacccaagcagggcaaaacaaactctcaccaaaatgggaaggaccctacacgatcacacaagtcttgcggccaggcgcattcaaaatcgcagacggcgacggtcgcgaattagcaaattcgtggaacattgaccaactacgtaaattctatgtatgagtcaataacaccgtacctgtaagcacccttacagtatcaataaagcctatttctaggtttcatacca

SEQ ID NO: 89065 - DNA, 551 bp, Oryza sativa
tacatgatcttgctcaacttgttgcagaaggggaattccaggcaactaatggtaaattccctatctcagttgaggcttgtcacttgtatatctctcattctgatcatgctcgtgattcaacagtatctttaagcattacatgatcacacatatttacatacatgtatacaaagatgtacacatacaaaaacatttcgagccatgccccaccccgagggaaaaagaattgctgagcacacaaaactggctatctacatgaacatgattgatgagcaaaactagcctagggttagagcattattggaagctatacagatgccacggccacaacacgtgctagcgttggtaaactgccggatcagccgtccacaactccagtacaaagagaacacaagaacgtcttgtggaaacaactgaagcttcgtccgcatacaagcagttctccctcactcacttgttaccctggagtacgaaaagttgcttcagcaagatgggataaaatcagattacaagcacctagaaaacgagagtaactgaagtattacatgaac

SEQ ID NO: 89066 - DNA, 863 bp, Oryza sativa
ccggctgacgatgcaccccgttttatgtctataattctcaacaaatgcaactcctatgaacaatgaagcaaattgttcttattgcaagcgctattggtttacatgtttattactgagtatacattgtctagaaatatgttcattactaagcaacatcagcgtagaagtcttgaattgtgatccggacagcaattgggattcttgcagtgtggtgctcattgtaccaagttaggctgccgaatgtgtagcctccctgcactttccacagaggtgtaatgcaaatcttgaaggcatgcactttcttgctagcattgaagactaggacaggcggttcgatagtcatcttcactccaaggggggattctatagaggattggtaaaccgcatccacctccccgacattagtgactgctcgtcgtacgtttattggatgccttaggtctggtatagatatagaaggcagattcaggtgataggctggcaatgtcgtaatgttacagatctcatatttcttgatctgacaagcgaagaatttgttgtaatcctttggatcgatgtcataaattaggccaggatcagcagctccaataggatttatgttccctcctccataatcgaaagggtcagcaactttccgaggaagcgcttctgctaatatcggcgtgtcatattcgtcctttgttgatgcttttgcatgcaaaaaagagtaattcatggttgagtggatttacctatatagttgtttcatgtggatagcacactcaagtaatttacctgtggtgacaattgctgatttgagagcagcatgagaccaatgaggatgtagagccttaagcaatgcgggtaccgagctcgaattcgcc

SEQ ID NO: 89067 - DNA, 676 bp, Oryza sativa
gtattcacactccactatgattgatggaactgatggtttgggtgttgctgatttggaagttggtgacattgaaacaaccactgattgcacaaacacatcaaatatatgtataagttttatgagtctattagtatatgttctttaggttatttttttttgtactagtcttgtatctgacattctgaattgctgacaaatacatgtatgaaattttaggttttttgctgtgccaaaggaataagatgaagtttctgaaatttgatatccactgacaccctgctgaaatcaaacatggcactattattatagcagcaaccgctgactgctcactcaaacacatcaaatcctcaaacctcagctgcgatgctagctcatgtagcttgagaccgtgtgttctgcatgcagagtactcgagcatattgtaattttggtgcagtactacagtggcatggaaacaatgtgccggcgtcccttagtcatggctctgcccagccaacccgacgaagtggtcatatgcttagtgtgtaaaaattttattgttcgcagtgtttgtgtagtttagcttgtaattcaatgtgataatcgtcagtaaaaactttatctatcgatgtattattgcggtgaaagtttgacctcaatcttttcaccccaataaaatagagtaaataaattactc

SEQ ID NO: 89068 - DNA, 589 bp, Oryza sativa
ctaataaccgccgggaacactttccagcgcacggtccagggcgcacttagcaaccagcttggcaacaatgtcgaggcttacgttgacgacatcgttgtcaagaccaagacaagtgactcattgattgacgacctgcgggaaacgttcgacaacctccgacgatatcgcctcatgctcaattcagagaagtgcacattcggagtaccgtcgggcaagctactcggattccttgtttctggtagaggaatagaggcaaatcccgagaagatcaaagcaatcgagaacatgaagtcgcccacaagactcaaggaggtacaaaagctaaccggatacatggcagcattaagcagattcgtcactaggatgggagaacgaggacagcctttcttcgctttgttgaagaaacaagacaaatttgtatggacacgggaagccgaagaggcatttattgcactcaagcgctacctatcaaacccacctgtactcgttgcttcccaacctaatgaagaattattctttatattgccgtacgccatattccgttagcactgtcattgtagtcgagagagagaaagtacatcgaccagtt

SEQ ID NO: 89069 - DNA, 3277 bp, Oryza sativa
cttacattgtgaaacggaggaagtatttaatttaccggccgtatcatcaagttggccagttgattttgtctgagttgaactgtttagttgattctacaatctgcatgcacatgctaactacgctactagtgaaaaaagaagaaacgattttcttgctgcatggcttgctcacctttgattgatctattgagagaacatgtatttttccatgctaaaggacacttttgttgatttatcttcttgctcgtatgataattgataacaggggtttgccttaatatgccatggtctactcgaatgaagattgctctaggtgctgcaagggggctggaatatcttcacggagctgagagatcaattatatatcgagatttcaaaacatcaaacatcttgttagatgcggtttgtacttcatctactatctgaatactttgatatcattaccctttttcaatcacttgttataggaattccatctcatcaggctctagcaactttgttctttccaacccagacaagattccatttcctacattgttctgaactcttggaatgacagaactaacagttaaccggataacttagcctacatgctagccataaggcccataactgtctttacagaatccaagattctgaagtagtgatagaatagtgtgcttgccctccaaaccgtcatggtggtttcagttgctgccagcatggtcaaagctactaaatcttctgatgaatgaatgattcaattctttcagcagtaagattctaaacatcagcgatctcaataacgtaccagtttggatctggtcccgcttgctcttcaacacagtcctgtttaccactgatatttcgactgaaatctttttaatattctcaatttattagtgtgacacagcaaaaagtatgtaaggacgattacaaatgaaacacttgatcaatcatttatttgtccctggtcctcctccatggttccactttaaatagtagatattatgtgtgccctcatccatccaattaaaccatgcaactctgcacaaggaatactgatctaaatatcttatttcagatcttgggatgttatatgttgacgattatcttatgatactgccgcagtctcactctgtgtcacctctgcaggattataatgccaagctgtcagactttggcctagcacgaactggacctagtggagaccaaacccatgtatcaactcgggtcatgggtacttatggctatgcagctcctgaatatgtcatgacaggtgagcaatggaatctccctgtatttttagaatgccaacccgttcattcttgagtgcatttaatgttcttaagtatgaatatgcatatcattgtagctgacatcatgtatgttaaattgttactctaaccagtttgatctgttacaggccatctgacagcacgaagtgatgtctatggctttggtgtcgtccttctcgagatgatcataggcaggagggctgtggacaagagccggcctagccgtgagcacaacctagttgagtgggcacgtcccctcctcgtgcacaatcggaagctgttcaggattatcgatccaagaatggaagggcagtactccaccaaggctgccattgaggtggcaggccttgcgtaccgatgcttgagccagaatcccaaaggacgacccaccatgagccaggttgttgagacctttgaggctgtgcaaaacatgcctgaatgccaagacatactcttgcagaactgcatgacgggtgcagtgacactctacgaggttgcaaaggaccctacggagagcgtcgagccggagaagataaaacaagaacaaccagcagcaaaaacggtcaccgtggcaccggcaccggtaaatggaaaacccgtgcctcagagcaggagaacacggccagggaatggccggagcaagagcgagccgtctttggaatgcaagctgtacatcccatctccagactctgatggccagcagccaggcctggaggcattgtcatccccttccagagatggaagcataaaggatccaccggacgaggatttgtacaagatataaaagtcacacagaagttttttatgacgattcaagttttcgctaccggcgatttcgcattgccatccatccatcttgttgtcaagatcgatcagagtcaaagttggtgttaaaattttttctgatggcggaagaactctacctcgttaggtttcttgctgttccgactagcaattgtatgtagagaggagcgttgtggaaagcatttgtaatgtgagatgcctgccgcgacgaaaagttcgtgttgtaaacttgaaaccattctctgggaagaggaagatccacatcataatcgatgtgtcagtgttgttgttgctcgagtgtttttgacttttctgtatagatgatgatgtccttgcaaacttggtacagttctacaggaaatcaacaagaagatggaaaaatataagatgaatcagtgtccgtttgttgacagtttgtttttggagtatggttttgttttcactgcccatctggaaattattaggaatgtgagatacaagagtatgcttgaatgacacatcactatcgaggatatatcatctaccactgaaacaataagtaaatgtaaatgcgagcatcccctagtgagttaattccactaaaaaaagaatctaacgaatataaccagttgaggtagctcactttacatctatttattatattataataaggatagttaaaaaaaaaaatcactacattgacggcctataaattatcacatagaataaaattttattacacaaaatatgaaaatagaagctaagaattgtataactccaatgcaacttaaattccttaaatttttactgagactatttggtagggtaatgttgctgcggcgcagctgcagtcacgaaaccttcattgttagcttctaactgcaaccacacgtaattaaagtaaaaaagaaaactgaacaaacactgattcaagcctcttagttttacgagtactactaaatacactgtaggttaagacctaagaaaaaaataatttgaagttgtataagaacccagactttcacttcaatgggctggtttagtttccaactttttcttcaaactttcaacttttccatctgtcggtgatatgggaccgggagtatcatgaccagaggcttgaggcagacgcaatcgcccacgtggcctggcaccttcggggacgtcgggcccgagggctgaggtgtccgccctcctcctgatttcccccgaggggg

SEQ ID NO: 89070 - DNA, 586 bp, Oryza sativa
acaaagtcatcaatgatacaagcaaagttttgaacaaaggaaacccccaagagaatgagaaaagaaagaagagaaaaaattcactctagaagaggaacaaggaattggacgacccttaacaagtccaatgcatgagaactcaaaaacagttctctaattatgctgcaaggtggtgatctaaagagtactattataacttatacatctagagtacttcccaaagccaaggtagggtaattaaccaattaaacacaccgattaaaatgccgagatgagagagagagaaaaggtcccccatatatgttcttgcaccaccacaccgccatggatatgccgcaagaacttcaagctcttctcatgtatctatccccccacaccgtatgccctatatacaaaataagctactacataccacccaaggaaggagatcaagaagccaagaagccaagtagagctagctagctagcaaatcaagtagtagcaacactagctagtgcacttacactttctttgcttctcttctcctcccatgattttgttgatctctccttccttcttggtcatcaatgcatcccaaattgatctt

SEQ ID NO: 89071 - DNA, 1779 bp, Oryza sativa
taagtttaacaaatcagaacgatagcttcgtgtaggaggcacagaaaaatgggctcttttctattaactcgatgtataaatctatcatgtacagggacgtcattccaaaaaatgatatgatctggaaactcaaggtaccgctaaaaattaaaaaaaatttgtggtacttaagaagtggagtaatcctaacaaaagacaatttggtcaagagaaaatggaaaggtagtgttaaatgctgtttttgtgattctaatgaatcaatacaacatcttttctttgattgtcctcttgcacgatttatgtggaatgctgtcttcatttctctctctagcatataacgtaaaagttacagttttgtgataatttctcacgctatcattgtagcaaactgaaacatgtcgctaatgttatagcaaactgatagttttgtcattaaagttgcaattttctgaaatttactctatatatattgcttgtggaagactaaaattttgttatagacgttcgtgctgcgatgaaataatagagttcccttccccttgccaaccctttccctcccctcgcatccatagctagctctccgccgctcgagccagctgtcgggagtccatgcccgccgtcatcgttgccgctctgcccaaggcgcagatccagccggcacgcgcggggctggcggcgccgctcccagtcgcctcctcctcctcctcctcatcatcagtggcggccaccgcgccgcccgccgccggatccactcgggggagggcgggggagggccctgccggcatactactcaagcccgccgctggagctgcgcggggcagggcgagggagccgcggccttcgccattgcccgccgtcgactgcgctgcccaccgcccgttgaccaagccactcgctgccgccgaccgccgtccacgctcgccgcccgccgccgttggccgcaccgcccacactggattgcgagaggagacgagtgagagtgagggagaggtgaggataaggatgaaattttgaagtgatgaggagggaaaagaggagggaggatagacttgtaagcttagtctattagtttcttcttttcagttgtttgttatttatctcagttatgagattaggggtgtatatactcgtgtaacttttagctatatacttgaggccgggattctatccattatctaaaaatatatagagatgcactgcctgtcattttaatcatgagtttaatcgaacattttggtggtgttctttttgttgtaaaccaacgcgcctattagcggatcaccggatctgttccctgtccctcccacaatagtagaggcgtgagatgatgtagaacacccgcgcccatccctttgccctcaagaacattgcagaagtagacaatgaacacagatatagggtggagctctctcttcattatagatctcatctggagtacaagccagccattagccattagatgtcacaccctgcccctgtatatatacattgtgaaacggatggaatatataatagatagatagattatagcacaagtctatatctatatacctaataattaaaaaaatacgtaaggcttttgccttcctttcgtccgtccggcccctctccctcccgcgtacctctgcttctacctccctccctcctagcacccccatttctccccctcccccgcagcctctcttttccctggcgtatgtcctctcctgcctccctccttccctcccggcaccccacacccatctctccctcgctgcacacactccctctctccctcgg

SEQ ID NO: 89072 - DNA, 664 bp, Oryza sativa
tctcatgacaacacacatcacatcacatcattgacacgtgacaaacacccgtctctcctgcacatgtcgccctcgaccaaaaggagaggaaaaaaaaacatggactgcacgaatctcgatgcactaccctacttcggtggcggcgctgccacgtcgacaagcgcgccacggcggcgatcagctcgccggcggcgtcggagccggggccgagcgtgaagaacccgtggtgctcgccggcgaactcggcgagctccaccggcttgcccatggcggacagccgctcggcgtagtcgacggcgcggtcgcgcagcatgtcgaggccgccggcgacgacgaggaccggggggagctcgacgccgtccatggcggggctgtccgggccgaacgggttcgccatcgggtggtccctcgtggcgcccggcggcagcgacagccgccagaaccggtcgaacaggtccaggttgaggaacacctccgccgggcaccccgcctccgacggcgtccggctgacgccgccgaagaacggcattagcaggacgtagcctcggatcgcgaccgggtcgtcgggcgccgccgccgccgccgagccggcgcgcacggcgaggtggtgcgctatggtgccgccggccgagtccccggtgacgaacacgcggccgaagtcggc

SEQ ID NO: 89073 - DNA, 675 bp, Oryza sativa
aaaaggactaaggcagggagacccgttatcaccaattctctttaatttggtggttgacatgttggcaattttgattaaaagggcaaatgacaaggtagctttcatggggtagttccacacctaatagataatggtctatctatcctccaatatgcggatgatacgatcctttttatggaacatgatctagaagaggccaagaatctcaaacttgtactaagtacattcgagagattatcgggtctaaagatcaactttcataaaagtgaattgttttgttatggtaaggctaaggaggtggagaaagattatatcttaatgtttgggtgtgattccgggaagtatccttttaggtacttaggaattccaatgcaccacaaaaaactatcaaacaaagattggttcgcaattgaggaaaggtttcaaaagaagctgagtagttggaaagggaagcatctctcggtaggtggtagacttgtgttgataaattcagtgctcagcagcttggctatgtttatgctctccttttttgaggtacctaaaggtattctcgaaaagctagactattataggtctagattcttttggcaaagtgaagagcataaaaagaagtacaggttggccaaatggagcattttgtgcaaaccaaaggaatgcggcggtctcgggattcaa

SEQ ID NO: 89074 - DNA, 2182 bp, Oryza sativa
  unsure (1)..(2182): unsure at all n locations
ccggcgtcggctatgaatcctattattaaggcatggccgttcagaggttggggaattgatatgatcggcatgataaacccaccatcgagtaaaggacataaatttatattggtggtaactgattatttcaccaagtggtagaggcgattcctttgaagaaagttgattctggggatgnctattcaatttgttcgaagagcattataatctatcgatttggtcttcctcaaactattactacggatcaaggttcaatcttcgtgtccgatgagtttgttcagtttgccgatagcgtgggtatcaagttgttgaattcttcaccttattatgcgcaagctaatgggcaagccgaggcgtctaataaaagtttgatcaagttgattaagcggaaaatttctgattatcctcggcaatggcatacttggttggacgaaacattgtggtcttattggatggcttgtcatggatcgattcaggttcctccttacaaacttgtttatggaaatgaggctgttttgccgtgggaggttagaatcagctctcgacgaacggagttgcaaaacgatttaacagccgatgagtattacaatcttatggctgatgagagggaggattttgttcagtcacgattgcgagcccttgcgtaggttactaagggtaaaggaacgtgttgcccgacattataataagaaagtggtatctaaagattttttggaaggggaacttgtatggaagttgattttgccgattggtacccgtgatagtaaattcggcaagtggtcgccgaattgggaaggaccgttccaaattcataaggctgtgtctaagggggcatatatgttgcaagggcttgatggtgaagtttatgggcgagcgctcaatggcaaatatttgaagaaatattacccaagtgtttgggttaatgcatgatcggctcatattgccgatgcatgatagccgatgtgcttacatcgccttgagatggccgatatggttatatcgcccttatttgtttttcatggtgtaatcggttgtggtttgccgatgtacaatggccgatattgttatatcgcccttagttgttttataattttatcgatgctcttgacattgtaaaactaggggggcatatatatatcaaaatgcgaaatgcaatgcaaaaaatgcgaaatgcaatgcaaaatttttgagcaaatttcaaagtcatattaatcgccacaaaggattgttaagacagtaaagtatcagatgtctcagccgattacaaaaattctaaagtcctattacataaagattattgagataagtatcgctggatggccgatataaccttttgcctaatttgctctacttcttctatggcttgggcatcctgagcatcggttccagggataactttcagaaacttgtcagaacagtaacatgcttgatacccgattggagtctactttcttgtcttcaatagactttggagatcggctagctttttgtgctctatatccagttcagcgttacattcttcaagttgtgctaagagttcaattttgcgagcctcaagccgatcaatgttagacttgattaggccttcagataattgatcaagcttggatttctcttcatgcacaagctgtcggttagcttggatagtggcctcaatatccttgcgctctcgctgttcggccagtcttaacttggctttctccagtttaaattggtgttgctcaaggtaaacggctggagtaaggatgttggctaactcatctgggattagagcctgaatctcatgtagccgagccctgattgagccacaatcaactactaagctatctagtgatgatgcttctagccgatccaagatactttccaaagttttcttcacatcatcagatagaggggctaaggctttgcttgtggtatcttcttctccttcatcaagatagtctctgatgtcaaaagagaaaagatcggctaatacctgcagtgacaatttagaagcagtttgaggttaaacgattatagccgatctgaatgcttttaagacgaaagaaacttactgggatagcaggagcagctggttgttcttcttcctcgacgtgatgactccccacagctgaaggggtctggtcacttgctgattgttgtacaggaggagaaggaggaggtgaaggctggggctgcagga

SEQ ID NO: 89075 - DNA, 1887 bp, Oryza sativa
ttcccggtctacaccacgatgccgatctcgactggcctagcaattaccgggagcgagaacggcgtggttacgaccctggtcgactctatgtcgaaagatcctcccgcagaagcggagaacggaacatcgataacatctgagcctgagaaggatcctagtgcggtcaaatcttgtccttccgacaaaaagcacgagccgacaaggacaacttccgaggacgacacagaagctgagaagataacccgacaagccaagatctattgtatgatcggcaatgatctgtacaaaaaggcgccaaacggagtacttctcaaatgcatctcgtccaatgacggcaaacatctcctcctgaacatacacgaagagatctgtgggtcacacgccggcggatggacgctggtaggaaaagcttttcgacaagggtttttctggccgacaacactcaaagatgcctgcgatatggtgcagcggtgtgaagcctatcaatttcacagcaaacacacaaaattccagcgcaagcgctccagactatccctctcacttggccgttctcgtgctgagggctcgatatactcggaccattcccacgaggacagggtggctacaagttcctattcgtggcgatcgacaagttcactaagtggattgaagcgacgcccacaggggaaattaaggccgacaatgccatcaagtttatcaaagggatgttctgcagatatagattgcctcacctcatcataacaaacaacagctcccagttcatcagtgccgaattccaggattactgcattggattgggagtcaagatttgctttgcctcggtttctcaccctcagagcaatggataggtcgaaagggcaaacggaagagtactacacaggatcaagacccgtgtctacgacagactcatgtcacacgacaagaagtgggtcgaagaactcccctctgttctatgggccgtgcgtaccacaccgacaacatccaataaggagacacccttcttcctcgtgtatggcttagaggccatgctccccacggagctacaacatcagagcacacgagtacataagtactccgacgaggaacaggagcagcgaagcgacgatgtgaatctactcgaggaacatcgagaaagagttgccgttagagcagccagctaccatcaggcccttcgccgataccacgagaagcacatcagagcacgcacactttcgatctgcgattacgtcctccgacgggttcaaagtcaagtagggcgcaacaagctctcacccaagtgggaaggaccatacacaatcacgcaagtcttgcagccaggtgcattcaagattgcagacggcgatggtcgcgagttagtaaattcctggaacattgatcaattacgtaaattttatttacaaatcaatagtctcaaaatttgtaagtcatattacgatttcaataaagttgatttcaggttaagaatattgtcagagtgttccttcccgacgatcccttaccacgacgacacctagagttgaaacctatcctcatgtccctttacgccgtcctggcaaggcctctgaggaacctaagggaacttcagctagggacgcccagagcggataaggccttgtcggatcatgtagagacaaacgaccatgtatgacctggtcatgtaagagttctcgccatgcgtattaaccaagccgtgtaatcggaaattgagttttccaacttcacggctgggggctagggtcagtgcttttttcaaccaaggcaggtcaagggtctaaaagccttgtcctccgagaacgattctccgacaaggctaggggctagggagagtgtatagctcaagtgactgatcgaaatcacaaagtgagaaaacactcatacacaacatgc

SEQ ID NO: 89076 - DNA, 1791 bp, Oryza sativa
caagtatttcttacaagtcataaatacttcaaagtatattacatgcttccttgagatatttttctacataatacaaaaactaccagacggccaacgccaatccatggagcggatctccgcaggaccgtcgatctccgcaggtgtcctccgagaacgcgagaacccttcgcgaaggaactcgagatgcagctgcgaacgatgatctcggatgcaggctagcacatgtcctctggcatagcggctcgctcgacgacactcctgcttcagggcatcgtcgatgcgctggccaatcccttcgagctgtgcgcaagcctcattcaaccacgagatataaccagccgccgactcctcgggatcttcgcggggaactcagagctccatgcaaaccctcgccatcgacgtgcaacagctcctgaggtacgagttgaaccacacctcgtgacccccggagagcttccatggcctggtccttcttcacctgcaccatgatttttttgagttccaccacctcgagtttcgtcttccaatatcggattcgacgagctcggtcagccaacatgttcttgaaatctgcccgacacggaaaagactaagtcaagctattcttctcttccgagaacacagctaattaagtcaatccgaacacaaggagtgaaggagagcaagatacaaacctagcaacgtcatcgccatgtttgcctccgcggacgggccctgactaatttcctcccacagcacgaacggctcgagtgtgagcgccggaacgatcaccggcatatcgggctgcccgtgctgctggacatcctcgacatcaatatatctacaacgacaacaaagtactcagaatcacatgctaaggaaacaagggagacagtgttgacggtcgttatcaaacagtttcgaccgtcaatattatcaaaataggagagaactagtgatgcttgcaatgcatatgtttgttagaataataatattccactagtattaggtatactaacctttttgtagagaatgacactaaagtggaggagaatcgacatcaacatagacgataaatcaatcggacgatgtcgagaaccagacttatgtatgaatgggccaagaactcagaattgacacgatgaattgggccaaaattcacaagtctacaaagtgaagcaatagaggaagtcgccaaccgaagatgggctggtttgggccagcccatggttcagccaaaccagggggttcggtgtcacgtcctgataaattcatcccgaaataaaaattattttctaaaaggaataatagaattaattaaaattcgaaaagaatttggcaaacactaaaatacgtacaagaaaaattcaaatgtggcccggagaatttttgttaaattctccttggtctaaaaagagccctcaaattttagtggaattttcagagcacaaataataattattaagaaataaacaaagttaaaatgattttataaaaagaaaagccctaaaaaagttccctttccctccccctctccctcttgggccggtccggcccagctccctccctctccctctcctctccccgcggcccattcggcctcctctccgcgcgcgcgccgctgacgggcgggcccgcccgccaccctcgctgacgggtggggcccacctgtcatccctgtcctcccgccgctcccgccgcctcgtccgcgccctagcgccgccgccgccgccgaatccgccgcatcccgtcgtccccgcgtgcaatcaataggggggaattattccccgtgatttcctctctctttccccc

SEQ ID NO: 89077 - DNA, 876 bp, Oryza sativa
tcttgcccaattcctcagccgatgggattgtatgaccagtagggagctgaatttgcttttctcggagtagtaaatcaaaaatcttgtaagccttggtgatatcaaagtcatactttttctctttcccaggactttttacccattggcatggtatgacctttttgctcctcacccattcggttgcagctatttcagaatcatcttccttgtcatccgacccatacatgtatggacaaacatgattaactttcttagagcttttcctgacttccgccgacctatgctcatgcaaggttaccttctgtattagatacgataagctatcaaagtctttggacgagaacttctccctgatcggaggaatcataccctggaaggccaaatcggctagttgagcatcagtcaaactcaagctaaagcatttgttcctcatctccctgaatctctgaatgtactcgtgcacgggttcatcatgtcgctgcttgatcactgtcaagtcggtcaacttcatctcatgaaccccactgtagaaatagctatgaaattgcttctccaaatcggcccaactattgatcgacccatatggcaaagaggaaaaccaagtaaaagctgatccagacaaagataaccggagtaacctaactctcagagcgtctacagccaatgcttcaccacactgagcagggaatcggctgatgtgctcataagttgacacgccttcttttcccgaaaacttggagaaatctggaactttaaaccgattggggagagggactctttcaaaccactcaggataaggctgtcgatacaagcttccagtctcttttggtttaagcccaaattgttctctcattacatcggcaatcacattgggcc

SEQ ID NO: 89078 - DNA, 802 bp, Oryza sativa
tttttcacaacggaacctttaacaaggcttgttcgagaatgtgaggctaatcttgagctcctgtttcctatcgaagcagaagtacttgagtctgctagctcctctgctaagttgcaacctcagaatgatgatgcggctagccatgacccagcgtcatctgtcgatgttgaaacctcggacgtgtaccgaagcacactcgcggcaatgaaggcgattcagggcctccgcaaagccagctctacttacaatcccttgtcgctcgccaggttcttccatggagaggacggtgaagcctgctctggagccatcacctctgaaagtgattcctattctgattcccagattgaagatgctgaagatgatgataaagaggtgcaatcaagggagcagaatacggctcaaaatgctgcagaaggccagccacgtgatgaatgatccgtctttgcattgtgctgtttaatcctccgaggccctgataagtgtaaatgatacagctgcggcatacactaataatcttgatccttgaaatgtataaccattactgatcttcccaatggaactcttttcctttttcttttcgctcgtagatatcaaagttggatttatatttactgtgttctttggtttgacagcatattatcaggattttggagttctggatttctgatgttttaggcagagagcaaatgtgagttattagctgacttgggtgaactttatgcaaacccccagtagcattttgacatattctttgtacaaagaaagccacaaagctcccaattctgcagtgtacattcataaa

SEQ ID NO: 89079 - DNA, 2606 bp, Oryza sativa
ccaagagtggaagtttgagcagggttggcatgattggcccatgttgaaagcggctttgttaggggaatttgaggtgcatttgaagtatgttaagatggatgagttattgttgttgactcagacgggttttgtctctgattatcggtcgaagttcaatcagttggtatatcagattcgtctgtatgatcctctgttgtctcccaattttcttattcgtcagtttctgttgggtttaaaggatgaattgcgagttcctgtgcaagctcaacaacccacttcagtcacacaagctttcttagtggctctagcttatgagagtgctttgcctagttctgggagtaagaaatctgtttctaagaagaactttcaggtgggacgaggtggagagaaacagaagttggctcctggtgaattgtggaaggctcagcagttgaaagagtaccggagagcacaaggattatgttttaagtgtggtgataaatatattccaggtcatgtgtgctcaaaacaggaaactcctcagttgaaagctatggagttacaagaggaggcaattgttctgactgatgaacttttggatgctgttactgggttggagttgtctgaagacagtgccaatttgtcgcttcatgctttggccggcacttctcacaccaacattgtccaactcagggctctgtctagcaatcaggtgcttattgttttggttgattctggagttctcatagtttcattaattctgctctgtgtcatcgtttacaccttctgtctgagccaattccacccacttctgtcagagtggctaatggagaagttctggtttgtgatgcaaagatttctcaatttgattggtgggtgcaaggccatcagttttcttttccagtcagggttttacctatggggggctatgatcttgtattgggaatggattggctaactcaatacagccctatgacatgtgattgggctgctaagtggctgcagttttcgtatcagggttctctcatcaagctgcagggaattcagtcttcttctgacttaaccactcctcaagaagctactcctgaacaggttgtgaaatggacaaagggcaatgatgtgtgggccattgcagtgttggaacaatctggtggggtgactatacctgtgtctgaatttcctgagattcagtctttgctatctgaatttgagtctgtttttcagaatgtttctgatttacctccccatagagctttggatcatgctattcctttgctccctaatgccattcctgttaattctcgtccctatagctattctcctgctcagaaagatgaaattgagcgtcaagtgtctgaatgctgtcagctagactgattaccactagttgcagtccttttgcttctcctgtgcttttggtcaaaaagaaagacaattcctggaggttttgtgttgattaccggcgtttgaatgctctcactgtgaagaataagtttcccctccctattggggatgagctgtagatgagttggctggcactaaatatttttctaagttggatcttcgcagtgggtatcatcaaattcgcatgctggagtttgatgagtataagacagcttttaagacacaccatggccattttcaatttagagttatgccctttggactcacaaatgcacctgccacttttcagtgtttaatgaactccatctttgctccattcttgaggaagtttgtgttgcttttcatggatgacattttgatttacagtaaatcttgggaagaccatttacagcatttgaaatgtgtcttgcagttgctgtagcaacatcaattttgtgccaaattatctaagtgtacttttgctgctagtcagttagagtatttgggacatattatatcagctcagggagtggccactgaccctgataaaactcaagtaatgcggcaatggccaattccaacaaactgactgagttaaggggttttttgggtttaacaggctattatcgcaagtttgtgcagaattatgggattttggctaaacctttaactatgttacttcagaaaaatgctaagtttgtgtggactgatcaagctcatcaggcatttttggccttaaaacaggatatggttacagctcctgttttgatatcacctgatttttctaagtcattcaccattgaaactgatgcatgttccactggcattggagctgtgctttctcaggaggggcaccctgtggctttctacagtaaggctttgggagtaaacaatcagaagttatccatctatgagaaggagttcttggctataatgatggctgttgacaaatggagagcatatctgttaaggggaccatttgttattaaaactgatcatcaatccttgtgccatttggatgatcaagttttgggttttgaattacagaggaaggctatgaccaagttaattggtctttagtataggtttcagtataaaaagggagtggacaataagtcagttgatgctttgtctcgggtgggacatttcttttctctccaggctatttctgttgtgcagcctgtgtggatacaagaagtgttgaattcttatgttgtggattctcaggctcaattactgctgat

SEQ ID NO: 89080 - DNA, 574 bp, Oryza sativa
cgtgtgtacatatatatacactcatcagtcatctaaaattgcacaataatgtgcctgtatatatgtacatgtagttctacgaccatttcttcgattgggggttaaaggagcagatcgcggcgctggtggcggtgaggcagcggaacggcgtgacggcgacgagctcgctcaagatcatgctgcacgacgccgacgcctacgtcgccgagatcgacggcaaggtggtgatgaagatcggctcccgctacgacgtctccagcctcatcccgcccggcttccacctcgccgcccacggcaacggctacgccgtctgggagaaaatcgccgccgccgccgccgccgccgatcatcgcacctcttccagcgcatcgctctgattgattagcgatatgatgcttgtgtgccacctcttatgttttacttctgctgtatatggaacaggctcttctacctttaaaggtacgtactttcgtcactgatatgtgggatcgataaaccatgggtctaactgttagtgataaagccatgatgactttgaagatataggatttcaatccctgtatatagataagta

SEQ ID NO: 89081 - DNA, 1381 bp, Oryza sativa
aaatttggggaaatccattttgggagaccactgtctacgcggcgcatactctccaacctcaggtgcagaagtagtaacaggaacacgtgatacctgctcacgaggggaatcaccatgaggtggtggtgttgccgacgtagacgcaccagaagtagcagtcggggtcggcaacagcggcggcggattttgaggtggagttggcagagaagactccggagccgcagctgcggtcgccttgagtgcacgcgccaacatcgtctgctcctgctgaacctggccaagagaagtcatggagagatccactttggtttgaacacgatccagacgttccccttgttgcgccaacttgttgtcaatcagatgaagacgcttgccgatgtcctcaatggtgttcaccttcaccaacaactccttcaggacctccataacccgctcctccatggacgccatggccgccaccatctggcgaacttgagcactgggctttgcgggtgccgtgacgaatctcgcggaaacccgatcgaaccaaacacgagaattactgcagtttaccggaaagcaaaccacaaactcagtgccggaatcaccgatcaagaattaaccgacggagaggaagcacccgggatcaaaagcgactaataccaagttgttgtgacccaaatctacggcggaatccctcgccggaagttcgccggagatctagaagagaagaggcgagaagaacagggtagaaaggggaaacacgaggaagcagttggggaggaggatatttttcatttctttcatgaattgttttctcaatacagctggagtatatatactcacgcactccacccctcttgcccttagggcccaccttgtcatagacacttctatctataaagagtagaagatgtattcacttctgaaaagcgtcaatgtagaaaacgccttcaccctgttgctcgccattgctgacacactgatcgcttcacgcatcagtcgtgacaggaggacactaggccgtgggccatctcggctcccgactagccactagatctaggggtcggacggctaggcagtggggataggattaatatgattttttaaaaaacaattttcctatagactttttttataaaaaaatacaccgtttaactatatggaaaccgtgcgtacgaaaaacggtttcgttttgaaacttatgacatgtttcattaaaaatgtgataaatcgagataacaactaatttgctctataaaaaccacacaaaaaaaaggaatctttttaggcggatggaatcaattctactcctgttcttttacttctgtacagaaaccggtaactggaagaagtaaaacccaggcaaggcagagagccagcgaaagcggcaaaagcatcg

SEQ ID NO: 89082 - DNA, 728 bp, Oryza sativa
tagtctctgatttgatctcaccagcgatgttcaattgttgcgactgtccttgaccagcggaagaagattcaccaatttggagtggcctgatatgctgcctctggctactaccttgtgcctcctggaatacagtcattctccgtttacggttatccatcctgttcttcttgtcttcaagtcgaattgctttgtcaaccagctgctgaaaatcaacatagtcatgggagatcaatgtaactgacagttcatccttcaggccttccaggaacttctcctgcctttcttcgtcagtacgcacatcttctggagcataacgtgccagatctattcgaagttcaaatggataaaaaaactaacttcttcgtacataattgtaacatcttacgcagacatatcgtccaatgtgcaacttcatcgagtgggtagacatggagaacccacaaaacgacggaacccgtgcttacccacgtagtgaaacaagatcggactacctaaggtggaaggatgagcatgaacgtcgaattgctgctgaggctttagaatggcacgtaaatcccctaagactccccacgtggcgtgagcgtccggagtgtcgttgtggtgaccgttgtcaggtcataaggtccgtaaggcaccgaactcgaggacaaaggtgtttcgtgtgtccaaacattgtcgacgatgatttcgtggtaataacaactattcttttcatcactcctcagtac

SEQ ID NO: 89083 - DNA, 2144 bp, Oryza sativa
ccgccgcatttggtcaagatgtcaccggagatgccctccaggcttcgggtactccgacgggcaatgctccttctgaacaccgtcttgaagaacagctctctggactgatcgtttgcagacatccatgaagtgaacgcgatcgccgggaagcgagcagcagctctcatcaacctgacggttccttgtagtgattattattcgactatgcttgtcattgtcgggaaaggctggcttcaagcttgcccagtcctccagactccataagtcgtcaacaacaataaagtatctgcacatgaaaaggaatgcattacatattcatacttaatacttataatattgtgatttttacggtttctgaagagatcctgaaaggcaccttctttgtctgatgttagttaatttatagcacctccagatttcttaacactagcaagataccgatggaaaccaaatctacactaggaattgtgtgatatctcctactagttgctcatggatagtaaaagattctcaaaatatttgacaaagttctgacatcccctaagtgattagaatccaacctcctaataactactataatagttttcgacgactatttcctcatctaaactactacttcctccatttcaaaatgtttgacaccgttgatattttagcacatgtttgaccgttcgtcttattaaaaaaaattgtgaaatatataaaactatatgttcacatgaaagtatatttaacaatgaatcaaatgatatgaaaagaataaataattacttaaattttttgaataagacgaatggtcaaacacgtattaaaaagtcaacggtgttaaacattttgaaacggagggagtataagatagagggtgtatgcgttatcaaaatttgaaaagatgaaactgtctgaatgtaattttggcaacaaaacaatcaaccaaccaaaagcattttcagttgaaaattaagtaggcagagacagagacaataatatacctcttgtcgctcagatgagtactgcaatgggcgaggagttggggaatgtccttggtttcgatgcctctgagtatttcatccttttccatggccatgatctccttcctggagcagcgtggatctcgcgccggcgcgaacagctgctccagcagcgactccagcatggcgcgaaggttgcagctccgggtcaccgtcacgaacgccctgtgatggatcccctgcaccgccgggctcttgtacaccatcgccgccagcgtcgtcttgcccaggccgccgaagccgacgacggcgaccaccttccggcgagccaagccgtcgtcgtcgccgtcgtccttgtgttccagcagcttgaggatggctctggtcttgctgcggacgccgacgaggcgggactcgtcgacgctgagcgccggaaggcgacggtcgaggtcgtcgtagcagcggggcgcgtactcgccggagctcgacgccgcggcgggcggctccagcctgtacctgagcctccgctcgctgaccttgagcgcgcgggccttgaggctctggacctccacggccagcttgtacatcgcccgcagcgtcgtcagcggccggagcgccgtcctgcgcagccagccggcgacgacgaggaggccctcgtcgtggttccggtcgccgccgacgtggtaccggaaactgtcgatgcagtcctccgcgtcgtacgccacctccctcacctgcttcatccacgtcctagtctgcaacccaaaaaaaacctatgattcatcatttcaagaacacgaagaaccaattgcgttgtataaaaaaactcttttctttttctaatatgttgacgtgcaatactttttagcgttcgcgaaaaagaaaaaacaaggcgcgacgccacggcgaggggctgacctgctgggactggtggtagtcgccgacggcggcgaggtcgcggaggcaggcgttcatgctctcgaggtcgtccttgagctcctggatctcgtggcggacgccgctgaggaggacgtacttgtcggagaggaattcgccgagcttggccaggaggatgcgcaccacgccctcggtcgagctcaccacggcggcttccatggtcaattgccgcagctaccgcaacccgagtgtagagtcaatcagctggcctcttcgaat

SEQ ID NO: 89084 - DNA, 628 bp, Oryza sativa
ctatagggcgaattcgagctcggtaccggtggttcgtggcttttactctgattttcacagtggcgggaggaccagccgagaagatattatcttgcttttcgcctgtgcctgtacacatatacgtaagcattacggcaccttttccccggttcgcggcagcgcgaggcgaggggcgaggcggtcgcgacgcgccaaagcaacgagacaaacgggaaaaatactgcgtgcctagtacagggggggagcacgccgaatcttgtcgtatttttccccccattttttttccccgtgcggcccgtgcgttgcgttgccgtgcagctcacatgcggcgctgagccgatgcatcgcgcgcgacagctaagcttatcaaagctgccgcgccctgtacggcgcccatgcatgccatgcatgggccatggccacaccaccggccttggcccccttgctcccgcgattttttttcaaaccctgcaaagcgcagctgtttgtggccgcgtgtcaatggcgcctggctgaccggtcggttttcttctttttgtgtgtgtggttttgcgtgcaggggtgcgacgcgtcgatcttgctggacaacgccgggagcgagaagacggcggggccgaacctatcggtg

SEQ ID NO: 89085 - DNA, 1160 bp, Oryza sativa
cccagtcctttagactccatacatcatcaacaactacaaagtacctgcacaataaaaagagaccatcacacatcgtccatgcttataaaaacactagctaagctaatccttccttaaaaaaccaagcctccgacaactacatcctctcaaatccgaactacaagaagcatatccacacaactggcaagtacattttaatttacaactttcgatggtaatcaataacaatggtttgcatctttcttttcttttcttttcttttcatctaagcgaccacatatgttcttttgaattttaaattatatataactatttattaaaattttataaaaagaatataactatttcaaagcaaatttgatggcaaattaaccacatgattgctatttggtgcacgtgtgttttactagcgtacactttttcatataaaagtttttctatgaaagttttagataaaaatttgtttttcgaataaagtttttgagataaaagtttttagggaaaaaaaagtgtgtgctaggaaacgcacacgcgtacgtgatgcgtcaaatagcagtacccaattaaccaagcaatagaatttcagttttggtgagcaacatgcgtgccaagtagtaagtacctcttgtctctcaaatgagtgctgcaatgggcgaggagttggggaatgtccttggtttcgatgcctctgagtattcgtcgtgatccgtggtcgtcttcttcgtggagcagcgtgaatctcgcattggcgcgaagagctgctccaccaacgattccagcagagctcgaaggttgcagctccgggtcaccgtcacgaatgccctgtgctggatgccccgcaccgcggggctcttgtacaccatcgccgccagcgtcgtcttgcctaggccggcgaagccgacgatggacaccacctttcggcgggccgagccgtcgtcgtcgccgaccatgtccagcagcttgaggacggctctggtcttgctgcggacgccgacgagactcgtcgacgcttagtgccggaagacggcggtcgaggtcgtcgtagcagcggggcgcgtactcgccggagctcgacgccgcggcgggcggtttcagcttgtaacgcagccttcgctcgctgaccatgagcgcgcgggccttgaggctctggaccttcacgg

SEQ ID NO: 89086 - DNA, 600 bp, Oryza sativa
caccctcagagtaacggataggtcgagagagcaaacggtatagtactacaagggattaagactggtgtctacgactggctcatgtcacatgataagaagtgggtcgaagaactcccctctgtactatgggccgtgcgcaccacaccaacaacgtccaacaaggagacacccttcttcctcgtgtacggctcggaggccatgctccctaccgtgttacgacatcagagtacacgagtacagaagtactccgacgaggatcaggaggaacagcgaaacgacgacgtgaacctactcgaagaacatcgagaacgggttgccctcagagcagctagctaccaacaggccctacgccgatatcacgagaaacgcatccgagcacgcatactttcgttcggcgactacgtcctccgacaagttcaaagccaagcagggcgaaacaaactctcgcccaaatgggaaggaccgtacacgatcacacaagtcttgcggccgggcgcattcaagattgcagacggcgatagtcgtgagttagcaaattcgtggaacattgaccaattgcgtaaattctatgtataagtcaatagtgtccatatttgtaag

SEQ ID NO: 89087 - DNA, 547 bp, Oryza sativa
aacaccctcgactcgtatacctatctcgtctgcaaactaccttcgcttcaaccaattctttcgtaccctcagctctactcacgttagcttcggctatttcaagtgcctgttgagcttcttccggatcaatgtcactacccagttccgcatcatttcctaaaatgatgatctcattattaactattctggcaaaactgctccacagaaccgccgttaaccatttatcgttgaggaggcgtattctcaagggacccatatctacagctgtgttaatgggggcgtggtttggtaatacgccaatttggccactattagtagataaaatgatttctttcacttcacaattccaaataattcgcttaggagtcagtacataaagatttaatttcatttcttcaatttgttctcctcttctaagtttatagctttcgtgctagcttcatcgatgttacccaccaaataaaaagcctgttcgggtaggccgtctaattctccggaaaggattagttgaaatcccctaatagtttctgcaagaccaacatacttt

SEQ ID NO: 89088 - DNA, 1913 bp, Oryza sativa
ttcgtttcttttattatttttttgaaacctttcattttgaaaacaaatatctaaaataaaaatttccaaaatctgaacatttgacgtggcaaaataatactatcacgccactcgcaaaggacgtggcgattttattctgccacaccagctaaaatgacgtggcttgtagagtgatgtcaataacgttgtcacgccatttaaaccgatgtgatcgcgttgttttagtaaaaagatacaaatctagaaaatactacctccgtcttatagtagttatcgttttgattttttccttacaacgtttgatcattcgttttatttgaaaaatgtgtacaaatataaaaaggataagtaatacttaaataataaagtaagtcataaataaaataaataataattttatttttttaataagacgaatgattaaattttttaaacaaaaaactcaaagcagacaagtagtaagtattaagagttaaaaaaagttctgaaaataaaagaattcactttcctcttctctccggataacggcatgcgtggcactgtaccacactaaccccccctggaccatccgctcctgggtcgctgaaacgatggcacgtctgcgccggtgtcgcttgcgcaaccagaattaattgcctcctcctcctcctagcgacaaagtgaggggtggccaagttactatcaggtgagtgacactaacaaccccagctgcggtaagaaacaaaaacatgcttcaacatatttagagagaaaccgagagtgcatgcttaaaaggagataattaacccctttttttctctaaacaaacatgcttcagcatatgtagagatagaccgagagagcctgcttgaatggaggtaattaacttcttttttttcttttgccatttcgaaagggtgagtggcaacaaatatcactttgtaacaagagaggcaaatagttttaaaaaatatttttgacaaaggcaaatagttaaatttgctgcttaaaaggcagttgtacgattataagccatagacatgtgatcgaagtagcggaaggggacaaaatttacgcttataaaccgaagatagtttgtttaagacatcgattaaacatttttatacttgatgatattttttaataccgattgtaaagcacttggttttcataaaaccgctagaagcagtttatgaaaaaccaaacggttttagctattcttcttcttactgaattaaccgaaagtcgttggttttacgggctgctttcgatgcttttctgtaaaccaacatagactggttttgacatcagaaaatagtgctctcactgatgtaaaacgtggattttggtagatgtgcggtttaatgtggtggtcggtttcggcatagctttcaccacgtccctctcactctcttgtgcagtgaccaaccagggagtggtacagttgcagctgctgctgctctgcacaatctcgtcgtgttcgaattcttttctttaatccttttctctcgtccttttaatttcaggacgccacgtattggtcgctgatgctggtacaaatgaccaaatcgtagggtttttttgaaaagcaaatgaggagaggattattgtaattgatcacgtcgttagtcaaaaggacactaaataaagaagccaatcaaggacgatcgctgcaccaaacctaaaatgtttacccggtgattgtgatgagagcgaccaatcggcgagagttatggcaattgtttgagcaatcagacgatcggcaatggcatgtcatgtgatctttacggaagatgataaacgttgcatcattctcattgtccccaagctagcattcataattgatatatattcaaacataagaaactgtcaccatctccaattagaactgcagctctttattatactactacacagcatttagggataaaaag

SEQ ID NO: 89089 - DNA, 587 bp, Oryza sativa
cttcctaaatgtacctgcttctgtaagttaagcagtgtaagtatctcattccgtagttcaagatgctcgacgcaaactgctttcgtcgggaccttgggcttcaaattcacctacagagaaacaatgcatacaatttcatgtatctaattgtgttattaaattataaaagaaaatgcactgcaaacctactagacccaaaaagaacttgaacaacatcagttcggtgcatatcaagtacagattgatgtctaggaaacaaaccccgaggtcttgtaaagtctggtcaacccttttgataactctaaggcccgccgaggcacttgctgcttggaccatttgatcaagcgcttgggttctcaaatacactcgaagctgtaaaagaatgtatagcgagtaaaaaacatctaaaaagaacagtgtgaagagtgatataccaattttcatgtgattcataggcatccacagttaatgagaacaagaccgctagtaatataattaacataaggtctgcttgtgatgagttcggcacaatcctataacagccacctcccatgcaatgagcaagaaaacttacactatctttgttt

SEQ ID NO: 89090 - DNA, 699 bp, Oryza sativa
aacagtagtttctgcagtacaccaggaaagcaacttctagtttctagaacttaaatttccagaacatagacgagtgagaatcatccacagcatagcgcaaggtatcacattcatgacctaaatggcaatatctcccaagctctgctgtcaacaaagtcagcatatccttgtaacgtgattgtttctgctgaagcacacgaatgtatgcagttaaaccaagccaaatggtttcttttcgcctaagcttcagaactggacgcacattatagtgcagctccacatcttgcatccgtctgacaattaggctatgcatgtatctgcttaacagcaaagtataattattaagaaagacacatgatttccaatatatcgcatgatttcaaagcatgttcttctacgccatacatcttaaaagaataaacctgataattacttcataggttttagtaggattaaaaaaagggtataattcaggtacctgaaggttctcttaattacttgcagcagttctaatttgcttacgttggcatcggaaacgcttcgaatataacagtggaacttcattgcacataacaggaaggcttgataaatatttactcttatggtaccaggtgaattgatattggagtcatagaaaatgggatggcattttggacgcatataatggcatagcttgctgtggatatactttgttgaaga

SEQ ID NO: 89091 - DNA, 514 bp, Oryza sativa
aaaatcctcttattctaattcatgacaagaaaatctcaacgatgaattcacttcttccagttttagaaatgtctatcaaggtgattatgtcccataatgtctcagcttcttttgaatatggcaatggtaaattggtttagtactaaccagtgtctcatgtatgcagaatcgtaggcctcttctcatcattgctgaggatgttgagggagaagctctatcaatgcttgttctgaacaagcatcgtgctggattaaaggtgatattaactactggtcctactgtatacaatactgaattgcgtatacaagctgcttgatgatatgtgtccgttgttagttaaagtgcaagcttcttaccttcttcaagctagagctatggatcgttgatattctggtaaattagtaattatcatgcatcgattatagatatgtgctgtcaaagctcctggatttggtgaaaacagaagagccaatctggatgacgtggctgtgttgacaggaggagaggtcagtca

SEQ ID NO: 89092 - DNA, 732 bp, Oryza sativa
ccggcgcactctcaatttacaatggtcacaatgacatatgaagctcgactctggaacctgaaactatttgttgaacactactctagatgtgagtcagtcagagagatagttgttgtctggaacaaaggcaaccatcctaccagcgacgcctttgattcaacagtccctgtcagaatacgtgtggaagaaatcaactcccttaacaaccgatttaggggtgaccctttgataaagacaagggctgtcctggaactggatgatgatatcatgatgacttgcagtgatgtagagaaaggattcaaggtatggagagaacaccctgagaggatggtgggcttttaccctcgaatgatagacggtgatcctttgcagtacaggaatgagcgatatgctcggggcaagaagggctacaatttgatcctcacaggtgctgctttcatggacagtgagttcgctttcagtaaatactggagtcaagaagctaaggaaggcagagactatgtccacaagaacttcaactgcgaggacttgctcatgaattttctgtatgcaaatgcaagctcttcgaggactgtggagtatgttcaccctgcttgggctatcgacacttccaagctttcttcagttgctattagccgagacacgcagaagcactatgacatcagaacgaaatgcttggcgaagttcgcctccatatatggccctctcccccagaaatggctatttggcatg

SEQ ID NO: 89093 - DNA, 915 bp, Oryza sativa
gggagatcgctgatttgcgaatcggaaccagttatttttgcgcggcaaagccaattttgttggtccttcatacactacgcagcaaccaaaccaacactacaaatccctagtagagaagagagacgtactacatagatgaactagtattagacgaagttctggacttctggtttactaggaacatagaaaacatcagatggaggatgagttacaaacatgggagttaaaattgaaatgacacgtgcaggaggtcttgttgatgaatggcacaatcgaacttatttcttctttccgccggctccctttgttttcttgttagcgactgctttggttggtttttctgaagtgtcctgccattatatcatagaaacaaatcatgagacataatattgctacaaaaatataattatggccacaacatttgcaagcctacatatagtatagcactatggttgcagttttacatggaacagtacaagatctgcgagaaaatcatgccaaacaaggctataaccttctcatagtagaaggattttagcatggcttacaagattcagctttggctattgtatctgcctacttctggctgcttgcaaatatattgttgagtactggtctaatggacatatttttatcattcatctgtgatctgttatttggcaggtacattggacaatcaaaacatcaaaccacgtgattcaacattgttagttgaatggacagataaagtacgcaattcaatgacatgaattggttgtatatcatgctacaatggatgaacctggagaaggctaaaagttctaaatttaagcacgacaagattgatggcattcaggttaaggtacctttcttttcagaggcactgatgtgctaacaactggcttgaagaaggattcgagcctggtcacattaatt

SEQ ID NO: 89094 - DNA, 805 bp, Oryza sativa
agccttcctctaatagactctacaggggtgatgatggagtctcattcatgccatggagtggtttgctaataaattgtgaaactttggaaattcaagctgattatacgaggtatgactgttgaaatttgtttttagctcattggtcattctatatttgttaaatataaatatcaaagggcatagtatcaattactagttatcttttgtaatcctgaggcataaattgaccttaagacatctgcaaactgtttttttcctttactattcaatgaaacgccagaaaattatattggctaaatatttgtgaaaaattgacttggacgatgtgtttccttttagtctttatttctttttgggagactcaaaggttgttgaaatgttaaccttagatatgtgcagcctaataccaacctggtttctatccactttctgaatcttgctttcttagtgagcaagaaaccgtagttacatttttcttgttttaggcattaatgtttgaggagtgcgagaaataactttcctaaccaagtgtggagaaatagtaacgaatgggtgcttttcttaaacaggtatttagatatcaccattatctccaccatcactgttaagatgcattcttcaacaaagtatatccacagcaagctatgccattatatgcgtccaaaatgccatcccattttctatgactccaatatcaattcacctggtaccataagagtaaatatttatcaagccttcctgttatgtgcaatgaagttccactgttatattcgaagcgtttccgatgccaacgtaagcaaattag

SEQ ID NO: 89095 - DNA, 1036 bp, Oryza sativa
cttatgtgttacggctcatcacagctgcatcttgcattatcaatttaactcagatagggcaaaacctgggttattaaaaagcaaatacctaaaatctaacttgcaattcattgtcaaatacctgaattttcagaaaaggttgtatcaactgctgctaaaactggtgttttaagtatcaaaatgttccatttgaaaatctgaaggttttcacagatcaggcacttcaacatatcaaaaaggcatgatgccagtataagacgctcagaagccaagtgtaacaagagtatttcatcaaagaaccaattgatcggttggccttcttatgtgttacggcttatcacagcagcagttagaattagcaatgtaacaaaaacagggaaaaaaagatggttctgaaaacgaaaaacaggaattctcacaaactaacttgcagttcattgacacctaactgtttttttaacagcaagttataccaacttctgtaaaaaacattgtatgagttttaattgttccgtatgaagatctcacagttccatcctaacgtctgaaccccacaaatgagagccacttcaacatatcaagacaatacaaaatgctcagaagccaagcgtaacaagagtatttcattgaagaaccaattgatcggttggcctccttatgtgttacggctcatcacagcagtaaataagaaaagagtaatgaagccaaaatataggatgctttatgttcatagcagtgcatttaaagcttctagcatcgcaaggcataacaaggacaagaagctatgcaaagaagtagtttcacgtgctaatacctggttcttgacagccttagccattttgcggaactccttgcgcatcacagactgtggtagagcttcgctggggcattctgcttcttggtcttggttgtggagaggaccacggccgcgtccttcacgcctgatggctggatcgtcacggtcttgttgttcgccaagccttacaaaacacatcatcacccaagtcagcactttgcatatgctgaatgaaatgct

SEQ ID NO: 89096 - DNA, 1544 bp, Oryza sativa
accccattgataccatggttcaagtacagtggataattgcagatatactgatcataacagaagtctccatgcattgtatacacaaaatactccctccgtcccataatataaaagattttaagtttttacttgcaacgtttgaccactcgtcttatttaattttttttaaaattattatttattttatttgtgacttattttattatctaccgtactttaagtataacttttcgttttttatatttgcaaaacaaatttgaataaaacgaatggtcaaacattgcaatcaaaaacttaaaatctcttatattgtgggacggagggagtacttcctatccagtcaatgtcgcccacttgacactttggcagcaagtgtgcctgagcatttcagcttttggattggtaatagtacatgatctgttccaacagcaaagcaaaaacaagcttcgtctttgcctgcacgggaaatgcattgcatcttaattagcaatagctcaaagaaagcaaccaccccagcacaaactacaagctcatggaataagccctcggaagggaaagggatttggcgcaaattaagcagcagcgcgaggaacagcagtacaaagccaagggaggccgcagtaacttttacaacagcactggtgctgaggagttgaggtatgtacaaagccactgtacacaccttcatacaccggaaaaatggggattgcagatagcaaggggtggaaccgcagctcacgatattcaccatgtcaagtgaacaagattgaaatcaggaagcctttctccggccggtgccgctaggacttctggggctcatttgcttatcctgtgccatcagagaactggtgccactagtcccatgatacatcaagcgacgaggagaatcatttctcatgctctggttctctgcctcaagttgtttagcctcctccattagcatagataactgttcacagaaccaagtagccattagtggcaactccctttaagagcagtgtaataagatgcaggctccactcacccgaagttcattttccttcagacgatcctgaagtacagttatagcagggctcaaactagaatagcagaatgcaagataagttagcagagggctgcacataaataaacatatcagccaattaacagacagagattgtgctactaaccaatattccattaatttgcagagagatgagttgtatgtagatgcatggtgaatagatgtaagtgggtggatcttcccatcactgcaaaagaaccatacaagatgtgcattttaccacataataaacacgtagtactatataaggcaaagtaagtaactttagttaccgaatattttgatgcatggcttgattatatgctgatttttcctcttcgaaaacgacatgttgcatatcacagtaagaagttaatgtggtgtccagctttagcagatgcctggtcggaaatacataaagtggcacctcctttcttacatattctgcaccactattggcaacacattctagttagaagttaatatatgattatattgcacc

SEQ ID NO: 89097 - DNA, 606 bp, Oryza sativa
  unsure (1)..(606): unsure at all n locations
cgcgggggnnnnnnntttgtttatagacatactcaagctatgcactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgctttt

SEQ ID NO: 89098 - DNA, 520 bp, Oryza sativa
atagattaactgcaaaagcaatatcaggtcttgtgcaattggctagatacattagtgctccaatggcgcttaagtagggaacttcaggtcccaacatttcctcatcatctttcttgggtttaaatgggtctttatccgcttccagggatcggaccaccatgggggttttcaatggatgacatttatccatattgaacttaccaaggaccctcttggtataggtagactggtgcatgaacactccttcagggaggtgctcgagctgcaggcccaagaagaacttggttttcccgaagtccttcatctcaaactcggtcttaagataagccattgcttctttaatgtcctctgtggtgccaatgatattaagatcatcgacatagaccaagatgatacaaaatccattcagggattttataaacacacagggacaatcatcgttgtttaagtaacctctcttcaggagatagttacttaaccgattgaaccacatccttccggattgtttcaatccgtataa

SEQ ID NO: 89099 - DNA, 560 bp, Oryza sativa
  unsure (1)..(560): unsure at all n locations
acgactgttntnttctgactgctacgcatatccgnctnnnnnnnnnnnnnnnnnnnnnnnnnnnnnnnnnnnnnnnnnnattaatcagatcatgtgcgtcttcttcacttgtgccagctgcaaagccatcaatagcatcgacattgattttggggtacagagacttggtcattgccaatgccatgcttgctcccatatttccagcctccttgatatttttgaagtacacatctagagcagtccttaacttatcaaaaatttctactgtgtccaaggagctcgtaccactattgctcaaatacatggcctagataattggggtagcagtgttggcaacttcgcctctagcttttttagcaacttcgactttgttgatcaagaagtcgaattgtgcctttgtcttccccttatgatctgcatacaacaccaatcaaggaatttagatgcaacagtattggctaaatttcatttatagttagtcagaagagttaccttcaaattctttgaccgccaaatctttctccttgggtagagcagcttcgtcttctaaggctttgatt

SEQ ID NO: 89100 - DNA, 626 bp, Oryza sativa
ccggcgaatctggttgttatgtttctttaccccctcgacgtgcggcggctcgtcgctgggcgtgtagatgccggcgctgctgacgaagaggaattgcgccacgccggccgccttcgcccagtccaccaccggcctgcgggaacgcgtcgaacaccttggtcatgacgcctgcttgctcggagcgaggggggagaataatcgagggaggcgacgtacttgacggcgtcgaggtccttgccgttgttgtcgaggacgacgtcgaacgaggcgccgccgccgaccgccgcgccgacgtccgccgggtcgccccacaccgtcgtcgccccggcactcgtcagctcctgcattattaattgcatccattcattcaccatcgccgccgtgagccctcgaacccccataatgttacctaccgagaagcgggagaagggcggcttcttcatcttgtcggagccctcgtcgccgacggtgagcacggtgacggcgtggcccgcggcgagcaggtccttggcgaggtagaacccgatcacggcgtgcccgccgccattcgtgttcacgatcagcacgctcttattgcccgcccccgccgcctcctgcgcgcgcacggtcaccgcgcccacccttct

SEQ ID NO: 89101 - DNA, 588 bp, Oryza sativa
gcaaattacaagtacaaggaaaattactttttctcatctggagttgacaaaaatttaaataaatgtcattcagtgctggagaaaaaaaaaatcatatgatcatctaaacagatgcagaaaaagcatttgacacaagtcaacattcttataaaaactttcaacaaattaggtatagcaggaatacttctcaatataataaaggttatatatgacaagaccacagcttacatcatacccaatgatgaaaagctgaaggctctttcctttaagaccataaacaagacagggatgctcactctcaccactgctattcatcttagtgctggaggtcccagccggagcaattagacaagaaaaagaaaatgcattcaaattggaaaggaagttatgaaactgtctctgttttcacatgacatatatcttatatacagaaaattctaaagactctaaaaagactgttaaaactaacaaatgaattccgtaaagttgcaggatacaaaatcaacatgcaaaaatcagttgtttttctacacactaacaaggaactatccaaaaaagaaatttagaaaaccatactatttacaatag

SEQ ID NO: 89102 - DNA, 807 bp, Oryza sativa
acaaatcggagggggcaaaaaggttaacaacttcatcccccaatgttttttttgtcatattacatttggagctatgttttgcacaattttttgtctctaaaatttagttgtagttgatgagagagaaaatttgtgtggggaagaaagaatatatagaaatttagtttatttgctaaagaaggttttataaaatagttgagaaggaaaatatagtgaaagttaatcttaaataatagaaaacaagctaaaatgaaaattaaaagaagtacaacacattaatattagtttaaactttagaaatagtaaataagaattatttggtgtaatattttataatttttgtatgaataatgatatgtcattattgtatgactgttgaaagagtttgttattattttataattattgtatgactgtcattattgtacgaataattatttgtgtacgattttttccatctcatgtagatggatcggcaatggatgtacgctgaccggtggtccaaagagtttattgacggcgtgcattattttttgagagtggccgaagctaacaggcataagggttttatttgttgtccatgcaataagtgtaagaatcagaaggagtattctgcatctaggactattcatttccacttgtttgagtcggggttcatgctaagctataactgttggacatcccacggagagtaaggggttgaaatgcaagaagatgaagtggaagtcgacaatattcaggatattggtcagtacgctggatttgaaggaaatcaaacgggcgaggaggaaagggatgctgatggta

SEQ ID NO: 89103 - DNA, 867 bp, Oryza sativa
gcaaaaccctggttagagttcgtcttgagcgaaatcaacttgaaggagatatctccgagatgggccttcatccaaaccttgtctatattgacatgagctcaaataaactatatggacaattatctcatcgctggggtgagtgcgccaaacttaccactctacgtgcatcaaataatcgtattactggagtcataccatcgagcatggggaaattgtctcagttagggagacttgatgtttcatcgaatgaaattgaaggacacattccaccagaaattggtaacgtagtgtctctattcaatttgagccttgcaaacaacatgctccagggaaccataccaaaggaagtaggttctctacaaaatttggagtatttagacttgtcatcaaacaacctaagtggacagatacatggatcgattgagaactgtttgaaacttagattactaaggctaggccataatcgcctcgatggaagcattcctgttaaactagggatgttggtaagcctccaagaattgttggatctaagtgacaattcattttctgggatcataccaagtcagctgggtgctttgagcatgctcgaagctctgaatctttcacacaacacactgaacggcagcataccatcatcatttcagggtatgatcagtctctcatccctggatgtatcatataataatttggaagggccagtgccacatattaacttcttggaagaagctccgattgagtggttcatgcacaataaaaagttgtgtggtacagtcaaagctttacccccttgcgaccttaatcagaaaggtggccagggaaagaaattcaaatccattttacttggtatagttggtgctgctggcatgt

SEQ ID NO: 89104 - DNA, 637 bp, Oryza sativa
gctccagagcttaccaggtattgatcggacatgctgcatatactaaaagggagttggggttttttaaatttccaaaaaactgggccccctttttttggggtttgcctcagacctatttaacgcaggaattgagctttacagggagagattagtaagagctctcgcacacgagttgcaggtgccgctgctggtcctggacagcagcgttctagctccatatgtaagatactgcacctttatacctatcaaatatataagagtggctgcgaacttaatgtaactcctaacttgtaggattatggggatgactattcagaaagtgacgaagaggatgaacatgatgagtcagaggacgaggaatctgatattgaatatgaaggtgatgaagattggacaagcaatggtgaggctataaccgatgaaagtgacgatgaggatgctctgaaatccgtggaagagctgaagaagtctgtggatcgcctcagacaattggttccatgtactcttgaggaatttgccaaggttatattctgttagcctatcctacattccaaccataacgagaaataagtttttgtatttctcttctcacaaaatatttcataattttgtctatttttctcggggctgcaggaat

SEQ ID NO: 89105 - DNA, 680 bp, Oryza sativa
tttgtgattagtgattatagcaaaattgttgtaagaaaataaacatgaattgatttgaactaaatcccaagcaattaccactgaagacagggggggaaaaggaaaatgggaagggaatttttggtggggggaaaaaaaacccaaaatcagtcgccggctgtacatgtccacaacagaaataagaactaacaaaaactgttttattggttaaattcaaatgcatagaagtttgcagagcttacaggttccttatccttgtccttgggttctgcttccaatatgttctgcccacatatcattactactggtccagtaagtttgtcaaacatctcctctaccttttggataaactctctgcgatttgattttggaactgctctagatagccactgggaactgtctggaaagtagacaattgctggctgtagagatggcagaacctaaattcataatcatgtaaggcaggtaaaaattattacaggggttggccaacaacaaaatagaaatgttgggggtatgtaacaccaaaattcaatacatcgtttgataaatcacctcgcaaagtgcttcaattgcgatatgccaatcttctgacccagtctcatggtcatgaacaatgtcctgagctaagcacaaggaaacgagatgaagtcaaggcgcctgaaatgggctgcaggaat

SEQ ID NO: 89106 - DNA, 510 bp, Oryza sativa
ctacaggagcaaacgagtgaagttacacaaataataatgattaagttcaaaatgaattcaacagatcaaaaggagtaccttagttgttgcttgcatacgttcgacatacatattcatgaggggatccaatgcaccactttctgaacaaacttgggcaagagactcgtccacaccaagaccgataagattttcttggtatttcacaacccaacctgttacctacagtgaccattcatttaatgattttgcaatatacgagaaagcaaaccaaacaagtgatattcatgaatcaaggaaaacaaaatgctgacaatgcttgcggttttcacatttcatcttgtggaaagtaaatttagcagaataaaacgatggcatttgaattcatataccttaagaatatttatatttggaatatcatttgctctatcactgagaagtcttagcatctggatgaacctttcagtatacagctttaccatgagctggaaaatttcatatctgtatagaaac

SEQ ID NO: 89107 - DNA, 1035 bp, Oryza sativa
ctttggaacatcagaaagttcagcagaaagctcgaattttgaatctagcactgatgatgtttccagccctaagagagccaaggctgagaggagtgtcgcaggaaacaaaactggtggtgtcaaagaaactattggagagaatgagccacacgccttgctgcctattccctgcagatctctaccacaagataagctgggtgaccattcacgtgttcaactagctatttctgctgttcagaaattgttgctgcagggtctgggcactgttcttggttccaaggacatcgttgggatctacagaacaccagcagtagataaccataaagaatttcgttataatcttttcaaaaagcaggcagagcatactaaatgtaagcgtggcaatgcaaatgtccgctatgcctggcttgcttgctcaaaagatgctgtggatgaaatgatgttgaatggtgtcatgcactttgagaagactgttaagtgcccagactacggaattggcacaatccttgctccagcaaattgctccaatacctggtatgctcctgatctatgaatcatccagtgggccaaacctgttgtgattataatgatcatctaagcctgctattgatacttccagtctgtttttttcttatcttttagataaattgttgctcacatgttgttaatattactgacatttttcatttatttgctgttcacatgtttttttttcttatgatatcatcaaattactacttcaattatatatttcttttgttcccaagtttttattttcctaaccattgcgaaattcaatatttgtattactttctgcagtgtgaattactctgatgttgatgaaaatggcattgtccatatgatgttgtgccgtgttgtaatggggaacgtagaaatagttcaccatggatctaagcagcatcggcctagtaacgagtatttcgatagtggtgtagatgacattaaaaaccctcaacattacattgtgtgggatatgaatgtgaatagtcacatctattctggggctgcaggaat

SEQ ID NO: 89108 - DNA, 1161 bp, Oryza sativa
  unsure (1)..(1161): unsure at all n locations
gaacaaagacatcaacttcacaaataaaaaaggaaggtttaacagatgaggcnatatcaataagtaacactatcagtgagcaagtctgaaagtcaaaagttctgtaaactgttacaaaataagaaaggttcttagcctaaaccctggagacaaggggcctacaagagtaacagcaatgagaattttcaaatccaactaccaatctcaagctagcatgggtgaatatcatatgcaaaagtggaatataaactgagctgcacaatgatgaaattacaacttattttgcaccctctacaaaagtaaattgatgtagcttagtttcacgttctgaagaagatatatgcacaaatgtgtctgttcaccctgaaaaataggttaaatgatggggccaacacttgatgcatgattttgacatatccattaatttcagctaccctaacactataaatattcagccattcccagcatagagaaaaaacaatgaaatttgggcaagagttcatcatgatcaataatcagtaagaaggcaaacagagtcctgaaagctaatctaatggttattgttctacctgaagactgggcagaagcacccacccccaccaaagggaattacacaaaaataagtaaaatcggtaaatcattagaaatgcctgttacagtgttacttaacaaaataactagaagtcagagcataacactatccagatattaaacatgataatctacaaccaacattcagaacaaacctcgtcgacattttgggtatgaaccgtaatgtcgctgtactttatctcttcagttactgacaagcctacaccatggaaggatataaccctttgctcaccaatctctttctcaacctattcaaatataaaagtcaaacaaatactctgataaatatgtctaaagtaatacagtaagaggttgcaactgaatataccttctgtggtggaggcataacctcatagcagagcagtgagagtggatatatgtgcccaggaacaccagaatgctccagaagcctcctcatgttgtccactgcagatgcatcaaatggtgcctgtccttgtttttgtaagtagcagacaagatacagacaagtggtaagttggaattatactgatgaactactgtaccatactggtaagcgcatttattcta

SEQ ID NO: 89109 - DNA, 847 bp, Oryza sativa
tccagtaagtcatttatttactacttaatgtgtttcacattctttaacatggccaaaatttcatgattgtattacactcatccaaaacagggagtaacagatccaatgctttatatcgggatgctcttcagcatgtttgcttggcatgtggaagatcattatttgtacaggtataaattctcggttctccatggttactctttcttttttgctcgtaattaatactggtgttctgacattttattcatatgaccagcatcaattaccatcattgtggggcatttaagacatggtatggcataccgggtgatgctgctcctgggtttgaaaaggtggctagccagtttgtatacaacaaggatattttggttggtgaaggagaggatgcagcatttgatgttctcttggggaagacaacaatgttccccccaaatgtcttgttagaccacaacgttcctgtttataaagctgtgcaaaaacctggggagtttgtcattactttccctcgttcctaccacgcgggtttcagccacggtatgtatctttcagtttgtgcatgtgttataacgccactatcatatgcatagtattctaaggaatgtttcaactacccaggcttcaattgtggcgaggctgtcaactttgctatcagtgactggtttcctctgggttctgtggccagcagacgctacgcgcttctgaacagaacacccttgcttgcacacgaggagttactttgccgttctgcagtgcttctgtcccacaaactgttaaacagcgacccaaaatccctcaataaatctgagcatccacattcacagcgttgtttgaagtcttgctttgtgca

SEQ ID NO: 89110 - DNA, 1343 bp, Oryza sativa
tgtatttgttgacgtcgatgatacgtctctgttggtcagagccaagtcggatgggacactgcggactttgatcaatgttaaacaactctttgataggattaagtcttctgagactatatggtatgcaccagtcatttactagcttgctcttgtagaggttttaagaaagttgaccaattctatgttcatcttgcaggttcattgatgaggatcaattggtagtgaatctaaagaaagttgagcaagagctgaaatggcccgacattgatgaatcttgggaatcccttacttctggaatcactcagcttttgacagggattagtgttcatattgttggtgattccacagatataaacgaggcagttgctaaagaaatagctgagggaattgggtatgtgcatctcatttcttaatgattcaaactgcaatttgaattctgccattctggtttcttttcaaccttctagtttatactatacaagtgcaaatggtagttcattagaatgagatttatatagttacatactgagtatagatcaggtatccttttacaatatttgctaccatgcatgaacatatacaattcattgctagtttatcgcatataaggcccctgaaatatatttgctggttgtacctttgcagttaccttccagtctgcacaagtgagctgctagaaagtgccaccgaaaagtctattgacaaatgtaaaaattatcgcctcatttctgttgataaaagttgcaacaaccatgttgttttacaggcatcagaagttgttatgtgtagttcatactgttacagtgaattgacaaaagtgctgttatttcttgtagggttggcttcggaaggagtggattcggtagcagaagctgaatgtgttgtgctggaaagccttagcaggttgcttttgtgggctactcctagtttgttacctttggttgatgtcttgctcagtatgcttaaaagactatttctccctcgcagccatgttcgtacagtcgtagcaactctggggggaaagcaaggagcagctagcagatttgataaatggcagtatcttcatgctggatttacggtttggttgtcggtctccgatgccagcggtaaggaaactaggaaaggaaggctagcattgttctgttcctagtacactactactatatatgtacataatgaagtccattaatctccagaggttactactcctagttactttacctttgatgaggatgtcatatgtacatagatgaagcttctgccaaagaagaggcccgtagaagtgtgagctcgggaaatgttgcgtacgcgaaagctgatgtagagtgaagcttggtggatgg

SEQ ID NO: 89111 - DNA, 555 bp, Oryza sativa
agtcgctgtcctgcacgacaaggacacctacggtcagggcctggccgatgcgaccaaggcgcagcttgaaaaacgtggcgtgaaacctgtgctgtacgaaggcctgacccgaggcgagaaagacttcagcgcggtggtcaccaagattcgttccaccggtgccgacgtggtctacttcggtggtctgcacccagaagccggcccactggtacgccaactgcgcgaacaaggtctgaaagatgtgaagttcatgtccgacgacggcatcgtgaccgacgaactggtagccaccgctggcggtgcccagtacgtcaatggcgtgtacatgaccttcggtgccgacccgcgcctgctgcctgacagcaaggcggtggtggaggagttccgcaaggccggtaccgaacctgagggctacaccctgtacgcctacgcttccctccaggccctggctgccgcgttcaacggcgctaagtcgaacaagggcgaagatgctgccaagtggctcaaggccaacccggtccagaccgtcatgggcgagaagaagtgggacaacaa

SEQ ID NO: 89112 - DNA, 5142 bp, Oryza sativa
agctgatttccttgccgagtggaccaagtgccaagaagacatgccagaggaaaagatggaatattggactatgcattttgatgggtcgaagaggcttacaggcactggagctggggtcgtcttaatttccccgactggagaaagattgagctacgtattgtggatacatttttctgcgtcccataacgtggcggaatacgaggcgctactccatggattaaggattgcaatctctttaagcattcgccgattaatcgtccgtggagactctcagttggttgttaatcaagtcatgcaagagtggtcttgtctagatgataatatgactgcttatcgacaagaggtacgcaagttagaagacaaattcgatggactcgagctcacccatgtcctccgacataacaatgaggcagccgacagactggccaattttggttcaaaacgggaagcagctccttcagatgtattcgtcgaacatctttacgaaccgaccgtgcccagaaaagagacaactgaagccatggatactcaaggcgtaagcatgattgaaaccgactggagagaacctctcatagaattttttaccaaacgagaactccttcaagacaaaaatgaagccgagcagatttccaggcgcagcagactttacattattcacgaagctgaactatacaagaaaagtccatcaagaatactgcagcgctgtgtatctttggaggaagggagacaattgttgaaggatatacattctggcatttgtggtaatcatgctgctgcacggaccatcgtcggcaaggcttaccgacaaggttttttctggcctacagctgtgtccgatgcggacgagattgtgcggacatgcgaaggttatcaattttttgccagacaaactcatttgccagcccaagagttgcaaaccatcccgttgtcctggccgtttgctgtctgggggcttgacatggtcggcccatttaaaagggcagtcggcggttacacgcatctctttgtggctatcgacaaattctccaagtggattgaggcaaaaccggtcatcacgatcacagcagataaagctagagattttttcatcaacactgtgcatcggtttggggtacctaattggatcatcactgataatggcactcaattcaccggcggagcatttaaagacttttgtgaagacttcggcattaaaatttgttatgcctccgtggcacaccccatgagtaacggacaagttgagcgagctaacggcatgatactgcaagggatcaaagcacgagttttcgaccgactacgcccctatgctggcaagtgggtagatcagctgccgtccgtactttggtctttacgtactactcctagtcgggctaccggccagtcgtcgttctttttggtttatggcgcagaagcaatattgccgagtgaagtggaatttgaatcactacgatttcggaacttcaacgaggagggctatgaagagggccgagtagacgacatcaaccgactagaagaagcccgagaagcagctttaattcaatcgactcgatatttgcaagggttgcgtcgttatcataatcagaatgtccgatcgcgagcctttttagtcggtgacctggttctgaggaaaattcaaacaacacaggatcagcataaattatctcctttatgggaaggaccgttcataattgctgaagtcactcggcctggttcttatcgactcaagcgcgaagatggtactatcattaacaattcttggaatattgaacaccttcgtcgattttacgcttaggcatttcgtttgtatctttcctctttgactgctaacttcaagtttttcctcgaagtttttagtcagggggctactataataataatggagtgtgatttttatcaattcagtttgcttacttgatgtatcattgccctgtttgatttcttggcttagtcaatgaggactgaaagttttttaacaacttttgtgggttttaggctcaacaaggtttgacaaaaacttttaagaaatcaggagctaagctaagatatcaagcacagcataaattcatcagtattgtacaaattgtgcctccatcatcgttaatcatcaaagttatcggtacattaatcggtatcagtcttttcatcatcagaattttcaggaccagtcggtcgaagatcgttgtcctgaaatctctcaactacatcagcagcaattttgtcagccgcttttttcgcatcactgatgaggtcaagagcagcttcttcgctcgtcccgtctgcaaagccatcaatggcgtcaatatcaactctcggataaagggatttagtcatcgccaacgccatacttgctcctatacttccagcttctttgatgttcttgaaatatatatccgagcaactctcagcttgtcgaaaatttcagaaacatcaagtgcactcgggccgttgttattgaggaacatcgcttgaacaattggggcagcagtgttagcaacctcatcccgggctccttcaagttttttgatcttgccaaccaggacgtcaaattgagcttgagatttgatcttgcggtctgcatcgacagattcacattaataagtcagcatatggaggataatggattttgaggtattgattgttgataccttcaacttcctttgaagccaggtctctttgtcttgccagctctgccttgttattttccagaatttagatctgcttctctagttgagatatcttggcagcttgcactacattaacttcggttaatcaggattacagagataacagcacaaatcagttgggcagagtttgcgcaaaccttttgatgagccactcagttcaaaattggattcctggagctcagcaattcgattcctcagatcatgctcatttttcctggcaagctcttttgtctcgtgcagcagactcctggtggcttcgagggtcccgagatgagggactagcttctctaaggtcgccgttttagcttcgttcctaagatgaatcctctgcaagacagtttaattagcgcatgaattaaatggcaaacaagatggttgagatcaggtaccagagggcttacatttacaatgcgggttgcctgaccaagtgccttcttcagtaggcgtaactcttcgtcctctttttgcttatttatcatgatcccttgaggctgcatgttgtcatcccaccacttgaccagaatcggagggcgtgaatcctcagctgcttgtatgcggggaatttcttcatcatcaccgatcattggtcctaatgtatccactgacagaggttagacaattggtcagagttatttgggtcgacatggtttcagacaaagtgttttacccgtaatgatttctggacgaggacgagtgggttcggatgcctttaaaggagatccagatctctggtcattgctggcgtcttgtccgcgaaggctgtctgcttgagctccaacttctggaatctcttggcttggccctgcgtccgactggtttctagtcgggggctcctgattaaccctggcttcggcttcgaccgactgattcccagtcggtggttaatcaccagattctacattatcggttgccggctgattgtcactcggacggtcctcggcagatggcctggtttctttggaagaacttgcgtccacgctagtcgggtcagagtctttcccagacggatctatgtcagatggtttcctgcaagtttgattatcagtattattgccgcaatggatgcgcatcaatgcaagagagatcgttgtatgagttgtacctggaagacttcctgatctttggcgcggggcgactggatgttttcttccttggagtagcctgttttggtagtttcttggttgtctctcggtctccaggcctcctggtagtatcatcggcttcgtcatcactcagaaccagcttcctctttcgagagtctgactggccgactggatcaaaagcacttggttgagtttcagaccgaattcttggtcctccgctcccttgcccagtttggtggcggggagatcggcgttgagcgattgggggatccgatttcatcaaagcaaattcctgggtgcaatatctttcattgttaattgattcaataggaagacaagatcatatcttgaggaaggttgaaatgtttgagtgcataccggtggaggagggttgaatgcgttgaatggcacgacgggtagcagatgtgaatagctgacaacaatagcgtttgagaagatcttgtacattctttctttcatgaccttaaagtcaagagaatctggatcttcccgatttggatcatgcttgccatcgaactcaaaagctgtgcgggatctttctttgattggagctaaccgacacttgataaagtgccgggtgatctgctttccttgaagaccctgttcttttagctttatcatcctctccatcagttctactgcctgagcagcttcatctcctataggcaatgagtcccatgtgtcctggtaaaccggaggaagacaacagtactcggggagtgcgggctcaggattctgaacatagaaccagttcacatgccagcctttgtttgaggttttgaagggcatggagaaatatttttggctcaaggttcctctgagttggaagccagctcccccaacaacgcacggcttgcttttgtttggctggggcttgaggaagaagatgcagcggaacaaggcgaaatgaggcctaatgcctagaaaagcttcgcaggcgtggataaaattggcaatatgtactatggagtttggattcaagtgatgcaagctaatcccgtagaagttcagaatgccccggaaaaatcttgaggttggaagagaaaatccgccatagaagaaatgagcgaataccacgatttcgtgtgtgtcgggggtcgggaatgcctcaccaaatgctggtcgcctgtagcgcccgttccgtcgtggcgcctagcgggaaaattatctcctaaaaaccctaattgcgaattttgtttctttgcttgttgtctagtgtccgtgccatctcaagatctcaatccccgatctatcgtcgagttcatttccgaatccaaatccttccaaatcaaattcctccgcaaaagtccattttgcctcccccggggtcgatg

SEQ ID NO: 89113 - DNA, 903 bp, Oryza sativa
acacattcaggtattaaagcaatatcttcaggagcagaatagagacacgcccttgaaagcaacagcaaagacattcgtgtcaaatacccctgttctattgcataagaaaattgttccgcaccattaaggatgctgttactggatccaagaaaggactgtagatgatttctatcaacaaatggaatgtattcagtaagcaaagccaatgcatgcttccttaataacatagaagaatcatagaaagccaatgctgctactcggtcccaggtatgagtaaccaaaagggatgttactgttgaaccagatgagagtgaattttgcttataagtagtatattcagaatcaactttagttgtgctcataataatcctcccaagttgctgcaatgcaacagagcgctgttctggttcagcatgactcaacaatgtgcagaaaagatcaatcaatgaattctcactgttcttaaggccttcaattccataagaaaccaatattgataaccatatctctgtctgaagcctccaagatatcctgggtgcatgagagcagaggtgtttcattgcagaagacatgacattaagaacattatcccaagcaagaatatttggaagcttaatcatataatcgagcataactgatgccacctgccagcactgcttcttctgatttactaaaatggtttctgcgaggccttggagagcactctcccagtgtttttgggaaagatcagtggatatttcagtaccaacctcttgtttgatgctactatagatcatacctccttcggcaatagactttaggcattttgcatacagcaaacattttgcaatcgataaagataacctagaggccaactgaaggtgccatttccaactgccctcaatagatggtgcaaggtttgat

SEQ ID NO: 89114 - DNA, 522 bp, Oryza sativa
tccatagaagcattcaagcacttgaggccggtgctagcaattgatggcactttcttaaccggtaaataccaaggtacattgctcacggcaataggggtcgacgccgggttacatcttgttcccttggcgtttgctctggtagagaaggagaatacatccaactgggagtggttcatcaacatgttgagaaacaagctgatcggtcctaatagagaagtgtgtataatttctgatagacaccctggcattttgaactccatcatccacatcatgcctcatcacctaaccattcaccacaggtggtgcatgaggcacttctgtgctaacttctacacagctggagctacgactgatcagatgaaagatcttgagcgcatatgtcaaataaatgagaaagcatttttcctagatgagataaaacgcctcatgggtgtggtcggagagaggccaaagaagtggctagaagaccacatgccacttaaggtcaaatgggcaagagcatttgataccaacgggcgtcgc

SEQ ID NO: 89115 - DNA, 1035 bp, Oryza sativa
tttgatgttgttgacgtcaagtatcttcagtgcatgagagcacaagatgccagcaaattcaaacttcttgcaactgcatttaacattggattccaacggagagtatctaacaacatgttcaagatgaacatgttcaagatgcatttaccgttggcctttattttgtacaccttttctgcatcaacctcaccacagtagaatatgtcacaattcaaagtctgcattacctcttcctcaaatatcttataaactgctggagtataaacttctgctacatctctcaaaattctcaactctgcctttagcttcggtgtactttgtgttgctctaaagtcacactttacctcttcatatcttttatctcccaccaatctgtcaaagtgctcaagaaaagaaagcatgccatacttcacactaatataaccctttaattcattattcgggctttcatttctttgggtggtactcatatccgcagaaaacatgttctggccatatattaatgcccattgctcccttttcttaaaaatccgttacaaccatgtattttgctggtgctcatatttttcaagcaattggccccatgcacgtaaaaattcttcttcctcttcctgatcatatatgcagttctgaaagtcagcattaaatttcttatagtccttaacacacccagcaaggtgcttgcaggcattctgattcatgtgccatacacatatccgatgatgagtttctggaagaactattttaattgctttagccatagctccatcttcatctgtcaaaattgtttttggcttctttcctgacataatatttagaaaagttttaaataaccaaacaaaactattagcggtctcatcatatagaagagcagcaccaaaaacagtagtcttcttatgattattcactcctacaagcaaaccaaaaggtcgtccgtcatccaactttctatatgttgtgtcaaagcatacaacatcaccagaattttcatagtcggcaaccattttagagtcagcacagaaaatgtttgtaatt

SEQ ID NO: 89116 - DNA, 798 bp, Oryza sativa
atgcctcagtagcacacccaatgagcaatggacaggtggagagggccaacggcatgatacttcaagggattaaagctcgagtttttgaccggcttaaaccctatgccggcaaatgggtgtcacagttaccatcagtactttggtctttgcgtactacgcccagtcgggccacaggccagtcaccttttttccttgtctacggggcagaagcaatgttgccgagtgaagtcgagttcgaatctttgcgcttccgtaatttccgagaagaacgctatgaagaagaccgagtggacgacttgcaccgactggaagaggtccgcgaagcagctttgattcagtcagctcggtacttacaagggttgcgacgttatcataatcgcaatgttcgatctcgtgcctttctagtcggcgacctggttttacggaaaattcaaaccacacgagatcggcacaagttatctcctctatgggaagggccatttattatctctgaagttacccggccaggttcatatcgactcaagcgcgaagacggcactctcgtcgacaattcttggaacattgaacatcttcgtcgtttctacgcttaactttatcattgtatttccctattttgactgtcaaacatcaagttttctccttgaagttgtcagtcgggggctatcatcataataatggagtgtgattttttatcaattcagtttgcttacttggtttatcattgccttgtttggtttttctacttagtttgcgaggactgaaagtttttaatagcttccttgggttttaggctcaaca

SEQ ID NO: 89117 - DNA, 627 bp, Oryza sativa
cggcaagaaatcaataaggtttttcagtttctgattgagcggcacccattctttgaaactggattaaatttaatgaacattccaggatcgatgtatgatctttaatctttatattgcattttagtaggtggtcaacagatatattgatgaaggaattgcagagcttgtacctggtgttctgttcattgatgaggtatcttcttattttatccgtatgattgaaagtttactgctctcagtgggctaattttggagtcagaaagtacaaatatgaatgatggtgtgtttatatgttgtgaagcatacagtgtcttgtccttgtgaagcagtgccatgctgtataacttatttattactattgttctactatatggtagaaatatgtcttaatgttgtttgatttaattacttattattgttaggaactttaattgcaggtccacatgctagatattgaatgcttctcttatcttaatcgtgctctggagagcccattatcaccaattgtgatacttgcgacaaatagaggaatatgtaatgtaaggtaaacggtttgatttaccgctcgaagcactctgtcacattgcagtaccagagtaatactgcgtctatcagtttgtctattac

SEQ ID NO: 89118 - DNA, 879 bp, Oryza sativa
tgcaggatccagatccagatatgcataaaagggattcatggctttaagcttatctcttacgctccaggaatggatcagtcagaacatcaccaccggctcgcctcgaccgccgccaccgaccttccgctgccgactggtgtttccgcctgcacggctggcctattatgccgccgttgttgggcgtctacgtcgtcaccgaccggcttgccttcgccgctgccgactggtgtttccgcctgcacggctggcctttatgccgccgttgttgggcgtctacgtcgtcaccgaccggcttgccttcgccgctgccgactggtgtttccgcctgcacggctggcctttatgccgccgttgttgggcgtctacgtcttcaccgaccggcttgccttcgccgctgtcgactggtgtttccgcctgcacggctggcctttatgccgccgttgttgggcgtctacgtcgtcaccgaccggccgcctcgtccgccgccgactggtgcttccgcctacacggctggcctattatgctgccgttgttgggcgtctacgtcttcaccgaccggcttgccttcgtccgccgccgactggtgcttccgcctgcacggctggcctttatgccgccgttgttgggcgtctacgtcgtcaccgaccggcttgccttcgccgctgccgactggtgtttccgcctgcacggctggcctttatgccgccgttgttgggcgtctacgtcttcaccgaccggcttgccttcgccgctgccgactggtgtttccgcctgcacggctggcctttatgccgccggtattgggcgtctacgttttcaccgaccggtttttttcgccgctgcctactggggtttccgccctgcacggcttgcctttat

SEQ ID NO: 89119 - DNA, 625 bp, Oryza sativa
gcccaacagcggcggcataaaggccagccgtgcaggcggaaacaccagtcggcggcggcgaaggcaagccggtcggtgaagacgtagacgcccaacagcggcggcataaaggccagccgtgcaggcggaaacaccagtcggcggcggacgaggcggccggtcggtgaagatgtagacgcccaacaacggcggcataaaggccagccgtgcaggcggaaacaccagtcggcggcggtcgaggcggccggtcggtgaagacgtagacgcccaacagcggcggcataaaggccagccgtgcaggcggaaacaccagtcggcggcataaaggccagccgtgcaggcggaaacaccagtcggcggcggcgaaggcaagccggtcggtgaagacgtagacgcccaacaacggcggcataataggccagccgtgcaggcggaaacaccagtcggcggcggcgaaggcaagccggttggtgaagacgtagacgcccaacagcggcggcataaaggccagccgtgcaggcggaaacaccagtcggcggcggacgaggcggccggtcggtgaagacgtatacgcccaacagcggcggcacaataggccaaccgtgcaggcggaaacaccagtcgg

SEQ ID NO: 89120 - DNA, 982 bp, Oryza sativa
ccagatgatttacctggtatgccgcctaaaagggatatagagttcagaatagatttggtaccaggaacaactccgatccacaagagaccatatagaatggcagcaaaggagttggcagaagtcaagaggcaggtcgacgatttgcttcagaaaggatacatcagaccgagttcgtcaccatggggagctccagttatttttgtggaaaagaaagaccatacccaaaggatgtgtgtggattatcgtgctctaaacgatgtgactatcaagaataagtatccgctgcccagaattgatgatttgtttgatcagcttaaaggagccactgttttctccaagatagatcttcgatcaggatatcaccagttgagaatcaaagaggaagatatacctaagacagcttttaccactaggtatggattgttcgaatgtactgttatgtcttttggacttaccaatgcccctgctttcttcatgaacttgatgaataaagtgtttatggaataccttgataagtttgtggtggtctttatagatgacattcttatctactctcgaaccaaagaagagcatgaagaacatcttcgccttgcattagagaagctacgagaacatcagctgtatgctaagtttagcaagtgtgaattttggttgtctgaagtgaagttccttggtcacgtcatctcagcaagaggagttgccgtcgatcctagcaatgtggaatccgtaaccaactggaaacaaccaaagacagtttcagagattcacagtttcttaggtctcgcaggatattatcggaggtttatagaaaatttttccaagattgctaagcccatgacacgactgcttcagaaagatgtgaagtacaagtggtcagaagagtgtgagcaaagtttccaagggttgaagaatcgcttagtatcagctcctattttgattttgcctgatccaaagaagggtttccaagtgtattgcgatgcat

SEQ ID NO: 89121 - DNA, 667 bp, Oryza sativa
acatcttcatccgaccggccgccttcgccgccgccgactggtgtttccgcctgcacggctggcctattatgccgccgttgttgggcgtctacgtcttcaccgaccggcttgccttcgccgccgcctactggtgtttccgcctgcacggctggcctttatgccgccgttgttgggcgtctacgtcttcaccgaccggcttgccttcgccgccgcctactggtgtttccgcctgcacggctggcctttatgccgccgttgttgggcgtctacgtcttcaccgaccggccgcctcgtccgccgccgactggtgcttccgcctgcacggctgacttattatgccgccgttgttgggcgtctacatcttcaccgaccggccgcctcgaccgccgccgactggtgtttccgcctgcacggctggcctattatgctgccgttgttgggcgtctacgtcttcaccgaccggccgcctcgtcagccgccgactggtgtttccgcctgcacggctggcctattatgccgccgttgttgggcgtctacgtcttcaccgaccggccgccgcatccgccgctgactggggtcaccgcctgcacggctggcctgttataacgccaactgatgctatcttcttcacgactggctacatcgctgtcactactaataggcatca

SEQ ID NO: 89122 - DNA, 652 bp, Oryza sativa
acaactccgatccgtaagagaccttatcgaatggcagccaatgagttggcagaagttaagaggcaagtagatgatttgcttcagaaaggatacatcagaccgagttcatcaccatggggagctccggttatttttgtggaaaagaaagatcatacccagagaatgtgtgtggactatcgtgcactaaacgatgtgactatcaagaataagtatccattacccaggattgatgatttgtttgatcagcttaaaggtgccactgttttctccaagatagatcttcgatcagggtatcatcagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacttagacaagttcgtggtggtctttatagatgatattcttatctactctcgaaccaaagaagagcatgaggaacatcttcgccttgcattggagaagctacgagaacatcaactgtatgctaagtttagcaagtgtgaattttggttgtccgaagtgaaattccttggtcacgtcatctcagccggaggagttgccgtcgatcctagtaacg

SEQ ID NO: 89123 - DNA, 630 bp, Oryza sativa
ctcctccgaaccctaaactttccatctcgtcgccggccgccgtgggccttcgccaccgcctcctagcccctttaaaggacccccgatgtctcctctacccgccgcctccctcgccttcgcctctcgtcgtccgtagcgccctagcgccgtgagacctagcgccgccgtcgccgccacagctccagtcatgcgccgccgctgtttcagccgtcgccatcgctcgggaacgccgccgtcgtggtcgccatcgcgtcgccgtcctcgtccgccccttcgccgttgccgaagaccgccggagcaccgtctccgccgtcgacgccgtcgccgtccgttcatcttccgccgcttctttagtcatcggtgagttcgccgcgtcgcgctctacgtcctggtgccctccgttcgcgtcctcgcgccgtcgttcaccggcgagcatgcgagcccgagccgccgagccgtcgccggaggtgacgtcgccgctgacgtcatcgtcgtcgtctctcgtggtccggccgtagacccgatcaatctcggccgtccgttttggatggatcgatctcggccgtccgttcccgtgaaccgtcgccgtgcgcccggtccaccgtaaccctagccgctgacgcaataaat

SEQ ID NO: 89124 - DNA, 2405 bp, Oryza sativa
  unsure (1)..(2405): unsure at all n locations
gaggaacagaatggacaaattgatatgattcctgatacaatacgtcagatatgtggaagaatattgatattcagattgaagttgactaaaaggaatttagaagagtgtaaggaagactacaaagtgaactacacttttacacctaatgaaaagcttgagatgaattatgtaaatgacaaggcagaagaggtatgactatttgcattattcttttttatacatgttatagatcttatattacaatataaatattaatttgcagtcaatgttgaagtacaacgatgattatggcttcactgatttgaaaaaaatatttttgtaatgcatatgatatatatataattatttattggatgttctgtagtttgggcagcacaattttcaggtaaaagaagagccaaaaaatgaaagtagtgatgattatgaaatgaacaatcatcgcaaaacaaagaaagagagatcaaacatgagatctacaaaaagatcaaacaaggtatgtataattgctttcttacataacaattcgtaaagttgtttatagtactacactaataatgatgttttataggaaccatacattaccgattctgatgggaaaacaaatgaaaaggcaatcacaatcgatgatgattccgaagaatcacttgatgattattttgatgaagaatacaatgaaaaggttacacaggagagtacaaagacgaatccttctaaaagaagagttacaagacgttttaaaacatctaacaaggtacttcatttattttactttccaaattcactcaatttaattttcacataaattatttaccatttcaatatggcactatgatatacgctaagaaaggaaaatgtctgaaatgaaaactcaaagaaataaggtacaattcttacttttctttcatatacaaaacgatctgtcaaactattactgacatgttatatacaattgatgggtattaataggaaccatatattactgattgtgagaagatagcaaatgacaaaccaatttcgcttgatgatgattttgatgaagaatataataaaaatatggtcatggcggacaccagtacttctaaaagaaaagtcagacactacataggacaaactaacattgtacttcattgagttttacnttctatttaatgttacctttcatgtttgtccattaatgtcaatatgctattgtgcaggtaaggggaaaaggttgtggaaagaagagtacaaatatgggaacttgcacaaaaagtgcaattgaaaatacaattcaagatgatgaagtatttgatatatttgttaaataaatcatgtattttaacataaaacttttttaattaactaactaagaacacaaaatttaggtgcatgacggaaaaattgcttcaggaactgctaaaagaccatcaaggaaatttataatttcagatagtgaggtactgcatgagacaatttatcaagttattaattaatatatattttttttgtaacaactaatttttttttccataggatgagcacagcagtaatacaaaggtgactggggacagcaccagctgtaatagtagtaaggaagatataaacaaaggtcgatgcaattataatattgagaacattaaagttcacatgaatgagcagtccagtcgatgcagatcaacaaggattagaagaccacccacccgatactcatattagctacaacatattacttctgggaaaatgttggttgctttagatttggtttgattagtaaattataataatatggtctttcgtctgcaggtaatttatagtcaagaaggcccaaaagaaccaattaaaaggagggttcagccaatactttttattgaagaatagtattatatatgttcctattaatttttatgttcattagatattgtcagatgtaacgtacaacttgcacttgccaaaggaatccttggattactttgtttatttctaagatagagagttaataacattcaatataaatgcatgcatgtaccttcagtacatgtatatgagtcgatccctgcttgcttcctctaccgttgatatcctaaaagcatataaaacaagatcagttgatttaataattcttaattaatacaaatccccaagcaagaaacttaatgattaaaaaaacttgattatgtaaaatggaaatcaatcaagaacgatgagctctcggggctaccttcgctctcagccatgcttgatgttgctgcacctgctatccgcactgccccaacacctgccatccccactgccccatttcctacaaataccacctcccataccagagccaactaaccgatggctaacactgctcctgatctagacatcctgcggtggatctaccaaggcactgacttggatgccctatggtggatctagccaaccag

SEQ ID NO: 89125 - DNA, 1250 bp, Oryza sativa
caacttattccggaagtcgcttggcggaattgtatatggcaaggattgtgtgtttgcatggcgtccctaagaagatagtgtctgatcgaggcagtcagtttacttcaaatttttggaagaaacttcaggaagagatgggttctaagttgaactttagtactgcttatcatccgcaagcagatggacaaactgaaagggtgaatcagattttggaagacatgttgagagcttgtgctttagatttcggtggaagttgggataagaatctaccttatgcagaattttcatacaacaacagttatcaagctagtctacagatggctccttatgaagcactgtatggtcgaaagtgccgcactccgcttttgtgggatcaaacgggagaacgtcaggttttcgggacggatatcctaagggaagcagaagaaaaagtaaagatcattcaagaaagattgcgtgtggctcagtctcgtcataagagttatgccgacaatcgccgcagagatttgagttttgaagaaggagattatgtgtatcttcgtgtcacgcctctacgaggagttcatcgttttcataccaaaggaaaattggcaccgcgttttgtgggaccttataagattgtcagtagaagaggagaggttgcttatcagctagagttacctcaatctttggcaggagtccatgatgtgttccatgtgtcgcaattgaagaagtgtttaagggtacctaccgaagaagctaatattgagcagatagaagtccaagaggatttgacttatgtggagaaaccaatccgtatcttggaaatagatgagagaagaaccaggaatcgagttatccgtttttgtaaagtccaatggagtaatcactcggaagaagaatcaacttgggaacgagaagatgaattgaagtcagctcatccacatctattcgccagttcttctgaatctcgaggacgagattctgtttaaggggggtaggtttgtcacaccctaaaaattcaaaatctataaattgttgtttaattggaatttttagaaatgattttaaaagcctagaagagaagatctaattttaattaataaattctaatataaaatggggccagataaaattttattaaatactttgcttaattctataattcctagatttttctgggatttatttgagctaaggaagtatttttaataaatggaattgcatttcatgaataatttaaattgaaaaaggtttttaaaagtctcttt

SEQ ID NO: 89126 - DNA, 583 bp, Oryza sativa
accgaacacccagagaagcaagtaactcacaagttcgccctaatacaaatcttgtatatctacaattacgccaaacaccacaaaactaacctgcataataataatgcagccaataattattgtctagtttaaaaatcgtacggcgtgacgaagccttccggccggagaggcgcgaggaacggccggaccggcggcgtggcgaacagcggctgccggcacgtcgggcaggtggagcgcgcgaggagccagcggtcgacgcagcggacgtggaagccgtggttgcacttgggcagcacgcgcacgcgctcgccgggctccaggtcggcgaggcagatggcgcacgccgggctcggcccgcccgccgccgagtacaccatcgtcggcatcgcccgcagcgccttccgccgcaccccggcggcctgcgccgccgccgacggacccagctcgccgtcatctcccgccgccggcgacgacgacgaagacatcatcatccggccgccgctcgagcaccggagcgcgcaccgcacgatcgagttgagccccagcgcgcagatgagcgcgcacaggagcacggccaggatca

SEQ ID NO: 89127 - DNA, 678 bp, Oryza sativa
  unsure (1)..(678): unsure at all n locations
aaaattgatgataaaatgtggagacgttgttctaaaagaaatatgcgatatgtcttctctcaaatatccgttgacgtattcgttccgtttcgtattcgctccgtatctgtattcgataataatcatttcatttccatatccgggttttcgattcagattaaaaaaataaaaacgaatatgataaagctagttttcatccgtttccgatccattttnnnnnnnnnnnnnnnnnnnnngggaaatgtcatctctggtgctctttctatcaaccaccattttcttttatcacgtgccgcgcatagaaagagggtagtatgtgttgacgaaaaaatggaacacaccggtctgggagatctgcttaactccagtgcaggtccaaaggttggtgagatgcggacgtgcctgtcagtttgatcctgcaactgacaagatatgcaaatagtagatcaaacagccgatcggctgactgttgacgaaaaaatcgaacacactggcctgggagatctgcttaactcctgtgcaggtccaaatcttaatgagatgcgggcgtgccagtcaggttgatcctgcaactgacaagatatgcaaatagtagatcaaaatagccgatcgactaacaagccgatggagtagttccagccgatagccgataatagccgatgccgataccagccgata

SEQ ID NO: 89128 - DNA, 2069 bp, Oryza sativa
agcgaggatgagaaacacatcggggctgatgtagcggaccaatatgagagccttattgtgcaacgtgtcttgagtgcacaaatgggcaaagcggagcagaaccagcggcataacctttttcagacgaagtgtgtcgtccacaagcgttcctgctgcacaatcatcgatggggccagttgtaggaatttggtgagtacggagatggtcacgaagctagctttgcagatgaaaccacatccccacccatactacattcagtggttcaacaacagtggccgcattaaggtaacacaattggtgagattaaattttgcaattggttcttactgtgattttgttgattgtgatgtcgtacctatgcatgcttgctctttgctgttgggtaggccttggcaatatgataaagacacattgcatcatggtagaaccaatcaatactcctttatgcataatggaaagaaaattgtgttgcatcctttgactcctgaagctgtttttgagaataatgttgctagagctgagaaagagaaaaatgttgagcatgctaaaagtgaaaatcagattgtagcaaaagaacaagtgcaccataatttgaaaggttctcaatctaaccgtcgcaaggatagtgtgattaaattgaatggtccttgtttgcttaccactaaatctgatattgtcaatttggacacaagtgatattgtttgctatgctttcatttgcaaggatgctttgttttcttttgaaaatattcctctctcttttcctcctgcggtcactaaccttttgcaggagtatgaggatgtgttccccaaggacgtgccaccggggctgccaccggtgcgtggaattgagcatcaaaacgacttgatcccaggagcatcgttacccaaccgtgcgccataccaaaccaaccctgaggaaaccaaggagattcagcgtcaggttcaggacttgcttgacaaagggaacgtacgtgtctcttagtccatgtgctgttccggtgattttggttccaaagaaagatggatcatggcgtatgtgtgttgattgtagagctattaataacattaccattagatatcatcatcatattcctaggttagatgatatggtagatgaattgagtggctctactgttttctctaaagttgatttgcgtagtggttaccaccagattcgtatgaagttgggcgatgaatggaaaacaacatttaaaacaaaatttgggttatatgagtggttagtgatgccttttggtttaactaatgcaccaagcactttcatgaggttgatgaatgaggttttgcgtcctttcattggaaaatttgtggtggtatactttgatgatattctgatttatatatagcaaatatttggaggaacatcttgatcatttacgtgctgtttttaatgctttacgtgatgcacgtttgtttggtaatcttgagaagtgcaatttttgcaccgatcgagtctcgtttcttggatatattgtcactcaacaggggattgaggttgatcaagctaaggttgaggcaattcagagttggccgattcctaaaacgatctcacaggtgcggagctttctaggactcgcggggttttctcgccgttttgtgcgagatttcagcaccattgctgcaccattgaatgagcttacaaagaagggagtgcttttcacttggggcacatcacaagagaacgccttccgcatgttgaaagataagttaacacatgcacctctcctccaacttctagattttaataagacttttgaacttgaatgtgatgctagtgggactggattgggtggtgttttgctacaagaaggaaaacttgttgcatattttagtgaaaaattgagtgggcctgttctgaattactctacttatgataattaattgtatgctcttgtgcgcactttagaaacatggcagcattatttgtggcctaagaaatttgtcatacattctgctcatgagtctttgaagcacattcgtagtcaagaaaaactgaaccgcagacatggtaaatgggttgaatttattgaatcttttccttatattatt

SEQ ID NO: 89129 - DNA, 694 bp, Oryza sativa
gacagctatgaaatgcttcttgggtgagtactggcaaacctaagggagttcttactgtgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacagtctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaagggg

SEQ ID NO: 89130 - DNA, 1206 bp, Oryza sativa
aattctacacacatcatacacaagtccaagtatctcatcatgagtgagttcttaacaatatacctgcatgtccaagtatctcagcagcagtagcttctgaatcccgacgctctttgcggcctcaatcatatccgcgggcaagctgggcaagctgacccctcgcttctccacctcctggaccacctgatcaaaactcaggatcggcccaaactcatcatccccttcatccccaccgtccccaccatcaccaccaccgccgccaccaccattatccccatctccgccgccgccactggagggtaacttcccattcccacccgagccgtcaacatcagccacctcgccacgctcccccttcgggagcacgctcggaggtgcaaccgcgccgacctccttcacgtggtcagcaacctccccagcatcaggcacggcgacggtcgaaccggaggtggtggcgccgccgcccccatccgcgcaggcccgcggcggcagctcggcgcggatccccctaacccccagccccctcctcccgcccgggtagaggcagcagccgctccgcctcaccaccgcggcgccaccgccaccaccaccaccaccccggcatttccccacgccgacccgcccctgctgcagccgcgcgcccgcgcacgagaacgccatgctcatgctcgcccacccacgcaccactacagaaatggtcagattggattggaaatggccacaaaaaccgcaaaaaaatcagagaaaaaaaatcggagaagcccgcacctgattgcggctcgacgaggaggcgacggatcgcggaaaactccgaacaaaatccggtgaatgattaggttcgatttatcgtgggggatttgagcgcgaggaggtgaggcgtggaggggttggtggaggagggggattggtggcgagtggcggcggcgcggcgcgaaggaggaggggagcgtgcgtgcgtgcggatcgtgaggtttttcgggggcgttttgtagcgacgggtgagaggcgccgcgtgtgaggctgtcacgtggggcccacctccggcgaggcgtcgcgcgtgaggctgtcaggtggggcacgtccccttttttgttgccttgtgggggcttcggatgggtgggtgacaggtggggccaactgacatggaggttttgcaagtgggggtttcttctcgttttggctgacttctggtcaaattgcacacga

SEQ ID NO: 89131 - DNA, 2185 bp, Oryza sativa
ctgatggaggttgaaagcttctaaacttgtgatggtttagttaattaggaaggcttgcatttaaaattgctccatgaaagcttcgataataattaaattatatatgtacaaacttagtaccatgtgtgtttgtattgaccttatcgtttttgcaaaatataatagattaacaataagtgctacaattattttatatcactagctaaatgcacatgcgttacaatagagttgtaaaagagatattcatctttataaaatcatttctcattgtctattcatgaaactatactttcatcaatcaaattttattggttagctataaaatgattgctaatcatcatcataatttaaagttgatattaaattttcttacagatttctttttacttttatagcctggttcttttttatataattgataaaatggcatgtaaaatgtctaactaacatttaccgtatatgggcctcactgtcacactgggcagagggtgatggcagtagaaccaccaccatcatttgtgtctttcataggagtatatataaaggacactatactactcctctcgtcccaaattataagtttacactggcttcaatgacatgctttgacctaaatttatttcatgttatgttatcaaacacctacgaaattagtatcacataaaattattttaaaatataaatctagttatataacatgcataatacttagtataaataagctaatgtaattattagtgaattttttttaagtttgagttttctaaaaataaggacaccctataatttagaacagaggagaagtcacagaggagaataacagaagcagtttttcagtgtttggcaaaaaccaatgttagtatttgcactattgttacaccatgagttgaggagaagttagagatgaagaagtattgcagacagagcaattgtaagcatggaaggtacagagaacataacactgatagcttctgaagaatctccatggccatgggggttgttttttccctcgctctctttagcatcatcaccctgcccaagatcaacaaaagaaaaatagttaatgaactaagggtttcttgaagatatccatgaaaaatttccattactatagaaattgaatatatatgtctatgaaaattcaaaaggatgtcgaaataggtggcaaagagaaattatcaagcgtgcatctctctcattttctcaatggtctcgtttcgatgcagtccacgagcatggacacatggatcatgaatgaataatgcgtgtacgtaccgcggcttccgtctccggcgagtcgccgtcgccccccggcgtcgtcgtcgcggcggcatcatccccctcttcctcctcctcctcctcctgcaagatgcgccacaaaggagtttcacaacgatatgtcagtcagtgtcggcagccacaaaaaccatgcatggtgatggcgacaatgagcgtcgatcgtgtcgagcacggacgcgcggcacgcaccggattcttctcgtcggccgattcgccctccgatggctccggcgaggccgagccgtcgtccgacggtgccggcgcggtggcttcgtggagaccttcttcccaccgacgacggcgcgggcgcactcgcctcatagccggcgcggcggcctccgactccgagtcacgcttcgtcacggcggcgccgctggcattgccgcccttcgccggcgccggcgccgacgctgatgacttcccctgcattacgcaacaacgttcattgcactcgccggcggcgcggcgtacggacggacggacggacgtacgtaccgtgtctttcatgaggccgacgtcgtacatgggcgtgaggtcgggcttgaagaggccgaagttgcgctcggcgatgggacccggcttgaggttctcgttgaagagcgcgaagatgtaggtctcgaacgtccgcttcggcatgagcggcgtccccgaccccgagctggcctctccgatgaggtagcggttgtactccgccgcctcggcgacgctcacgccggcttgtccgggctccgccttggtcggccacccggtctcccccaccgtgatgtccacgtcctcgaaccccagcttcttcatcgccgagaacaccgagtccagctgcgcctcgagcatgctggtgtaggtgatgcccgtgcccgggtcgagcacgccggggttggggcgccgc

SEQ ID NO: 89132 - DNA, 717 bp, Oryza sativa
gaccggccgcctcgtccgccgccgactggtgcttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgccgccgttgttgggcgtctgcgtcttcaccgaccggcttgccttcgccgccgccgactggtgtttccgcctgcacggctggcctttatgccgacgttgttgggcgtctacgtcttcaccgaccggccgcctcgtccgccgccgactggtgcttccgcctgcacggctggcctattatgccgccgttgttgggcgtctacgtcttcaccgaccggcttgccttcgccgccgccgactggtgtttccgcctgcacggctggcctttatgccgccgttgttgggcgtctacgttttcaccgaccggcttgccttcgccgccgacgactggtgtttccgcctgcacggctggcctctatgccaccgttgttgggcgtctacgtcttcaccgaccgg

SEQ ID NO: 89133 - DNA, 675 bp, Oryza sativa
gacttcaccgccggcccgcctccgtcgccgccgagtggtgcctccgcctgcacggctggcctattatgccgccgctgttaggcgtctacgacttcaccgccggcctgcctcgtccgccgccgactggtgcctccgcctacacggctggcctattatgccgccgctgttgggcgtctacgacttcaccgaccggccgcctcgtccgccgccgactggtgtcctcgccggcacggctggcctattatgccgccgctgttgggcgtctacgacttcaccgccggcgtgcctccgtcgccgccgagtggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttaggcgtctacgacttcaccgccggcctgcctccgtcgccgccgattggtgcctccgcctaca

SEQ ID NO: 89134 - DNA, 634 bp, Oryza sativa
cacggctggcctttatcaagacgatgttgggcgtctacgtattcaccgaccggacgcattgtcctcagccgaatggtgcttccgcctgcacggctggcctttatgccgccgttgttgggcgtatacgtcttcaccgactggcttgccttcgccgctgccgactggtgtttccgcctgcacggctggcctttatgccgccattgttgggcgtctacgtcttcatcgaccggcttgccttcgccgccaccgactggtgtttccgcctgcacggctggcctttatgccgccgttgttgggcgtctacgtcttcaccgaccggccgcctcgtccgccgccgactggtgcttccgcctgcacggctggcctattatgccgccgttgttgggcgtctacgtcttcaccgaccggcctgccttcgaccgccgccgactggtgtttccgcctgcacggctggcctattatgccgccgttgttgggcgtctacgtcttcaccgaccggccgccgcatccgccgctgactggtgtcaccgcctgcacggctggcctgttatgccgccgttgttgggcgtctacgtcttcaccgaccggcttgccttcgccgccgccgactggtgtttccgcctgcacggctggc

SEQ ID NO: 89135 - DNA, 1118 bp, Oryza sativa
cttcgctgcacctcgttgcccgcgtgccctcttctgtccaacggagggttgactaccactagcctcctcctcctggttcccctccatatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatatgacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagtgtaatatgtcgcaccacttccgtagtcaataattacatactaagtctaattacaaataaagtaatcttatattaaaactcaaataatattacatgctaagactaaaatagccatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacatgtattt

SEQ ID NO: 89136 - DNA, 4069 bp, Oryza sativa
tagtcatgtatgctaagtgtttcgtgcgtatatgctaagtctaattaagactacaatagtcaattgctacttgtcgcaccacttccgtagtcaataattacatactaagtctaattacaaataaagtaatcttatattaaaactcaaataatattacatgctaagactaaaatagtcatgtatgctaagtgtttcgtgcgtatatgctaagtctaattaagactaaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtattaggataaatgcgaagtaacatatatatatatacatatatatatatatatatatatattgcatttcacgttaacgttcgtcctcgttcgttcgctcgttctcgttcacgttcgttcgcttgttctcattcacgttcgttccctcgttctcgcttgtcttcgttcgatcgttctcgttctcgctctcgttcgttcgatcgttctcgttctcgttcacgttctcgcggcaacgtacgttgacgtgttcgttctcgctctcgttcgttcgatcgttctcgttctcgttcacgttctcgtggcaatgtacgttgacgtgttcgttctcgttcggcgaaggcggcggcggcgtggcgacggcggcggcggcgtggcgttggcatgcggcggcggcgttgcgcggcggcgaaggcggcggcgtggcgtgccggcggcggcattgcgcgcgcgccggagaatgcggcggcgtggcgtgccggcggcggcattgcgcgcgcagcggcgaagacggcggcgtggcgtgccggcggcggcttggcgcggcgtcggcgtggcgcgtcgtcgtcgtggcgcggcgtctcgtggcgggcggcgcgacggagagagatcgagatcggagagatcgagatgaagggagatctggcggcggcggctctcaccccagagatgcggcggcatcggaggaggcggaggcggcggcgaggacgacgagctcgagacgacggcgagatacggcggcgtcggcgcggggatttgccctaggcagtggcggcgaaggagagaggccgagagagatcgatcggccgaaaacgtctaagtgttggtgaagaagacgagggcgcaccggaaatatatatacccccggatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaagagtacaaagattaatgataattacttcgaaaaattatttttgtctgtaataaattaagtggataaatcgtaataagcaaatatatgacttataattaataaaaattccaatatatatatatacttagcatatatatgaatgatattattatatgggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgtttaaaactctaattaacatacatatgaaattgacacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactctgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatatgtggcagttgttccatcgtgtcccatggcatcgacacgaacagcgctgttttggttcgtgtcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgtatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcggatgacctcttctgttcccataccccttggcgatgtttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaatgaaggtggaaataccaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagatgtgtcatcaacacgtgacagtcatgagactttaggtttgtgaacttcttctccttcgtgcttattattcgcttgatattcgtggagtatccagacggatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcattacgtcgattgcgtggcgtacgtccaagaattcccaatatggtaactcccaaaa

SEQ ID NO: 89137 - DNA, 2000 bp, Oryza sativa
acgtggcagttgttccatcgtgtcccatggcatcgacacgaacagcgctgttttggttcgtgctcttcatgtcttgggctcttgtgtagaatgtgtacccattgatctcatatcccaggaatgtcgcgatcgacccagacggtcccctcgccaggaaggcaagttgttggttgattgactcgttacccatgagatattgtcgtagccacgcggggaaagtatcaatgtgatgccgtgtaatccatgcatcggacataccgatgttcctagcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacagatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatatgtactttctgtttcatccatacagtgagggcaagccttgtaccccttgttgaactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactgtcacgtcctgataaattcatcccgaaataaaaatcattttctaaaaggaataatagaattaattaaaattcggaaagaaattggcaaacactaaaatacgtacaagaaaaattcgaatgtggcccggagaatttttgttaaattctccttggtcta
